United States Patent 12,797,487 (ANTISENSE OLIGOMERS FOR TREATMENT OF NON-SENSE MEDIATED RNA DECAY BASED CONDITIONS AND DISEASES) - sequence listing, part 2

SEQ ID NO: 17 - DNA, 156676 bp, Homo sapiens
  source 1..156676: mol_type = genomic DNA
cagggctggggccgggcgggcggcggcagcggccaggtgcgcagcgagcgctccgagcggcgcgcaccaggcggatgccccagccggggcccagcgaacgccaggtaagcaggggtgcggcgccgggggcccccagaccttcccaagccccttggcccggcggtgtcctgcaggttccctggccgctcccgccgcactttggagatccgggatgcggcggcagcagctgtcagcgccctcggactcccgagcccgcacaggtgggatttgggtggaggtgctgggagcccccgaggcctcggggacggcgagacacggccggctgggcaggcagcgctgcggagagttccgtggggttttcacctgcctagaggagggaaatctcggggtgtttgggttcttcgatcggtagcgacacacatgtccgggggttaagccaggtagggcttgcggctccttgggggatgccgctggctcctgtgcggtggctaccgcccctctggaagaccccggtgaccgggtcctgctggggcgctctttgggagcagatgccaacgtgtccgaaaaggacttgcgggccaaacgtatctgaccgcggcccacctgccgggagggatggagggggtgagatcgctctcctccccagctcctgtggcagggccaggtactcccagacatcttccgtgcgctttattgtgggatggggaggggaggtgatggggaagaccgacaccactgtttttccggtgactgtcgggtcgcgtccgccagccccgctgagatggctgcaggcatctccttccctcagcagtttggtgccctgcgctgtcacctcgctgtgtgcacgaggaggggcaacttgttggggggcgcggggagatgttgcagagaatggcccagtgctttaacacccctcgcccccacttctccaactccctccttctccccaaagtgaaagaaaagttctgaagtgtctgcccaacttttccgacggaggcgtgtgcctgtggtccctgccgggggttggtggctggttgcgggggggggcggtgctcggagcgcagatccgtgacggttgtacgggggagactggattgcagtaaggatgcaaattggggaagggggattgacacgcagaagtaaggaggacttgggccgcgcttctgcccggtgagtacccgctcaaccctacccgacccccttggcctgcacgcgctgcccttgggggctgcaagctcttcctgggtagctccagacgccgccgagttcctctcccggaaactggcctccctgttggcgtgagaaaatattcgctcccatcttcctggttgcattgccttcaaaattttgccactacccatgggaaactaaaaaaagaaaaaactagtgggatgtttggagatcacccggcacacggtaggttatcgatgaaggttaactgctttcaggaacaaaagctaaaaaaaaccacgcgtgataaagcctccagggatagtgaatacgagcccgtatatatgggggacacgacagcaaatgtgaagtagaagcgctaattttcgtccgctaaggaatacttttgtgttagacctaagatgccgttcattaattctgggcctgttgttgaaggctttattaaaccctattataaatgcgcagactgtgcacaagatgattaatgcttattagctgattactttctgggggagaagtcacgcctgcctgcagttaactcctctgaattctcttaatgattttcattaggtggtggagttttccttgctataattttgggaaggaacattaaccactttgttcattcgtcgttttccagtggctgtattttagtaacttttagtgattctttgcgtgggttattaagggccgagcaagactcttttggttattactgtccaacacagatgccacctgtgtgaggtcagctctggctgctttcaagttttccttatggattttaaggaacacacacacctgtgtgcacatgttattacatcctagtgatagaactgggagaggttttgttttgttttttgttcaatagaagtttaaaaataataatgtggtacagcaaatggcttcgcaaaaagaagtcttcggtggtaaggcaagttcaggactgattttatgtttaatctgattttcagtctaggggatcttagtgctaatggagtcactaccagatctggctgtagaatgttcttttcctttccttccgtccattcctctttcctctttcttttccatccttttgaagcaaggagtagtggaaaatataaaaatgcccacagatttcagttcttttccttattaattgtataaccttaaatgaattcttgttttctgaacctctgtttgctgctctgttgaggggaaaagatattatcaatctctttggattgttgaaagaattaaatcagagaacatatgaatgttctttatatatagtcagtgtttgaatgttggtttcttactttctttattagattgatatctaaaaatactattattgcaggtatctggtatatttttaagattttattgccttatgaattaaaattccattttagttttttataagcaacattcacagaatgcaggtaattctaacaactccagagagatttttcctagttacctttgctctttagtgtcggttactgaaaaagaaaccgatgcactcatgaatgcagaggaacttgctttttaggtaccagaacaagttgttttttaaaattttttataaataaaatacatagagacagggccttgttatgttgcccaggctgatctaaaactcctggcctcaagcaatcctcctgccttggcctcccaaagtgctgggattacaggtgtgagccactgtgcctggccccagaacaatttatgtcccaaatctctctaaaaagagatgccttttaaattgcttaagcacttaattttagagtttatttgtacacttggttctagtttagtctcctggaaagtttttcttagtggtgtctttaggtatcttgtgagttttcaggtctgttgacattcagttagattaattgtattcatgcctgtaggttttttgtttcttattaagtaaaaaattaatttgctgccagaagagtgttaataccataaaaagaagacaggttatatttttcattttgttaaccaagttactcctgaatccccattcccatgcccagctaaaagtaatacctaatctaagatcttttgaggtcctctatcactgaagacctggtattgtttaggaagattctgaaagcatatatatgtgcatgtatgtatatagatatgagcatgtctatatacgtgtgtatatgtatatattagtcttgtttctcattttctttttttttttttttttgagacagagtcttgctctgtcgcccagactggagtgcaagtggtgtaatctcactgcaacctcctcttcgctggttcaagcaattctcgtgtctcagcctcccgagtaactgagatcacaggcgtgtgccaccatgctcagctaatttttgtatttttagtagagacgggtttcaccatgttggccaggctagtctcaaactcctggcctcaagcaatccaccaaagtggcctcccaaagtgctgggattataggcgtgagccaccgcacccggcctcattttcttaaaaaacagataactttttatcatctgaatctttaaggccatattggtactttctttgatacttataaatgcactgcacttttaaataaattgttgcccaacccttccacaatgagaaatatgtttcataactggtccctgcaagcagtccagaggcagcagtgaaacagaggttgccagccttggagtcttttgacctgggttggaacgcaggcctcatagcttcctaggtgcataacctagggcaagttaccttgcctctctaggcttcagtttcctcatctgtaaatgggataataatagtatggcctcacaaggctgtgtgatgagttccaaatgagatagcttaggtagaggacttagcacacagttcagtaaaaggtagtcgttaatacattgttgtgttgttgctatgactttgtaaatatcactcacccagccattgcctttctcctgggctatgtaggaaacaggaatcattctacaagttagtatttatttagcaaacatcagtgcccatttgcaccaggcactggaaagatagagttccccagagcaggggcaaggttctaagtctccgatctacactgttgttcttaagccctggtggctcagaggaccagagtgctcatttgcctcttaaccttgcaggagaactcgtgagggggcctggttgctgtctcacctgctacctcttcctgcacagtagaagcccgtggaatgctcctgagccccctttacccatcacatcagttggtcttttctctccctcatcctccacgctcctgtttttctatttttaactttatttatttatttattttagacagggtcttgctctgtcacccaggctggaggggagaggcatgaacatggcttgctgcaaccttgacctcttgggctcaggtgattctcccacctcaggctctcaagtggctgggaccacaggtgtgccatagtacccagctattttttttctttttttcttttttctatttttttttttgtagagacagggtctcactatgttgcccaggcttctcctgaacgcttaggctcaagcagttctcctgcctgggcctcccaatatgctgggattataggtgtgaaccaccatttctgacccacactcctggtttttttgtttgtttgttttgttttttaattactacctgtttaaaactcaacagtttctgaaccctgtggcttcttgaaaggctcattgctccctgtgtggttttcttagttgtggatcctgggtaggcgttgctaatgacagagaaccttggtatagctcctttcattcattcatctttagactatgctgggggaattacctctctgcttcatggaagtctgtggggttcacagagggcctgagttgggtttcttctttggtgagaaagcagatcagaggcctggcgtggtggctcatgcctgtaatcccaacactttgggaaaccaaggcgggtggatcacgagatcaggagttcaagaccagcctgcccacatagtgaaacctcatctttattaaaaatacaaaaattagccaggtgtggtggcatgcgcccgtagtcccagctactcaggaggctgaggcaggagaattgcttgagcctgggaggtgaggttgtagtgagctgagaccttgccattgtactccagcctgggcgacagagtgagactccatctcaaaaaaaaaaaaaaaaaaaaaagaaagaaagaaagcagatcaggtgtctgctctcttcctgcttgggaccttgtccctctttgcatggagggatggtttctttaggtcctgggggatagcccaggccacttccactctgaagatctgtgttctttatcagtctttcaatctagtatatttgcatttaataggtgacaaatgggcctggaagctgtggtggggatggagtgggaaaccagctctcagtctgacattgactcctggaggggagggtcacctctgttcctgggcagcctttcagtggcgaaggccaccatcccccacagcgtgattgagaagcctggcacttctgcaatgagtactgtggagcctgacctttggctagtagcttggtctttattgacagggctgtcatttatggctttgttactttgttgctgagtggcttttgttctactggagttgcggtttgtttgatttagtgcaggtggcttttgaaaacagttttctaacctttattgaaattgagttgcactagaaaatcctctttggaaaccctcaggcaccaaatactgtccttcacttagtatcagaatgtatattcttgctgttcagggaagcttccatggattggatgcactatttattttatagagtgtggtgtgattcatgtacacatccttattttctcttcctggaacttagtgagttactgacatgatcctctgagatttctgtgcatgatctgtagatccagaaggaacacttaacattttctataagaacatagctaacacctgtaatcccagcactttgggaagacaaggcaggcagatcatgaggtcaagagatcgagaccatcctggccaacatggtgaaaccctggtggcacacgcctgtagtctcagctactccagaggctgaggcaggagaatcgcttgaatccgggaggcggaggttgcagtgagctgagattgcaccactgcactctagcctggtgacagagcgagactctgtctcaaaaacaaacaaacaaacaaacaaacaacagcataggtaaccctttggcttgggtggtttaaatatttactcacttggggagatgggtaggttttgtacatttcatgctgggaaataatgcccctatctttatattgaaaaattaaagtgtgagtcctctaagtcaggcactagtagctgctgtatcaacctccagttttttgttgttgtttttgtttttttcatttagaggcagggtctcaagatattacccaggctggtctcgaactcctaagctcaagtgattctcgccttagtctcccgagtagttgggaatacaggcatgtgccactgcacccagcaacctccagaacttttgttacagtaaggactccaagtgtgtgaagttcatcaggctacaaagattgtaagaattaaaagaaaatctgtgctctgatttgtaccagtacaactttgagaggaggagaggttccttatgatcttgtcttcttggtgtagaagtttatttcatgggagtttttaaatttttttattttttgagatggggtctcgctctgtcatgcaggctggaatgcagtggtgcgatctcagctctctgcaacctctgcctcctgggttcaagtgattctcctgcctcagcctcctgagtagctgggattacaggcatggccaccaggcttggctaatttttgtatttttagtagagacagggtttcaccatgttggccaggctgatcttgaactcctgacctcaagtgatctgcccaccttagcctcccaaagtgttgggattacaggtgtgagccactgcgcctgactttttttttttaaatgtaaaatatacataacattgaccatcttgatcctttttcagtgcacagttcagtggcattaggtacattcacattgttgtgcaaccatcaccaccatccaccttcagaactttttatcatctcaaatagaaactatgcccatgaaagagtaactacccccttcttcctatttcctggtccctgtaacctctattctgctttctccatgaatttgactattctacagtacctcaggttaagtggaatcatgcaatatttgcccttttatgactagcttatttcactagtgtaatgtccttaaggttcatctatgttgtagcacaagtcagaatttccttccttttttagggctgaataatattccattgtatgcacataccacattttgtttacccattcatctgtgatagatatttgggtagttttcacctctggctactgtaattttttcaattaaaaaaattttttttaagacaaggtctcactctgttgcccaggctggagtgcagtggtgtgatcatagcttactgcagctttgaactcctgggctcaagccatcctcccgcttcagcctcccaaatgtctgggactacagacactcaccaccacacccagctaataaaagaaaaaaaaaatgtgtgtgtgtgtgtctgtgtgtctcgatatgtcgcccaggctgaactccagggctcaagctagcctcctgccttggcctcctagtgttgagatgacaggtgtgagtcaccatgcctggcccacctctggctattgtgactaatgctgccatggacctgggcatacacatatctgtttgttcatgtcagtttttgagccccccttattcagtttggtaaaatgtatccttcataaataagatgggcagggccacgtattatagtatttattaccatgctttcctccagagtagcatggaaataagaatgcagggaatgtgggaggagggtgttgttgaagacacctgaaggcagcacgtgcctctccttttcacctgcagctgctctcactgagctggcagtcatatgccattctttctttctttctttctttctttctttctttttgaggcggagtttcgctctgtcgcccaggctggagtgcaatggtgcaatctcagctcactgcaacctcaacctccgcctcccaggttcaagtgattctcctgcctcagcctcccaagtagctgggattacaggcacgcaccaccatgaccgtcatatgccattctatcatccaactggtctgtgctatgggtgactctttcctctgtgtcagggtgggtgtaaaagccccagggttgtggccctactatctggccatctctgctaaccacagccaccttccagagatgacattccatagaattgacttttttttttttttttttttttaatgtcaggttgtttttccccttagggtagaatccatggcaaggcaaaaggtcagttacagactgtagcatggcagagttatcaaatgttccacctctataataatgtgcttataggtgtcctggtataaaaatcagatgcctttatgtaataattagacatcagtctgttaaagacaccttaatctgtagtttctagagaacaatagactctcatatgagtttatactcacactgtgccctgaaaattagccaaataaggatttacgtgtttaaaaagcaggtttttaaagtaaaacaaaacaaaacacacaaaaactcatcaaagcttgaagccaaccaaaaatactactatccctacgtgtccacccactttcctatttaatgccaaccacagccacaaaaagaatactggggttaacatggttaatctcttggcgatctgatactttatttgtctagttcagctgcattaagagcatttagacttttgttatcagtcttaggctttctctccttctgtagaacaacatgaaaattcttaaaagtcaatttgagaaccttaggctgtgaatggtgatgtaagtagcagctaacatgccctgaatctttgaggtcactgggaccgagagaatgggagggcaagggtgcaagctgccattgtaaatagagtggccagtggaacctccttgagaaggtcatatttgagcaaacactcaggaggagagagggtggcacaggaagttttggggaaagagtgtcccaggcagaggggacagataacttgctgcagaagccctagggtaagagtgcttggcttatctagctgttcctccaaagagtaagtgggggagggaaggagaagaaggaggtaagggcagagaggaaggggagccaggtcttgcagggcttgccaggctatgtaaagactttggctttgatttcttggaagatggctcagtgcaggacattgctccttggagtggtgtgatctgtgtgaagaccagtccaggcagaaggctcccaatccgggagttcaagcaggaggcaaagccaggcaagtgagggtggaagcttttcccagggtggtagtgtccgccaggatggtagctgtggggctgagatgtcagattcttgagaaagacagaggagaaaggacacagagagaatgggatcggacacaggcatacgtgcaacttttattttgatagatcgaaatgccaacaggacttccgaacagatgggatgtggggtgtgagagagagaggagccaaagataactttctcagcagaacctgggtcgcaaaaggaaatctgagtttcaaaagctggaaattcgctgggctgtgttcagattgcttgcaactaggttataaagagcctcctcagaaacatacatataaggctttggttcagagaactttgtgtttaccatcagcctgtcttcctagtttgggggaaagaacattgttagaaaaaagaggcggttttcaggaagcagaggacttgacttcattgacaggagggcggtctgtaacccacaggctgtcctgccagggctgctgctgcagctattgccactcacaagcccctagtccccctccctatcctgtttgtcttttgcctaattgggaggttaagctttttccagccactccccatctccatacacatggatttttttgttttaaacaactatattgagatctaagtcatgtaccatacagttcagccttttaaaatatacaattcaatggttcttagtatatttacatagctgtgcaactgttgccacaatctacgtcagaaccttttcatcacccctaacagaaatcctgtaccttttagctctgcctggtttatcgccttgtccccgcagcccctggcagcctctcatctaccctctgcttctgtgggtttgccgattccgggcattttatgtaaatggaatcgtatgatatgtggtcttttgtgatcatctttttacacttagcatgatgtttttcatgtatattacggtcgggtgtggtggctcacacctgtaatcccagcgctttgggaggctgaggtgggcagattacttgagctcaggagttcgagaacagcctgggcaacgtggcaagaccctgtctcaattctttttaattgtaaaaaaaaaaaattaataaaatttcatccttattgtattatttgtcaatacttaatttctttatattgccaaacacactagctactggtgcacgtaatacatccttcaaaaaaagcacaggccatggaaatgtgtgctagttgcaaatagactgacatgttataaaaggaatgttttgtgcccagagagctacaaatatgtgtgtgtggatgtaagtatgcattggctcaccttcacaattgattacatggtccacagtgactctaaagacaaggggccttcaggtggcctagtgattttctttcattcagtgattcaacaattacttattaaatacccactacgttgccaggtgctggcagtaaacacagtgaggagcaaagcagacatgcccttcccctcagggagcttatggggttgttgagagtgtgatgagagatagagactaaacaaaatattgaacaaaagagatatgaaacaacttgatattagaattataatctgtgataaaggccttaaagaaaaataagatatttctaagagaataatgaagacctactttaaaatggcctaggagtaacccaggcatccaccgacgaatgaatgaataaacaaaattggtgtacccatatgattaggatgtttctcagccttacgaaggaaggaaattttcgctgagcacggtggcttatgcctgtaatcccagcattttgggaggccgaggctgggggataacttgaggccggaagttcaagaccagcctggccaacatggtgaacccccgtctctactaaaaatacaaaaaggtgcagtggtgggcacctgtaatcctagctactcgggaggctatgacacaagaatcgcttgaactcaggaggcggagtttacagtgagccaaaattgtaccactgcactccaccatggacagcagagtgaaactctgcctcaaaaaaaaaaaaaaaaagaaaagaaaagaaaaagaaaaaaggaaggaaattttaatacatgctacatggatgaactttgaagacattatgctaaatgaaataaatgagatgcaaaaggacaaacaaatattttgtgattccacttatatgaagtgcccagaatagtcaagttcagagacagaaaactgagcagtggttgccaggggctggagccagtggggaatggagagttagtttttaatggaccctgagtttcagtttgggaagatgaaaaatttctagggatgggtggtggtagcaattgcagaatcatgtggatgcacttaatatcacttagaaggcaataaggccggacgcggtggctcatgcctgtaatcccagcactttgggaggccaagatggacaaattgcctaaggtcaggagctcgacaccagcctggccaacatggtgaaaccccatctctactaaaaaatacaaaaattagccaggtgtggtggtgcgtgcctgtaatcccagctactcgggagactgaggcaggagaattgcttgaaccaaggaggcaaaggttgcagtgagtggagatcgcaccactgcacttcagcctaggcaacagagcaagactctgtctcaaaaaaataaataaaataaaagtagttaaaatggtaaattttatgctttgtccattttaccataatttaaaaaatggcccagggagtggggtctcttgaaggaggttatacttaagttgagacctagaggataagaaagtaccagtcaggggaagagtggtccagtcaatgggaaccgcatgtgcaaaggccctggggtgggtgagagcttagtgctgtgctctaggaattgtgagaggccagaatactgggtgtgacatgatgctggggctaccatgggataagggaggcaggcaccaaactgcagagaacctgataggaagtcactaacatttttaagcagcggcgtgatgtgatttgattcctggttttgtttgataatccagagactgcgatatggggaatgggttggttgttggtgggggatgggggtgggggcagggaatgaggccagaagcaaggagaggaaatctgggaggctgctgcagtgtccatgagagagagaggatgggggtttgggcccgatgatgggagtggggatgagaactggaaggtaggagccgcacttcacaaggggaatcctggtcttggtgatgggttggatttgaagatgtaaaagaagagaattgttgacaattctcaaatttctaacataagcgactaaaggtgatggcatcactgagaccaaggagtagttttagaagatgaatgtagctttgatcatgtttagtttgagttgctgggacacctaggtgtggtcgggggtcaagcattggtgattcagaagtctaggttggagacacagttttgggaattgcaacataggattgggtttaaggagctgtttggggatgctggaaacgcttcggaagccagtgcttcctatcattggtatcagccttttagtttgcactaatttatgtaaaataatccactattttttggcaacaaagtatgtacatgtgagcaaaaaaaagcatttgtgcaaagtcacaagccgtgctttatggacaaagatgacagggtggagggctgatacagggttgcctagtggacaagaccaccatacatggctcaaaacgttctcagatgtgggaaaggggcgctttgtatggtataggaacttgctaaagccagggaatttcttgtggaaaaccgacttttaaaattggcttgtgtggcctgacttaaaaaccaaatcactcttttcatgtgtgtagggtagtataacaaagtggtgctgcttttgtgctcaatgtactgtatttccacatgttatattgacccacttagtcccgtggtgtattaatttcctggtctctttttgcaagcaaaggaattataacttgcctgaagtctcagaactagtaattgacaaaaccagaaattgcagtcgtgtttccagactcacaaggcgagggttctttccgagacctcacagccgaaggttggaaaatcgatccaaatgactcagagatagggttgccaaatttaacaaataaaaatacaggacacagttcagtttgaatctcagataaatgatgagtaattttttttagtataagtgtgtcctatgcaatgtttgggactgacttacactaaaaatgatgtgttctttatgttaatgtcagatataactctgtgtcctatatttcatctggtaacccacccagaaatgaactcttggaacacaaaatcatttgtaatttgtggacttcctgtatattcaagctccttatagaaactcctggatctgccaagcattttgttttatttgggggtgggagtggaaggaggatttattttcctattctcctaaaagggctgtgttgtgatattttttccatctttaatatctatgatttgtaataaacagcagcctggttttgggaaacaagcccaggagatgtcagctctggtgagtcactgaatgggctggctgacctcagctaataatagcaattctttacatttttaaagcactttatagttttaaaatctcctcatttgggagttggcaagacaggaattatccccatgggacagatgagaaacacaagggaagcagggtttgggggagtgggtggtgccaggaactgggttagggtactcttttcctaactttcagttcagtgatgagcagttaattttcttttcttttcctttctttcttttttttttttgagataagagtctcactctgtcacccaggctggagtgcagtggcacaatcacggctcaccaggacctctgcctcctgggttcaagcgattctcatgccccagcctcccaagtagctgggattacagatgggcaccaccacgcccgactaattgtttgtatttttagtagagatggggtttcaccatgttggccaagctgatctcaaactcctggcctcatgtgatcctcccgccttggcctcccaaagtgctgggagccaccatgcacggccagttaattttctaagctccgattttttcgtgcttcaaatgatggacctgatgttttataggataccctctcattgtaattccatgcctctctgtgatctcatttgtcataagcttccaatttttaaaatgtacaggttgtaaatcatttcaagctttgtaggtccagatgacaataaaatatatgtgtttcagtagcagggatagacaataggttttattttgttcattccgtattcagtttgtcttgttttatagatggatctcgctctgttgcccaggctggagtgcagtgtcaaattatggctcactgcagcctcaaactcctgggctcaagggatcctcccgcctcagcctcccaagtggctgggactaatattcacttttatccagtactgtcatgtctacacaatggatactatataggtccctttagaagatgtataaaattttaaatgaggcctatttattttaaaggtgttttttctctattttgatagatgttaaaccttcagaaaaactactgacattcaaaaaggtatctaacccctgaggtttgacaaactttagagcatttttaaaggaatagactttttaaaaactgaaaatcagtaaatatcagtaaccaatgggctctaaaagccaactttgaaaaagaagctcatgacaaagaagccaaaattacaagaggaaatggtatagcggagccaacactccccacccacagtgttctagatggagctccacccacagtgtcctagatggagctccacccgcattgttctagatggagctcctcccgcagtgttctagatggagctcctcccgcagtgttctagatggagctcctcccgcagtgttctagatggagctcctcccgcagtgctctagatggagctcctctcgcagtgctctagatggagcttttaggctcactttttatcagacgaatttatgttgtcttttaggttcttgtgtgtgtgtcataaggaaatcagtaagcataaagtggctttaattgcacttggcagaggactaagggtatataaagattggtgaccgttgtgagaactaaagtacattttatttgcttgtaaaattttgtttgccacgatatcttaggcattatacaatgatttccggtccagaggatcctgagaatttaacatgaatattatgaagtttcctgtcttcaaaattttgtatttgaatacttattttaatatcgcttaaatgtatttctaacataacatcctgtctggcagtctttgtaaactctcaaatttgtctaagctctaagttgttaggggtcattcttctgttccaagtcgatgttgttctccatatctgctgtatttcaataccccttactagacgtaaaaaagataagagtatctctttcaagcaaaccttaatttttaaaaacaccctttaacatttttttgtgtttctagttttcatgaaccattggaagaacacattgtgtttttgaaataaaggggcttggctgggcacagtggctcacgcctgtaatcccagcactttgggaggccgagatgggtggatcacttgaggtgctacctcctcctggaagatttcctgattccttgtctttcccagaccaaagtgagggactcttcctttgttctagtggttccctgtacattctcatcttagcataggtggtaccatctcggagatggtagctagcttttatatcagatgtggcttgatcagtggtggttgcctagacactggttttcaaagtatggtccctggaccagcaacatcagcatgactgggggctgcactctagagtcactgactcagaagctctggggttaagacccagcaatcagtgtcctaataaaacttccaggtgattctgatgcctgctccagattgagaatccctggctgagaggcttttgacgagctggattctgaagtgatgtccagccacggcagcaaaggtgtgttaggattccttagtcctgtcaccttgagcaggtgagaagcaggacagatgtgggcctaggggtgtggcatccctgagctatattgtcattgctggtctatttgtctgtgtttacactagtggccaccttggtgagaatagcaccttggcaagactcatgttgtagctcagcccccagcgcagttcttaaattgtagcacctgttctataattacacattaaatagtaaagtcagaaacatgcctttccacactgataggtactagcattagctgccgttattagacacatgttttatgagagagaaggccattgaacaacatcgaaccaataattgttggctgtttttatagtgactctacaatgaaaagaatccaccgtggcctaattaagtgaattttatggcttttactccttcactaagctgccagaggagaataaccaagttctttcttggacttcataacttagtataatagtcacaaacacaaatagatacttacggccaggtacggtggctcatgcctgtaatcccaacactttgggaggctgaggcatgtggatcacttgaggtgaggagtttgagaccagactggccaacatggtgaaaccccatctctactaaaaatacaaaaattagctgggcatggtggcacgcgcctgtaatcccagctactcaggaggctgaggcaggagagtcacttgaaccctggaggtggagcttgcagagagctgagattgcaccactgcactccagcctgggcaacagagcgagactccgtctcaaaaaaacaaaacagaacgagacaaaacaacaacaacaacaaaaatagatatttaaagatttttgcactaacttttgatacttactgccatactttggaaatgcaacaaaaatatcgggaatttgttttaagcatctacttaggaaaaaaaggactcttatggcattttggtttgggttagagatatttttacaaatgttatttgaaataaacaccatcccataactctgagctatgaaatatttacatacaggggaaaatccagctaacacctatatccactcactgctctattttgggtttatgttgttgtcaaaagacaaaggataaagatttttcaagatcttgtgtattttggggttagtataactccaattgttttctaattcgatgaggcagcatccaccttaatactaggtctggttttttaaagtcaattttaggtgcttgtcaacaaagccggaacatgagaaaattgaaatgatttgtgaagctcttactctggcctgcccgtgaactttttgagacagaagaccggcaccagtttattaaagactttgtaaaagtatacttaacttagtcaaccagatgtgacttttgctccctggggaacattttaagttgtcacaattcaggatgctacaagcgtccagtggtcaaggccagggatacttctaaatatcctacaatatgcagctcagcctctacaacaaagaagtatcttacccaaaacgtcactagggttgaggctgaggaattctaccctaaaccacgggtaggagtcctcttaaaatgctacggtttcgcaggacttagtcataggcacgtttcataatactctcctgcacgtttcataatactctcctgcatgcccctaaacacagcacctcgagcattgaactctgacatcagttgagaagatgatacccctctagctggtgcttaagccttctggcttaagcctggacttgatctctgacccctttctcttccagactgcaccctgctttcatttccaatccgtctccaaggcctgttgcttctacctctggaagaccttgactccacctgataacctctatctccgctgccatccgcgaggttcaagctgtcatcctccctctcctggaccattccagtagccttcttacatgagggctacacttctaccctgccccttccaaaccagagcacccactcagatcctgccaacccttgcagtagctcatgctgtggttttaacaacagctaccttctctccacagctctctatgcccagcccgccctgaccccggcttccccctgcaaattccattctttttctccttcagtttctgaagcatgacgagtcccttcctgtcccaggaacttcagatttgctgctttctcgcttgaaaagctcttcctctgaaaggctccttatcttttgccttttggcccaaatgtcatttcttcagcgtagtctctgcccaccccagtaaaaattaaagtaggagtccctcctgagttatgtcctctgctcactctttctttttcaagtagcaaggatgtagagaacaggggaagcccagaaatactgttgaaatgacaacagctctgtcaccatgcgcccttcgatgtatggtagaggagacggcttctgtgttttcttcaatgcttaatttcctttattatttttattttttttttaagacggggtctcactctgccacccaggctggagttcagtggcgcgatctcagctcactgcaacctctgcctcccagttcaagcaattttcctgcctcagccacctgagtagctgggattacaagcgcgtgccaccatgcctggctaatttttgtatttttagtggagatagggtttcactatgttggccaggctggttttgaactcctgacctcaagtgatccacctgccttggcctcccaaattgctgggattgcaggtatgagccactatgcccggtcttcaatttccttttatattgtctcttcttgtgaatatcaggagtcttgcttcacttaaggcagcatctaccaggcatattcgatatttttaaagttcttattccccacagtctttctatattattaaaggaaataaatacataaaaaagacttgtttgttaaaccatatgtgtccaccctgttgtgtgcctgtcatcagtttcaaaggaccacagtaagcatgttagaacttttgttaaacataaagatatataaatattatcttatccatgcctgcgttccatcagatgccctctttcccctgtaatctttacagtttctactttatagtctctctgtagagcattcttaacctgaatagtgtgttctctgtcacccatcatacttctaggaacgtccccgcctcccttcagccagtgcatctttagaaaagacaaactaggccgggcaccgtggctcacgcctgtaatcccagcactttgggaggctgaggcaggcagatcacttgagctcaggagtttgagaccagccagaccaacatggtgaaaccctgtcgctactaaaaataaaaaaattagctgggcatggtggtgggtgcctgtaatcccagctactcgggaggttgagccacgagaattgcttgaacccaggaggcgagtttgcagtgagccaggattgcaccattgcactttagcctaggcaacaagagtgagactctgtctcaaaaaaaaaaaaaaaaaaaaaaaaaaagagacaaactagaattaatctgagccaggtatcatttagacagtaaatctgttttcctaaaagaatcatattatagtcaaggctcaaacaaatagatttcatattatctggagcctttctaaaaatgcataaaccagaggtgactgaagaattttttgtctgtgtgtgtgcgcaccattcattcttgactttttgataaatgagattctcaagttcacctgggaagcatcaaaaacattgatgcctgagttctccttgccagagtcttattagccagtctgggataaacctggctgattctctcatgcgtagtcaagacagagaatggcttggaaagtagacaatgtaagagtctactctttataggatgcctacacgcataataaaaaatttacttgggtttatggaaatgtctagatataaacctatggggaaaatgattgaaataaatgaatggtgtaacgtaaggatgctggattggcgtctgcaacgcagcagctgtgggtggccttgatgagtcttacttaatttcatagctcatatctgtgtagttatttgctgctggcaaactattgcttcatcttattttcgcaaattctatagacagcagggcttctttgcatcttctgccctttctgctccattctccaattaaatggatttcactgcagcagctttctgccctatggcagaggcctcccatgtgcttcccaggctgggttaggtatggttttgccaagctcccactgcaacctgagcatattgtcttctcctggcatttactgtattttaaatattattattactggtttttagagatgggttctcgctctgttgcccaggttggagtgcagtggcctgatcatacacagctcactgcagctttaaacttctggactcaggccatcctccagcctcagcctcctgagtggctaggactacaggtgtgtgccactatgcctggctaattaaaatttcttcttttgtagagacaggggtatccttatgttgttcaggctggtctcaaactcctggcatcaacatcaagctatcctcccatctcggcctcccaaagtactggaattactggtgcgagccactgcacccacctatgtttcccatattgaactgtaacagtctgtgttaggatttaagttatagtgagagatcacgtatcttcttcatccctggagtccacaacctagtaggcattcaataactgatcaattaatgaatatattaattttcactttacagatggggacactgaggcccagggagactaaatacaagttcagcactcacacctcccctaatctttctgagctctggattcctcttgtaaaaataaagaattttggatattttttctaataacccatatagctcaaaaacaggtggttctgttttatgattttaacaactctgcagtgttgccaaaactcaacaaagctgtctccagatggagtgaaacagtctcaagaataaagataatgattaaaataacgcacctactggcaagaatggaattcacattacacttcaacctagatcaggaactcagtcccaacttctgagtattaaaaatcacctcgggagactttgaagaagtagaagttcctgtgttttatcccttccctttctggagtttcccaagtgattttgaaggagaccaatcagcatttaatgcttccttttttggtgttcttggagatgactcatatctgaccagcagtggttatgtgaatggtcttcatgtctgattttaacattttaaacagtgggctgacccaaacacagctctgtttgagcagccggcctggccaggccacatatatcatacataccttgctgagacaaggaaattgtcttctgtagaaattctgttggaatcagagaagtggctatcgaggctggactcttgaccatttagaaatcatttcctaatcagttatgtcaggacgaggggcaggcatgctggaaaaacaaaagagagaaaggtgaaaccacagcttccttctgttggggtgaaactgtccacagaaaaaaataaaagttttttacatatcgtgtacaatattacctccatcaggcaacctcttggttgaagccaactgagagattttgaaggctgcaaaatgattgaacaagtgtatttcttagggtttaaatgaaatccctccagcgtttagtagaactggcaaactatatggactcctgattactaagtagttacgatttcctttcccccatctttcaagaagcttgtttttatttctggtttgcctgctctccacaccccctcacccagctgcctgaattggaaaccagcccaccatagttttaattgtgaaattcctgaagctgttaatatatgtaaacatacaacaggatgtttcccacagctgtgcataatgacttgggaaacaggccagaagacctgttttcaaattgggtgaattctataaagtcttcagttaggtttagagtaattatacatttatgcatttttattttaaaaggactttaaacaaatttcacaagttggatattttttaatcctttcaaggatttactcaagtgagcaaaagattaaaaactaatgtttgctttacctttttccaacttcagattttaaacattcctctacatttattgacatcttccaaaacaattttacacagacagacaaatttgtgaaatttgagattcataataaatctgttatgagaattagaaatgtgggcttcaaggccagttggtttattcagcatctaagctctaacatttatatgccgtggtgatttataacaggtttagccaaaagagactgtttaatattataactgttaatttacctatgttatttttgttattttttctttctttctcttttttttttttttgagacggagttttgctcttatttcccaggctggagtgcagtgggaaatctcggctcactgcaacctctgtcttccagttttcaagcaattctgcctcagcctcccaagtcactgggattacaggcacccgccaccacgcccagctaatttttttgtgtttttagtagagacggggtttcaccatgttggttgggctggtctcgaagtgctgacctcgtgacctacccgcctcggcctcccaaagtgctgggattacaggcgtgagccgccatgcccgcccctattttttctttcattacacaagttaagaatggataattatactaaaaataaggtagaaataccatgttcggtgttgctaaaattaaaaagtgaacattaggctatacctgataccaactttggatttcaaaggttaattttacattttatttttgccccttctgggagcctttcagctctgcctgtgagtgctcctaattctctgcctctctcaatgctggtttgagtgaagtaatttctctctgctgctacacttctttcttcttctccttctccttcttcttcttccttttttttttctgagggagggtatcactctgtcgcccaggctggagtgcagtggtgcagtaacagctcactgtagcctcgacctcccaggctcaagcaatcctctcacttcagcctcccgagtagctgggaccacaagcacatgcccagctaatttttgcattttttgtagagatggggttttgctatgttgcctgggctggtctcgaactcctgggctcaaacaatctgcccacctcagcctcccaaagttctggaattacaagtgtgagccattacacccagccctgctaaacttcttatgcttggtccataaaagccttcttaagctacttttggccaaatttggaacctttctaaaatatctcaggattcttgtgaagtgtaatttgtgatttcttctgtttctgggaaatcctctcccttgagcaggggttagacctggtgatgcccttctagtgaataaaatatggccacagtgatgggatgtcacttctgaggctggggcacagaaacaccccacttccctcttgctgatgctctctcatgctctcacttactgtaagagaagccagctgccccatggagagacattcatggcaaagaactggagctggcctctggccaacagcccaagaggatggaatcctgccaacagccctgtgagtgagcttggaggtggatcatccccaggccgacctttaggtgactgcagctctggctcacaccttgactgcagccttgggaggagaccctgagccatacccagattcttgatccattgaaactgagattataggccgggcgcggtggctcatgcctgtaatcccagcactttgggagggcgaggcgggcggatcacgaggtcaggagctcaagaccatcctggctaacatggtgaaaccccgtctctattaaaaaaaaaatacaaaaaattagccgggcgtagcggcgggcgcctgtagtcccagctgctcccgagactgaggcaggagaatggcgtgaacctggaaggcggagcttgcagtgagccgagatcgcaccactgcactccagcctgggcgacagagcgagactccgtctcaaaaaaaaaaaaaaagaaaaagaaaaagaaactgagattataaatacttgtggttcaaactgctaaatttgggggtattttgttaggcagcaacagataactaatacaagggcaaagatttaaggtacaattaaagttgccgcttgcatgtggggagctcactatctggtaaatgcttctgttgttgaccatcactggaaagtcaagatgtgataccatcatgtttgttatttcctgataaagggctcccacagtttccaagcttcagttttgttccacctattatttgttttttcatttaatttttggaataagtaatacatgcaaatggtacaaccttcgaaaggtacaaaagggtattaagtgtcagccttggccagataaggtggctcacgcctgtaatcccagaactttgggaagccaaggtaggaggatcgcttgagcccagaagttcgaaaccagcttggccaacacggcaaaaccctgtctgtacaaaaactacaaaaaattagctgggcatggtggcacatgcctgtaatcccagctacttgagaagccgaggtgggaggatcacttcagcctgggaggcggaggttgcagtgagccgagatcccaccggtgcactccagcttgggcaacagagtgagaccctgtctcaaaataaataaataaataaaaaataaagtgtcagttttcctgcctccttttaacccagttacccaactctcctacccaaaggcacgggccatcaccagtttattggttatctttttagaaatcatctttgtgtttacaaacatatatattcatgtttcttttttcccctggaacaaatgacagtggaatttgactttcaatggcctgtctcaggaagatggtagatatataacagattgaaatcttacatagtttctgcattggattcctgcattggattccagctttcaatagataagaaattagcctggctaggcactgtggctcacacctgtaattccagcactttcagatgctgagccgggcagattgcttgaacccaaaagttcaagactagcctgggaaacatagcgaaatcccatctctacaaaaaatgtaaaaatcagctgggtgtggtggcacatgcctatagtcccagctacatgggaggctgaggtgggaggaatcacttgagcccaagaggtcaaggctgcagtgagctgtgatcacaccaccgtactccagcctgggcgacagtgataccctatttaaaaaaaaaaaaaaaagcctgagaaaacagttggaaaggaagataacagattgcataacgatcggcctggagtaggacttagagaagccatctggagtattgaagacatccagatgaactgcttttgaagaagcttccacagtggagtatcttgttgacctttgagggaaggggggtgaaaataacatattaggaaatgtcctagacagttgttccagccttttctcctattattttctagccaacttctcccaaagaaggcttcacattgtgaaaaataattgcttttttctttctttttttttttttttagtgacttggttccagtcacttttaaggatctaaggtgactctgagttagacaggaaatgagtcctgagaacagatatgaggaggaaagaaaagggcttgctgttttatttcccctcctttctctcacctcagtgggcagatctgggtgactgtggttgattgtgtgggtgggctcccaccctccaaaacaagtcactctttccctgcctggccctgagacctccgtcacttgtcttaacctcttcatgtctctgtttctttcctgcaaggtgaaggtcattaaacgagataattaaaattactttcaagagtggtagaagcctaattcacgtgaactcacatgaatgcgaggtggtactattacagtcattacctttaaaattatagcagcatgcccaacaagacacagtggaggcaaagggtcgttggacagaactcagctgaatgccaatgttagttttgtttccttaacgtgtagtatcggttccaaatggaattgaatcatcaagtatgcttacctggtttattatgccaagtaacaagattggccaatccttcttatttattgttcagaaactatagaagaaagcagccaacaaatgatgatggtttttcagtgactcatgcctcctttgattagaatccaatgtagcctactccttatcctggcatcattactagatattgccttttattttgactaatggagcacatgaatggatagattttaaagaaatgcctaggctgggcgcagcagctcacgcctgtaatcccagcactttgggaggccaaggcaggcggatcacctgaggtcgggagtttgagaccagcctgatcaatatggagaaacgccgtctctactaaaaatgcaaaattagccgggtgtggtggcacatgtctgtaatctcagctacttgggaggctgaggcaggagaattgcttgaacccaggaggtggaggttgcagtgagctgagaatgcaccattgcactccagcctgggcaacaagagcgaaactccatttcaaaaaaaaaaaaaaaaaaacatggccagttgtttcactgctctctgacagaatcctgacagaatctcttgctctaggtagaacaaccaattttttattttaggctactcatctgtgaccttgataatatggagttagaattccttcctcctttctatttctttccgcactccctgtctccttctttctctttcctcccttctcccttcctccctctcttccttcttctgtctttccttctccttttccctccattccgcccctctccttcctccttccctcctcctttctttttctttctttcgtctctctccccctccttccttctctttctcttttctttttttgagacagggtctccatctgtcacccaggctggactgcaatgacatgatcattgctcactgcagccttgacccctgggctcaagcaatcctcccgactcagcttttcaagtagctgggactacaggcacatgccaccacgcccaactactatttttgtactttttgtagagacggggtttcaccatgttgcccaagctggtctcgaactctccaggctcaagcagtgcacccctcttggcctcccaaagtgttgggattacaggcatgagccaccacacctgacctctgtctctccttccttctctttctcatctcctctgtgccaggctctgtcctgggtgttcatcatacaacaaagagaaaagagacaagattcctgcccctatggagttggcattcttgtgtggagaagagaataaacacactaatatgtggtattaacatttatcacacgttgatgatatatgcaaggaaaaataaataagcatgaagggcaaaagaggtgagggcttactattttgtccaggtgactcagggagccttattaataggtgacttttcattcagtcaacaaacatctgtaagatagttaccgtacattgtactgtattctgggtgctggggatgtagctaaacaaaataagcaaaaatccctttgctctgggagtgtacattccggttagaagagattattaataaataaattttatttatttttgagatggagtctcacactctgtcgcccaggctggagtgcaatggcacaatctcagctcactgcaacctccgcctccaggttcaagcagttctcctgccccagcctaccatgtagctgggattacaggcacacaccatcatgtccagctaatttttgtatttttgtagagacggggcttcgccatgttggccaggctggtctcagactcctgacctcaggtgttccacctgccttggcctcccaaagtgctgggattataggcatgagccactgtgcccagcctaataaattttaaagtctgatagcagatgagaagtgctatggacaacaatgtaaagaagggggactggcaaggctggggtttaaatatggtggtgattgattgggctcctaaaaaggtgacattagagctaggacagtaaggtgaggggctaagccttgtggctacgggggaagagcattccaggtacaggaacagacactgtgtggccccaagctccaggaccagggagacagcagggtggctgtagatgagagggaaagagagcaggtagattttgggttttactctgagagaagtgagaacccactgcagagtttcgagccgaggagtaactccatctgattacctttggaaagaatcagcctgccctccatgttggagctagactgaagggcatgctgtctggggctacctctaatccgggtgagggagaacagagcttcagccaagcagcttgcagggaggtgaggagaggttttaggttctggaaacatttggaaggcagagcctagggcttacggatgaatagggagcagggtaggagggaagatgagactccagcatgactctaggtgtttggcatgagcacctgggagatggggttgccttttactgacgtgaggaagcctgggggataatggagttatgagggaaattgaggggttcagtcttaggtttgagtagacacttgaagtttgaaatttagcttcctttggctaaatatggaaacatttgggggaaccaccctcttcttgaataaaatgctaataagtgcgtatagaatgtcagggccaaataagaacccttgcagagttcagctgcctgcagcagttgctaaggctagaaactgggcacctttttcaatgtttttcctcccagaccccctgcccggatgaagtgagttgtaaaatgctgcctctgcctctgaaagttctgccagaaatcccaccctttctgtctgcaccaccttattagcctccgcctttggcccctgttgccagaggacagtaaggactttctgcactcttgtcttggccacagattaacaccatcttttcctggagtccttggtcagggttatcatttctttcttttctttttttttttttttttaagacagagtctcgctctgtcacccaggctggagtgcaatggtgtgatcttggctcactgcgtcctctgcctcctgtgttaagagattttcctgcttcagcctcctgagtagctggaattacaggcatgcaccaccacacccagctaatttttgtatttttagtagagatttgttagtagagcctctgcctcccgtagtgttggaattacaggcatgagccaccgctccaggcctagggttatcatttctaaaatgcaaatctgattaaaacagttcatgttgttgaggccccagcctctttgcacagatggatcctgcacttctgctccccacctcctcacctctgcaggtgcttcaacttcaggaaccaactcacttcttccagaatagcttcctaggcccccttccctgctctatgtcctcatcgtccctgttacttctccatcacagcagagaggcttctgtgcgccgaattcctagggtctgccttaccttagactttaagcttcatagggacaggagccacgttgctcaccagcagctgactgaatacctgccacgaggtcgggacgtgttgtttactcaatgcatgggagaactcagatggcctctccctgcttagcacacaaattccaaatgccgctagcacccaaggccttcccagccttgcctcagtctgctttccagtctcctcttccaactctcttcttcttcctcccctgtctacccgcactttagtaactgaactaatcctgtgtgccttcagtgctgcagaatatttgcccccagggatttctttccagaaatgcctttctcctctcactttctatctcccaatcagatagtggcccagcttgggacttgaccttcaaggccaactcagcatccctcctgtctctctccatccctgatcatcaggtataattgactgctttctcctccacttctcccgctagcaatactcacagtgaatgtcatggtaaggtgtttatttgccactgatgggcgggtagtagaggaacaatggaattttacattttaggaggcttgttccttataattatcttagctcttttataaagcactgataggtaacaaaattacaggtttgaactcagaaagcttgcaaagtttttgtttttgttttgtttttaggataactttagggagatttctaagtattgtataggttcagttaaccaacataacatgttttttaggagtataaacattatagagatgtctgccgactaattagtatgtcgattgtagttttaatcgtgaaaattggggtgggaacagctaaaggcagagctaactggttttttcccaggtatttatcatgagttgtgtgccttaggctgtgttcccttttgaatgtggtttttctggttgttctgacagcactgctaagtgtgccctttgacattactggagaactaatttatattgatggtgccactcatatctttggaaactggatatgttctgatcagctcattgatttctaacctgtaggattacagtaaaatttagacctgaggcaccacccagaaactcctgctgctgtatgtggcctgaatgaatcaaaatatgcttggacagctcattatttaacagaaaactctgcctttggcttttgaagagcagatgtccaaatgtaacttgtcagcctgatttttggaagcttgagcaaggggaacctggttatctcagaccatttcgtaattataaagaaagtgaattgaaggatcaggaagtaagtgaattgaaggatcaggaagtaagggaattgcctaacaataggagatgcaccacgcccagtgctgagagaggtagactatatcacgcttaataaaactgtctgaatgagtgatggactactcccatatcctctaaaggaggtagtctgactcctacagaaacagctccattttgattttaggaggtggttgtgatataagacttaccatcttaattctgccatcagttgcaatcagcattaattgcaaatctctttctgacaaaaattcaagtccaggcagggtgcaatggctcacgcctgtaattccagcactttgggaggctgaggtgggcagatcacttgaaaaggagttcaaaaccagcctgaccaacatggtgaaaccctgtctctactaaaaatacaaaaattagctaggtgtggtggcacgtgcctgtaatcccagctatcaggaagctgaggcaggagaatcgcttgaacctaggaggcagaagttgcagtgagccgagatcgtgccactgcactccagcctgggcgacagagcgagactctgttacagaacaaaacaaacaaaattcacatccatgtttctagaagaacggtgactttaactcgtatctgactgtccctttgctgttctgtccttaacattggggcatgttgacatgttttcacctacaggtatattgccatgaacttgcgatctgccgcagtaggcaagccccagtatacctgtcccctgcgtgtggtttgcccccaaggggtagcctccccactggctggcttgcagtgcatctcaaagtccctgtctcagcctctccttctcctctatcccatttctacccatctggagctcctgcctcaacaatttggctccaggggtaccctgttctgagggtgggccggctggaggcaggagaaaggagccttgtgtctcacggagtgaggaagatcccaaactggatggaggcaaagtggatggtaactaaattctgtggtgccattgcatatagaacacaggcctgtcaaggcaagtggcattttgtggactgctctggaaagtgctaaacaaattttgagacatctaaccgaaatgtgaaatattggactgcggttcccattggcagctggggtgggtgggcacctagggaagcttgctaggctgaggcacttctgcctgagtgcaagaaaaagcagttctcattagctgggcatggtggcatgcacctgtagtcccagctactcaggaggctgaggcaggagaatcgcttgaacctgggaggcagaggttgcagtgagctgagatcgcaccactgcacttcagcctgagtgagagagtgagactctgtctcaaaaaaaaaaaaaaaaaaatgcagttcagcagttctcagcatgagggttttatgagcaggatgctgggctggctgggttttaatctggactctaccgcacacttgtgagaccatggacaagtttcttgacctcagtgtcttcatttatacaaggggaataacaggacctaccttattggatccttgtatatttaaatgcatttgtgtgtgttaaatgtttggtatggtacttgacacatagcattggctcaataaatgctagctggtgctatcattaatacattatgaaatcagaattacaaataaaagttcttcgatcagatctactatttgctgtgcatttgggatgccccaggctcagtgctcctgaatgagcttactttccccacatccatttcaattatctactctggagtcatctttggccgtttcttgccatttgagatagtccgatggcatttatgatattttaaaaatcaatttagagtgaagtgtgtgtgttttcatgaattaaggctcaaaccagttgcctactggcttaatgaagtactagcagtttcttgctttaccccagcacctccaaggagccttgcactgagtttcttgctggtgggtcttgatttttaactaaatgaggaattggtgaatgaatggtcttccattcacagtgggtttggagtgggaaggcgcacgggcatacctagaaaggctctagagaaactagctttatttgaacccaaggaaggcatttaatagcagagcagggagaagggagccaatcagatctggcagggcaggcccaggaggaaatacggctctgaggatggaagagtcgtggggcaggcagaatgcgtggctctagggaatggcggccaggccttcctggccatcagaggttttgcgcaatgcatacacttggctctgctttctttctgagctggtcctccccttaatatgcctgggtcagaccacggttgagcaaggaagctgtcctgtctgagtacacttcccaaagccacctgtcactcaccatcaagataaggatactcagccacccaccttactcactgggaagctgcccacctgatccttcatggaaagtggaaggcgggctctgtttatctaggctggtaaagtccttgtggagcagctgggaaaacaagaacatctctgaatttgtagaattatcatctacctctggcttcttggactttttaactggttacagtgtttgctgctatggtcagcccaagggttaagcctttctcttgggtgtgtgtttcattttacagcataactcatttcctccttgcatcaatttccacttctatccttggcatagggatttgttaccaacttggcatgcaaccgtctcttgcattttatttttagaacttggagtaaggattagctatgtaatattttgaatccttcatactgactttggtaaaatacacaatagagaaagctttaaaagcttagctttttttttttttttttggcatgtaaacagtaaaaatggccttttagaattctaatctggactatgttttcctccctcaattcccttgactggttatttttaggatttacagatggctttggagaataggtatgattctaggattcttcttagtagcttaagaaaattcttttttttcttttcttttcttttcttttttttttttttttttttttttgagacagggtctcactctgttgcccaggctggagtacagtggcatgatctttgctcactgcaacctccgcctcctgggttcaagcaattttcctgcctcagcctccccagtagctgggactacaggtgccccccaccacacctggctaatttttgtatctcttagtagagatggggtttcactatgttggcaaggctggtctcgaactcctgactgcaggtgatctgcctgcctcagcctcccaaaatgctgggattacaggcgtgagccactgctcccagccagaattccttatatctcattataaaagtgatatctaggatatttgtagactgtatataatgtataattgttaattgtcttgctttataccctatagattttttaaaaatcaatttagagctctctgtgtatatatttgtatgtgtgtgtgttttcatgagtgaagacccaaaccagttgcttgctggcttcaggcagtaaaaccaaaatgcctggcaagtcttagatctaatcctgcttatacttcatttcctggaccagtgctggcttagggaactttctgggatgatgaaagtgttctgctttttttttttttagatggagttttgctctcgttgcccaagctggagtgcaatggcacgatcttggctcactgcaacctctgcctcctgggttcaagcgattctcctgcctcagcctcctgagtagctgagattacaggcgcgcaccaccaagcctggttaattttttgttattttagtagaaacaaggtttcaccatgttagcgaggctggtctcgaactcctgaccttaggtgatccacccacctcgccctccccaagtgctggcattacaggcatgagccaccgagcctggcccaaaagcgttcctgtttctagcccctagtcacaggtggctgttgaacacttgaaatgaggctagtgcaactgctgatctggcttctaattttagctaatttaatagccacacatggctcgtggccactgtactggatggcacaatggccttgggtttttcttacctgagcagcagaaggctttctgaggaaatggagcttgggttgtgtgagatgatgcgagaattagaggggcatgtacaactgcccccttccccacctgcttagtctgcgactctactggacctatgccttctcccggagctgatgagctcaccttagttcttagagcttcaattcttgaatgctgcaagcctgcctgaggttggcttccttttatcctgtggataaactgtaggattccaacgtcctttttgatagacctcacctctctcttccttattcattactttccccatcactctctgactgcccatgacatggaaagatttgcaatttcaagaacaggctgttcttacctctagacctgtgcaaatcggacactctccacctgaaatgctctgtccctttcatgcacctgtctgactcctacatgtcctgtaggtctcaggttagacctcaatttctgcaacacctcctctaggaaaggctttcttgacctctcctaggacaggtggatgcattacctagtatgtatactgggtggattcccatcacagcacacttgattgaaactgcttctttacctacaagtccctcctcctgccctagagcttcttaaagggtggtccctgtaccggcagcactggcatcacccgggagcttgatggaaatgaagagtcttggaccccagcccagtccccctgagtcagaaatcctgagtgtaggtgctagcaatttgtgctcaacaagcccaccagaggattttcatatgtgctaaagtttcagagccattgggctgaactcttagccccattaaggtaggatgtgtgatttttggtttcccactgtccctagcttttagcacactgcctggctagatacttgagaaacacagtcagagaagaaattccagttattcttttggcaacttgtctgatcaggaaattttttagttgaaatcagtttaaatctcttctcctttctccaaaggagataaagaacaactgagtacttaaaaaaaatttattgttatctgggctcggtggctcctgcctgtggatcacctgaggtcaggagttcgagaccagcctggccaatatggtgaaaccgtgtctttactaaaaatacaaaaaatcagccaggcgtggtggcaggcacctgtaatcccagctacttgggaggctgaggcaggagaatcacttgaatctgggaggcagaggttgcagtgagccaagatggcaccattgcactccagcctgggcaacaagagcaaaactctgtctcaaaaaaagaaaagaaaagaaaaaaaaattattgtgataaaatatacacaacatacaatctaccatcttaacatttttttttttctttttgagacagagtcttgctttgttgccccagctggagtgcaatagcatgatctcagctcactgcaacctctgcctccggggttcgagcgattctcctgcctcagcctcctgagtagctgagattacaggcacctgccaccatgcccggctaatttttgtatttttagtaaagacggggtttcaccatgttggccagactggtctctaactcctgccctcagatgatccagtcagcttcccaaagtgctcggattacaggtgtgagccaatgcgcttgaccttaacctttttttttttttttcttttgagacagagtctcactctgtcacccaggctagagtgcagtggcgcgatcttggcttactgcaacctccacctcctgggttcaagcaattttcctgccttaacctcctaagtagctgggactacaggtgcccgccactatgtctggctaattttttgtatttttagtagagacgcggtttcaccatattgaccaggctggtctcgaactcctgaccttgtgatccgcctgccttgacctcccaaagtgctgggattaaaggcatgagccactgcacccgacccaaccatttttaattatacacttcagtgtctttaagggcattcacatggttgtgcagccatcaccgccatccacctccagaagttcttctccaactgaagctctgcactcattaaacaactccccttcctcccaacctttggcaaccatcatcctgctttctgtctctgaatttgcctactctgcattcctaatgtaagtgaaatcatacatcatgtgtccttctgtgactggtttattttacttagcatgtctttatgcatgtgccaggatttcctttttaaggccaaatgatagttccttgtctctataccacattttgtgtatccagttatcagatagcatttggattgtttctacctctttgcttttgtgaatatcactgttgtgaacatgggtctactgtataaatatctgctcggattcctgccttcaattcttttgggtatatacccagaagtgagattgctagatcctatggtaattctatgtttattttttgaggaaccattatgctgttttccacagtggctacaccgttttatattcccactggcagtgcaaaagtgtttcaactcctctgcagcctcaccaacacttattttctgtttttttttttttttttttttttgacaactgaaagtgaaaagttaattcaagaatagtgtcaggctgggcacagtgtctcacacctgtaatcctagcattttgggaggctgaggcaggtggatcacttgaggccaggagtttgagaccagcctgcctaacatggtaaaaccccatctctactaaaaatacaaaaattagccgggtgtggtggcaggagcttgtaatcacagctactgaggaggctgaggcaggagaaacacttgaacccaggaggcagaggttgcagtgagccgagatcacaccactgcactccagcctgggctacagagcaagactcggtatgaaagaaagaaagaaagagagaaagagagaaagaaagaaagagagaaagagagaaaaagagaaagaaagaaagaaagagggagagaaagaaagaaaaagaaagaaagaaagaaaaagaaagaaagaaagaaggaaggaagaaaagaagaaagaaagaaggaaggaaggaaggaaagaaggaaggaaggaaggcaggctccctggggcaggtggctgcacagtcatggcggaggtgaccaaagccacatcatgtccgtcgttcgttcatctgtccatgccagatggatcgtggggaaggtgattgggacaaaaatacaaaagactgctaaagcgagagtgaccgggcttgttctggatccctatttattaaagtattataataagtggaaaacctcctttgttcacgatggccttcggcagtgcacagctggggatatcgtgcttctcagagctttacctgtcccatgaacgaagcatgtgaaacatgaacaggccaagatcattttcaaagttggaaaagtcatagatccagtgacaggaaagccccgtgcaggaactacctacctggagagtctgttgagtttagaaactacccagctaagcaaaaatctggaagaactcagtatctcttcggcacactgaaggaggagtggaaggagctaaagggaaagattgacatgtttatgttatgcaaaaataaatttttcaaagcttcatccccccgccccccaaaaaaaagaacagtgaagaattgtgtcagaggaagagaaagttttccaaactttcttcaatttacttacttggtcaattaaaacccagacattgagtacttattgtgtgataagttgctatgttaaaagaaatgacatcaatagaattgattctagtaggttctgtttagttctaacaaacttgaaaatgtttgttggaatttgaaaaataaatgcatatgaaagcttaaatgttgaaatgttacctctcgtttctgatacaatttgtggaaacagagctctatctttagagtacaattttttttttttcttttgagatggggtttcgctcttcttgcccaggctggagtgctgtggcacgatctcggctcaccgcaatctccgcctcccaggttcaagcgaatctcctgccttagcctccctagtagctgggattataggcacgtgccaccaagcccggctgattttgtatttttagtagagacagggcctctccatgttggtcaggctggtctcgaaccttgacctcaggtgatctgcccgcttcggcttcccaaagtgctgggattacaggcatgagccaccgcgcccggcctagagtacaattttttaacaaccatttcattctgacaatcaatcctaagaaatgacttgataacagtgcaaaaaacgtgtgttcaaggagttcattttccctcacttagattctcattctttgaactcctgactttcttagaactccaagtgccagttatctttggatcaagagaagtaatctctatcaacatctggttgctatgtctcagatttttaaaagattgttcaaggctgtaaagacacagccttgaattactacgtttgggaagcacattgcttcatcaggagataatgggtttggtagtttaagtaacagagagtattgctgtaggaaagatattccaagtgttaaaaaggaacaatgaaaaagcaaaaaagtaagtaggttcatgtttatggtgctgggcacatgcaccactgttcactgtaaatatcttcgatttgtcatcacttgaggatcacgggatataagcagcctattgctctcctcttctgcctttactgtgtgttccactcttgagagtaagacttaatgcaagagggcattctttcaactaggtaccatgtgtgtcactatacatttgccaaaccccacacaacaaagagtgaaccctagtgaactgtggacttcatgtaaactagggactttagttacaatatgtcattactggggccgggcacattggctcacacctgtaatctcagcacttcggggggctgacgcgggcagatcacttgaggtcaggagttcaagaccagcctggccaacatggtgaaaccctgtctctactgaaaatacaaaaattagccaggcgtgttggcgggcacctgtagtcccagttactcaggaggctgaggcaggagaatcgcttgaacctgggaaatgggggttgcagtgagccgagatcacattactgcactacagcctgggtaacagagtgagaccctgtctcaaaagaaaaaaaaaatatatatatatatatgtgtgtgtgtgtgtatctcattattggctcatcagttgtaacaaatgtgccactctaatgcaagatgtgaacagcgtacactaaggcacggggctgaaaggatatgtggggattgccactccatttttccgtaaacctaaaactattcagtaataatcctttttttttttttttttttttttaacagtcttgctctgtcaccaggctggagtgcagtggcgcaatctcggctcactgcaacctccacctcccaggttcaagtgattttcctgcctcagcctcccgagcagcttggactacaggtgtgtaccaccatgcccagctaatttttgtatttttagagatggggtttcaccatgttggccagaaaggtctcaatcttttgaccttgtgatccgcccgcctcagcctcccaaagtgctgggattacagacgtgagccactgtacctggcctagtccattaaaaaaaaaaataggaaaagaaaaaaacctatagaattaggagatttagtgccagaaaggacctcagccatcttctggagaaatgcagggacagactttacctgttccccattccaggttcagtagattgggttcaggttcaacaaactattgctgttaaaagcacactgtgggattctgatgtgtggccacatcttagaatcattgatctggtcaagaaccctcactgacagatgataacctgagcccaggtgaggatgtgacttgctaaggccgtactgctcgtggtgccatgctagagtagagaatagttctctcccactctttgtcttatctcaagaatcttcagagaggccactgcatttgaatctaaaactttcttaagataaatatcacagttgccctgatagcaacaacaacacagtctgggtgcaatggctcacgcctataatcccagcactttgggaggccaaggtggaaggattgcttgaggctatgagttcagggcttctttattttattttattttattttattttattttattttatattttattttattttttattttattttattttatttattttattttatgttattttatgttattttattttatttattttattttatgttattttatgttattttattttattttattttatttgagacagagtctcgctctgttgcccaggctggagggcggtggtgcgatctcggctcactgcaacctctgcctcctgggttcaagcgattctcctgcctcagcctctggagtagctgggactacaggtgcgcgccatcatgcctggctaatttttgtatttttagtagagacggggtttcaccatggtagtcaggctggtctccagctcctgacctcatgatccacccacctcggcctcccaaggtgctgggattatgggcgtgagccactgcgcccggccaactccatcttaaataaaaaaataaaaagtatcttccttattaccttggtgaacaaagaggaggatatagtatagccacatttccttgtcagaagcttcatgaagatgagaagaggttgcaggagattcgggttaagtgccagaatgtgcattacttttgggctggatcttgtggaagccactagctgctctttcccttaaaacaaaccatgttcagtttggggaaggtggaagagcaaagacgaaggtggagataggctggccacagagggggttcctcaggcatctctggggctgcaggctctgttcccagctggaggggtcttagggacaggccctttccctctgctggttctaggacatgtagaagcagaagctactcaagtatctcatccacccaggcattatcccagagtgattgtgttgatgaaatgttcatcccaagactttgttaatcatgatattattgtactgaattcatctttggcttccttccacttacatttctaccgggaattaaaatcactatgtgggaggataatttttagtcattttttccccccgatctttgtatattggagagattgggagagattggccaatttggaatatccaggtactgcagcaccaacctccttcttgctggtatgtagagggtttggagtgatagcttctttctagtgcctttgaatttgggtgctagtgacaaagtgagtggacctcctagcagctctcctacatgatgggaatggtaggagggtggtagcaattgccagtcagagacaattaagctgcagttggtttgcacagggcaggactaggagtttcccaacagcgatggtggcctattctgagtcatccaaatacctttttttttttttttctttcccgagacggagtctcgctctgtctcccaggctggagtgcagtggcgcaatttttgctcaccgaaagctccgcctcccgggttcatgccgttctcctgcctcagcctcccgagtagagtagctgggactacaggcgcccgccaccaagcccggctaattcttttttttttatttttagtagagatggggtttcattgtgttagccaggatgatctccatctcctgacctcgtgatccgcccgcctcagcctcccgaagtgctgggattacaggcgtgagccaccgtgcccggcccttcctggtttctttgatgaccacttgccatgagttaccagattatctgttagggattaaaggttcacaaggtgattttttaaaaattctcaatgaatatttacttggttgctgctattggagctatcaccttagattgaaattttgcttagggaaggtccctggagttgtaaatatctcgcctagaggttgataaattcactgcagtaatatgctacccttaggttaaagttgagtctttaaaggaaagctagactttaaggacctagggtggtagatgaggacttctgtcttggaaaacagagaaagaaagggaagcaagccatcgtgggatctatggatttctttttttttttttttttttttttttttgagatggaatctcgttctgtcgcccaggctggagtgcagtggcacaatctcagctcattgcaacctccacctcccgggttcaagcgattctcctgcctcagcctcccaagtagctgggactacaggggcgtgccaccacgcccggataatttttgtatttttagtagagatggggtttcaccatgttggccaggatagtcttgatctcttgaccttgtgatcctcccgcctcaacctcccaaagtgctgggattacaggcgtgagctaccatgcccggcctatggatttcttttaagttttccaggaaaatgatttatacatagacataagacataaatatttctctacttgcaaacagttgcctgagaagtgacttctagtgattataggagatattgctaagtgaaaaaagctaagtgcaaaagaacatatattttctacttttgtaaaagaaaaaaggaaacataaggaaaaatacaactatctttttttttttttttttttttgagacagagttttgctcttgttgcccaggctggagtgcaatagcacgatcttggctcaccacaacctctgcctcccgagttcaagcaattctcctgcctcagcctcccaagtagctgggattacaggcatgcaccactgtgcctggctaattttgtatttttttttttttagtagagacggggtttctccatgttggtcaggctggtctcgaactcctgacctcaggtgatccacccgcctcagcctcccaaagtgctaggattacaggcgtgaggcaccgcgcctggcctatcttcttatctttgtaaaacacacaggacggataaacagaaaacagtaaagtcgattaccaacaaagggtgggtgggaacaaggagaaggggatatgtgaggagggttacttgtctaagacacccttttgcatagttttggctttggggagcctgttaatgtcctacatattcaaaaataaatttaaatcaaggatggggccagacttggtggctcatgcttataatctcagcacttcgggagactgaggtgggaggatcgtttgagctgaggaccaaatgatcctcccgcctaagaccagtctgagctacacggtgagacccccatccctatttttttaagttatatttaaatataagtatatatataatagggataggggaaatcctaaaactgagagcaacatgaaatgaagaaacccagttgtatttcaaatgaattccataaccacagtgaagaggggagaaaaagaaataatccagggagctacgaacacagtattctatgagatatgctccatcttgtctaaagttgggtggtgagggaaactcgcaaagaaattttaaactcttacgatatactttatgtagtgatactggcaaagcaactctgaaacagttttagatgtattttagcattgagcaaatgagttattgttttggagagccagggttctcactgagaaagaaggaacatatagaaaggaaatgggagatgggggaaaagaacattgtgggaatcaattggaatcagaagaataggtatgaactgatttctgaaatacatgcatgtataagtattcccatgtacatgcgtgtgtgcataagtgtatatgtatgtgtgtgtgtgtatacattttttacttagctctatccatcaaaggaccaggaccaagaagcaaagtcaccccgctagtaacaagcacatcaagtgccaagatcttggtctctattatcatttcccattcaaaggaaccaggggtactgggagaaatggctgattacaggctggggcaggagaggtacaacttgagcctggaacatcttgttattgtcacaaggtatggacatgctgaaagaatgatgggagcctgtcacaaggacacagtgctagcttgaaagtgctttgattggccaaaccagggaccatgtggacaccaaaataattatggacagtaaggaattatatgccattggagaaaaaataggaatttacacatccatattgattactaactaataagtggaaagtagggaggctatgcttacagcggcatgctcaggctcaccaatatgcgtggaggggatgggtgctgtgaaatcatcctttcatggccattgtagtagagactggatcaggggagaatcatccatgagtgtcacgtttaggaggaaattgtgataaggaacgggacatttgcgatgtcttaaaagtgtctccccacaaattacaagttcaaaaaatacatacagtggagaaatcaaacaacacgttgaccacatgaccaaagtataaaatcaaaatgcaatcaccgacaaggggcagagacctcacgtgcctccagatgtcacatctgaaaggacgcagcatcacctatgtgatgttccagcaagaacagagaccttgaattaaatcacgaggaaatgacagagaaagcccaaaagtgggaggttcagttttaaaaagagagagagagagagagaaggaataccatattcttttaatgtcagtgttgtaaatgacaaatacaggttgtggaggccgggcacagtggctcacgcctgtaatctcactttgggaggccaaggtgggcagatcacctgaggtcaggagttcgagaccagcctggccaacatggtaaaaccgtgtctctactaaaaatataaaaattagctgggcatggtggcaggcgcctgtaatcccagctacttgggaggctgaagcacaagaatcgcttgaacccgggaggcggaggttgcagtaagccaagaccatgccactgcactccagcctgggtgacagagataaactcagtctcaaatatatatatatatacatacacacacacatatatatgttgtgtaaatatttcatatatatatatgtgtgtgtgtatatatgtgtgtgtgtgtgtgtgtgtgtgtgtatatatatatatatatatgttgtggaaatgtttcagattaaaggacatggctacctaaagtaacacctgattctagactggatcctgtgctagaggaaaaataatactataactgacatcattgggtcaatgacgaaatcagactattagataactgtgaatgttaatgttaaattgtctgaagttgataattctactatggttatgtaagagaatgtgagagactacccctgaagtatttaggggtaaagggggataatgaactatatgtaacttaagctcaaatggttcagcagtgagcctggtgtctgggcgcgtgcaagccctcttcatctgtctgtccctggcagtgctgcgccgttaattatgttatggctggggattggattgaattggaattgcactgctgtgactctgtagagaacaggagagaatataggattctctgttttcaaggcctggaaacaattagaatattgatcacctctaaccgctttttaaacagttaaaagttaaaagctccctttgggagtttgcctgtgtaaacttatgtgaagccaggcagctgaccagagcctgggattcatggataataactacatcagtcagtaaacacacaaataatcaagaattaacttgattaagcgtcaatgtgaaactgtcaaatccgcaggacattttatcaaggcttttaattttttttttaatttttacaaatggaatgcttcatgaatttgtgtgtcatccttgtgcaaaggccatgctaatcttctctatatcattccaattttagtatatgtgctgccgaagcaagcacatgtccaggattttttttttttatcttggtagagaaaaaattaagagattcagtgtctgttataatctttcccttcccaaatgttgatgttattatataatgcatgaattttgccatttatgtaggatgctagcattagaaccatttaataaggcaaatctgatgggagtgtaacatgaatatatgaatactttcagccccgggttctccaatgcacaattacacattgttggtaaacaacctgagactattttaggctggctggtgtaatgtgtctcttattggcaagatatacactggatattgtggcagaggtgtcagatgtaaagacaatttctatttcttaaaaaaacaaacaccataaacaaaaccactttatcattctgaaaaattccacatttactcactatgcaaagataccaactctaagttgccttgttcatattatattctaaattccagagtttggggtttgtgacatctttcaggagatctgaaaaaggcagtaatggatacaccccaggctgctttgctctgagcagctggtagagtaaaatatttaatatctctctcactactagggtgacattttcctgtggcctgagacagtaggttacgagttaggtatttcccttgctattaatgattcaacacacgaaagtaaatttgagccccggcgtgggctgtagtaacttctcagctgtccctgaagtgtcaatttggtgatgtgtttcttctcctagtatttaattatctcacataagaaaaacaacagctaatatttactgagccttcctttgggtcaagccctattccagagctttccatatattgaatcattttatcctcacagcagctgtaaaaggcagctgctattgtttttactcattttacagatgataaactgaggaacagcaatattacttcataatatatatatatatatatttttttgttagacagagtctcactctgtcacccaagctggagtgcagtggtgtgatcttggcatactgcaacctccgcctcccaggttcaagcaattctcctgcctcagcctcctgagtagctgggattacaggcatgtgccaccatgcctggctaagttttgtatttttagtagagacggggttttaccacgttgaccagactggtctcgaactcttgacttcaaatgatccacctgcctcaggctcccaaagtgctaggattacaggcatgagcccctgtgccaggctgaaactgattcttaaaagaaaaaaattgtaatgcacaaaaagaacaagtaaatgctaaatattcctgtttaaccaaagaagaaatatgcctcctcaagtccaatgcaaatggagtggccctgactcataaaacattatagttttctataacattttcactttattaaatattcagatgtatctttttttttttcttttctttctttctttttttttttttttttgagacagagtcttgttctgtctgtagcccagggtggtatgtagtggcatgatctcagctcactgcaacctccgcctcccaggttcaagcaattctcctgcctcagcctcccaagtagctgggactacagaagtgcaccaccaagcccagctaatttttgtatttttagtagagatggggtttcaccatgttgaccaggctggtcatgaactcctgaccttaggtgatctgcccgcctcagcctcccaaagcgctgggattacaggcgtgagccactgtgcccggcctgtatttcattttttaaaataatctcctcttaactgtctatgaaaagattatttaatatctgagttttcaagatggagccaatggctgcataaagcatgtgttcccttcagagcctgtgttggtgattagtacacatgtgctttacacagtggtgacctcatgttaatacattggtttatgtgaaggagagtttttgttgtgttgttgttgccttgttttaatttagaaagatttcaaacacatgtagaaatagtaaaatgaacccccttgttcatggccaaggccaatgttgtttttatctatagatctgtccacttcctctctttccatattatttccaagtaagctcagccaatgcatcttttcattcaacctggttttgaaatgtggtttgtttcacttgttcataccatgatcaaggtggtttgctgagtatactttgaggaaagcaaaaatctgtatccaagtagttatattactggttctctcttcccttgttgacacaagagagatcttttttttctttaatcggggttttttaagcactctactctcttatcttgaagttattgtcatctagaaaatatagaatgtcttaaataattacagttctgtggaaccttaccctgggggccggagacagtgtgattgaggagaaaggatgcaggatttggattcaaatgctaagatctggttctggttcctctacatcttgtcatttctgagaacctggatacagccttgaactctgagcttgattctacatttggtagttctttatgaaagttctactgtgtgttacatgctgttctgggcaatggagctattgcagagaataaaatgaaaataatctacttttcaatgatgttttagagataagtatgttaatggtatctgaaaagcttttgcaagctgtgaagtgcaattataaaagtttttattgttttcctactctgtttttcacttgaaaacttcagttccctgatgtttcaggtttacgatggttaataataaactaaactaagctttatcgaagggggaaatataagaattatatctgtgtgtgttactgaatttctgatgaaatgaatcactggaatgcctcactcagtggatatctggggccacatactgtgcatgctactaagggctttacatgggatcaagattaagcttcacaaggaccctgtaaggtaaccattatcttcatgttataaatggagaagtaggagcttactaagaatatttttcccaagcttctgcaggtagcaggccttagagctgggatttcatcccctatctgtctaacctcagacaggagcccttaaccatttcttgattctgccccacttgagaaataagaggaataggccatgatcttgcacctttagattatcatttattattattattattatcattattattattattatttgagacagggtctcactctattgcccaggctggagtgccgtggtgcagtcatggctcactgcaacctctgcttcctgggctcaaacgatcctcccacctcagcctctcaagtagctgggaccacaggcacgcaccataattcccagctaatttttgtatttttttgtagagatagggtttcgccatgttgcccaggctggtcttgaactcctgagctcaagcaatctgcccacctcggccctccaaagtgctgggattataggcatgagccaccatgccttgcctgcacctttggatttttactctgttagaaacaaaaacaaccacaatacaagccataatgcaaagaatggttcaggcagtaagttgttaaagtacaaatgataaagacattacatcgggatttgaggacctggaaaaggaatgaagctgcctagctgcccttgtgagtgtacttgtgagggagcagaaggtggctggagctagggtggggcctgcaatgggcacagtcagagcagatagagcctctccaagttctaacgcatatgtgaaaatctagtaatttctataatgaagcacaacagaaatgtctatcaacagattttgaagataatctggaagccttgtagatccccatttgacctatggaagctgtttcttgagagtcattgattctgatttcagagtatggtgagtgtaattgtattttgtgtttggtccagacagcaaaataaattccctttttttttttttcaagacagcatcttggcttactgcaacctctgcctctcaggatcaagtgatactcctccctcagctgcccaagtaactgggactacagctacaccaccatgccctgctaaatttagtatatatatatatattttgtacagctgtggtttcaccatactgcccagcctggtctcctgagctcatgtgatcctcctgcctcagcctcccaaagtactgggttacaggtgtgagccacaagcctagcccaacattccttattgatagcctaaattactaatgtttaagccataacaagcattgataagatttattttcttattctattttattttttgagatagtcttgctctgttacccaggctggggtccagtggcacagtctctcctcactgcaacctctgcctcctgggctcaagcaattcttgtgcctcggaatcccaagtggctgggattatagcaggtgtgcgccaccacgcccggctaattttctgtatttttactagagacagagtttcaccatgttggccaggctggtctcgaagtcctggtctcaagcgatccacccgccttggcctcccaaagtgttcagattacaggcatgagccaccgtgcccagccaaacattgataatatttaaatactcatgtgacacatgcaaacatgcacaaagttagctgtcatggttagtgcaacattgttttctgtacctgaggtttaagctttggaaaactaagacacaaattcactgtagacacgtctgttaagatgaaggaggaaaagagtaggttggactctgaggatgggtagggcaatagccagaatgagcctaggaactgatatataaggcaggcctagctgcggagcacttggaggtgaccgttttgtggcccaaacaccagcttttgctcttgagtgtagctcagtttttcattgatgaatattgtagaagagcctatgtcacaactccgaaatatttgaaaggatggcatcatgtaaatccagagcacagtctattcagagcacttttaaaacatgctttgaaaatattttaattagctccagatatctaatagtaaagttcaaatccatgtgacatttaaaggcttttcagtaattttctttgagttgtgcagtgtgcaggtactcttgatttatttctgattgctgatttagggactatttaaacccctagtttattctttttctttttttgagatggaatctcactctgttgcccaggctaaagtgcagtggcacagtctcggctcactgcaacctccacctcccaggttcaagcgatttttgtacttcagccttctgagtagctgggattacaggctcacgccaccatgcctggataattttcatattcttggtagagacggggattcatgatgttggccaggctggtctcaaattcctgacctcaagtgatccaccaaacttggcctcccaaagtgctgggattacaggtgtgagccactgcacccggcactaaacccctagtttatccttaatgctcttctctctattcttacactaattccatttttttcctttctttttaaaaagagctctcggaagttaggatcaaagtgttaaaatagcaagttgaggccagttagatttgctattgttgggaatttatccctggcatgatttattgatggacagctgaaggtttgctcacaagagtggagatggggtgggaaggagattggttgctggaagggagagaatcctctagacaattcagccagagcctgcttcctccctagacctacaggggacaatgacagtgagctctgtttcctaaataatggatcaatcttcctgactcaactcagagttctatagggtgtcttcacctaaatcaggttaattcgggggtaagttttcaggttggtaacatgttgaatatataagagcttataataacattaattgagtaaaagttataaatagtattatgataacaagagagttaaagaggattgttttcattggagtccagttgcattcaagagagtcattttctctttataggagatgcaggttgattgaagtctaggtctatggagaaggggaatgtggaaaagcaaaaaatatgcaaacattttgattggctttacattttattttatgtcagaatcataagtatatatattctctgtactacttgcctttgtggggtaggggctggagatggggtgagcattgctcaatcaaacccaagccctcatcaccatgtgctactgcacccatgaaagtacacagagattttaaaggggaagcaaacattgattgggaggagaaaatatcacagcagaaaaaagttctagaatacattatcatttttcctggggccatgctttttttaagaggtggagcagaaagcatctttaatgggcacttctttaaaactccaaaacattttgaagatgttttaatacatgttggatacttctataggtgtaccttttctcttaaatgcaaatcagactagatgtttgcacaaggcctgcatgagtcatccctagttcagcagcctggccttatttgcattaaacaccagttgcagttccttctgattattctctgcaaataactgttaaacctgggtaagctgcaaaattaaattaaattaaactttaaaatagcatgttaacctttgggtaattagaagagagaaaagaaaacatggtcatttagttcttatttatataacttgttacaaaaggtaaccacagtttttccttttgtgcacatagtcttggcaaaggtggattcagaatttaaagacattaagtaacaaatttgcagtacctgactgtggagtcctctgtttgttggaattaaggaatttgaaaggccctctccgatgttaaagctacacattcaagccatatattagttagctggggctgctgtaacaaggtaccacacacagagcagcttaaagaacagaagcttattgtctcacaaatctggaagccagaagttcaagatcaaggttttgcacggccatcttccctgtgagggtgctggggaaggatctgtttcaggattctctcctagtttctggaagttccttggcttgtggcagcatgtctccaagggattttattctggttaccccttatatgtccttgggcaaagaacttaacctctcagttacagtttctttatttgtagaatggggataataatttgatcctcaaacaaagtaagctaatgcgaatacatagtggagagcctgatgcatagaacacatagttagctctctgtaaacgcacgccaccatcatcctaggaaaacatggggagtttcagaagccttacatcagaagtcttaccatgggtgcttaaactgatcagatttgtaggagaagcttggacacactccttatatttgacctgttcaaactctgaaagccagaacagatagaattgctgactgttggtaggaagctctgtagatatttcaagccaaatgcaagtatttccaagggacctataaaatattaaccatatgtttgcagtagaatcttggtccaaaacttaggatatgaactctgctgccttggaagagtttgtaatctaagttgagtactctaagctgacttgaaatacagcataagagacagtgattaaatatctcagacccagaatttgtaaaggtgttaaccttcagatggaatgagaggtaaggctctgtcgaccagtcttagatgttcaggaaaccatgatagtatctagaaaagataccaagtaagtgccctaatcatacttaatgtgccaatcaccttagtgtctgtttaagctttggaacatgtttacatataaatatttggaaatttgagacagatttacaaatgaaaaggagccatgtgggaattttaagagcatctgtttgtatttgcagctgaagccacagctttggatacagatcactaaggagagccactgacttttctttctttctcttttttttttttttttgagatagagttttgctcttgtcacccagactggagtgcagtggtggggtctcagctcactgcaacctccacctcccgggttcaagcaattctcctgccttagcctcccaagtagctgggattgcaggtgcctgccaccacgcctggctaatttttgtatttttagtagagatggggtttcaccatgttggccaggctggtcttgaactcctgaccttaggtgatccacccacctcggcttcccaaagtgctgggattacaggtatgagccaccacgcccggcctgggccactgacttttcaagctatctttgtctctggcccctctccaaggcactcaaggtccattgtccttagtgctaagtaatggttggggatctttgctgaggatcagcaagggctcttggaggaaatggtggacccagactacatttcatgcagctcaccatccttaggagggagatggaatcttctgtttactaacacaccagaaaggtataatacaagggacaaaatgtggcaagtttcaactcttctgccttgacatgcaaaccatcccttctgagctcacttccatgcaccatgcacagtggattccatgaacccacttccatgctaccatttttgtttttgtaatcatttgcaaagagacagaatgatattaagaaagtatcagtggctgggcacagtggtggctcacacctacaatcctagcactttgggaggtcaaggcaggtgcaacacttgaggtcaggagtttgagaccaggctggccaatatggtaaaaccctgtctctactaaaaatacaaaaattagctgggcttggtgacatagacctgtaattccagctactcaggaggctgaggcaggagagaattgcctgaaccagggaggcggaggttgtagtgagcagagatcacaccactgcactccagcctgggagacagagtgagactctgtctcaaaaaaaaaaaaaaaaaaaaaaaagtaagcatcagtgggcataatcctaatggcctgatccaacttttctccccctttgaacagcaccaggacaaatcgtaagagatttggggacaaacagacctggttgaaacctcaatatgtgaccctggagaagtatgccacctaacctcttcaagcccacaaaatgaggataagcccttccttttgtgtgtgctgtaaaaattgcatgaaatgtacccagtatatgagcaattgctcagcagtgtttggatatagggagtggatagctattattaattgcagattattttggaaggaaaaacacacagagaattatgtatctttcagtgcaaatgttagttctaaaaacaatcatattatttacaaagctgcagttatagaacacaattctgatttctgcctcacccccacggttaatactgtaaaacatttcctacgtttcatctgatagtgttattaaaaatagctgttatttttaatagctatactaaaacataaaaatgtttaggtcaggcgtggtggctcatgcatatcatcccaacaccttgggaggttgaggtgggaggattgcttgaggccaggagtttgggatcagcctgggcaatgtagtgaaacctcgtctttacaaaaattttctcaaaatattagccagttgtggtgtcatttgcctgtggtcccagctacttgggaggctgaggtgggaggatcactgaagcccaggaggttgaggctgcagtgagtcatgatcatgccacttaactccagcctggatgacagtgcaaggccctgcgtcagaaaaaaaaaaaaaaaattgtaaaaccatgagatcttgttggacactcatgtggtttccattcctgctttttataactaatgacgccaatcaaaaattttgtggccaggtgcagtggctcactcttgtaatcccagcactttgggaggctgaggcaggcagatcgcctgaggtcaggagttcaagaccagccttgccaacatggtgaaaccctgtctttactataaatacaaaaattactcgagcatggtggtgcatgcctataatcccagctacttgggaagctgaggcaggagaattgcttgagcccgggaggcggaggttgcagtgagccgagatctccccactgcactacagcctgggtgacagagcaagacactgtctcaaaaaaaaaaaaatttgtttcagtaagagtcctttcattgaagtattcctgttggaaaaggctctgtaaatgaggtgattgcttcaaatatatctttagtgttttgggtacataaagcgtggccatcagtaatacatatactaatttcaaggccagcagcaaggtgggtgaggattcattcatctccactgctgacattgaaaacattgaatagtgtcaactgaataggcataaaatggtgtctatgttttcatcaacttgtcattctttgattgctagtaagagtaatcttttattgtatcattttatgtgtttattatttctatttacttatctgcctcttctactgccttttcattcaaataagccattcctagtgagtctggatggggaatataagttgtctctctgtagatcaaaagtttcaaagtttatattttgttccagaaagctatgatgttttgtatgtctttcgggagtgcagtctttgtattaatagcttggtgactcttctaacattaaaattaattcagcttgacagacttattttaccctgaagggtttgcttccaggtagctgtcaattataaagctcctatgactttgtattatttaaacatgaatataactttaaagcctaattatagagtcaatagtaatggggtaaaaatgaggccattgtccctaacaactaaggatgacgcttgaacgtaaaaataaccagggttttctcctggtaactttcattatttactataaaagtacattgtggattgaggccgagtctccaaaataaacatctggggaaatgacagcattcttatcctatgggaaccagccccagtcttttatttactttttttttccttcattttctagacaaaagaatggcagccccaccctgccttcattttaagcacatttttctggctgccaccaccctagttcaggcctgtatttctttcttttttttttttttttttgagacagtctcactctgtcacccaggctggagtggtgccatcttggctcactgcaacctctacctcccgggttcaagcgattctcctgcctcagcctcccaagtagctgggactacaggcacacaccaccatgcctggctaatttttgtatttttagtagagatggggtttcactgtcttggccaggctggtctcaaactccggacctcaggcagtcagcccaccttggcctctcaaaatgttaggattacaggtgtgagccaccgcgttcggcccaggcctgtatttcttcttgctgtggctagattcatgcactgagtgttgttgctgagtgtgatggtggaggtaataaggtagaaccacttggtgttccaggtgaagaaactgtgacaaggagatgctgtttccagggtgacttttgaacagtctccctcccaggctctcaccttcccagtcacccttccccctgtcagatgagtgctgtgcagatcagatttctttcctttgcagacaccttccatgggccctctaactccctggaataaagccttctcaaggctgcatgagctgccttacttttggaggtgactccaaaactacctttccccagctctgctctttcccccagatctcccacctgcgccggtgctgggcctttccattgcattttcctgcctctgaggtttttttagttccttaatatctctctcccacccaccccaagttcttgctcacctctgtgactcccaggttgcccagctcaaaaaccgtctaggaaataatgattgctctcacttcactcttcagcggcatacattgggaagcattttacattttagaattcactggtgtaggatagatctgcctgtagacctcaaagtttgatattttttgcttgtcaaattcttcctttgcttagggttttcttgtgactaatgatgttgttagtaggtgtggggaagggagggaagtaggtgatgttgggagtggagagcaggctctgatgcttcctgggcagagcttgaattccaatctgaatctacgatgcgttcactgtaccacagagagcacagagctgggatatgtgtggaaagggcctgaatagctaggagctaaatcaccctgggcaagctttgaaaccacctcagttttttcattagtaagaaggtaatgacattgcctggcgacatgcctcagcataattccatgacaattgcatgagacaatctgtatgaaaaatcctttgtcctggaaggggctgccttttatggataagaagaaatataatattactaggaaatgctgtgagcccatggcaatgctggactaagaaatcctttgaaccttagccaggggaatgaaaaagctgctcatctctgaaatgtcaaggttttgagatttcccctgtaccttttctaatgaccgcattgaagttgtacagaatgaaacaagaaccagtctgttttgttttttttttttttatagagatggggtcttgctctgtcacctagcctgaagttaagtggcaagatcctaactcactgcagccttgagctcctgggctcaagcgatccttctgcctcagcctcccaagtagctgggactacaggtgcccagctaattctttaaattattatttgtagagatggggtcttgccatattgcccagactcgtcttgaactcctggcctcaaatgatcctcctgcctcagcttcccaaagtgctgggattacaggtgtgagccaccacacccaggcagccaatcttcctttgtgagaaagggctctggggcggattttctgaggaatagggggtgaagctgtggactcagagaagccttttctatcatatgtaaagatcctggctgaattgtccccaccacagtgatactgttgataccttagttttatgttatttatcccaggcttctagattttttaggtcctgccttgggaggaaataaaaaatgtaatcctgttcctgctgggaactgtaattacgctgtttctataacagtataaagtttaaatttaatgcagatcttagatacattttattactattgcttcatgagattctttatctaattacaactgtcatcaagtttgtcattttactttcaagaatactgagcattggccaggcgtggtggctcatgcctataatcccagcactttgggaggccgaggtgggtggatcacttgaggttaggagttcaagaccagcctggccaacaaggtaaaaccctgtctctactaaaaatacaaaaattagccaggtgtggtggcatgcacttgtagtcccagctactggaaaggctgaggcaggagaatcatttgaacctgggaggcagaggttgcagtgagctgagatcacaccactggactccagcctgggtgacagagtgagactctgtctcaaataagtaaataaaagaatactgggcagactccaaacagggtgtggcatgtgtctggactaactaggaaaatagagaagatttctgctaccttttagatgggggctctttggaataacttggaaataatagtggctacattgagtgcctgaccctagaattactgcttgtgactaatggtatgtgtattggttgtcgattgctgtgtaacaagctactccaaaacttaacagcttaaaccaacacgcatttattatctcacagtttccatgaatcaagtgtctgagcacagcttaactgggttctccgtattaggatttctcacaaggctacaattaaggtgccagcccagctgatgtctcatctgaaggcaggactgaggaaggatctgctttcaagttcatgtagtgattgcaaaattcactgcattccttaaggactattggactgagggctccagtccctgctggctgttggtcaatgctaacttcacatcttgccatgtgagcctctccatagggcagctgcttcaccaaagcaaggaaggggaaagagttggctggcaacaagaagtcatggttttttataacctaatcatggaagtgacatcccattacctgcgccatattctattggttagaagcaaggttcaagctgggcacagtggctcatgcctgtaatcccagcacttggggaggccaaggtgggtggatcccaagatcagaagttcaagaccagcctggccagcatggtgaaaccctgtctctactaaaaatacaaaaaattagcctggcatggtggtgcacgcctgtaatccccgtgacttgggaggctgaggcaggagaattgcttgaaccagggaagtggaggttgcagtgagccaagatcgcgccactgtactccagcctgggcaacagagcaagactccatctcaaaaaataaagcagcaaggttcaggaactcaggcttattttaaaaaaaagaaaatgaagaagaagaaagaaggaaaaggggctggatatggtagctcatgcctgtaatcccagtattttgtgaggccaaggagggaggattgcttgacctcaggagttcaagagcatcctgagcaaactagcaagacctcatctctactaaaaaccaaaaaaattagctgggtgtgatggtgcacacctttagtctcagctacttaggaggctgaggcaggaggatcacttgagcctgggagattgaggctgcagtgagcttgatcaccccagtgtactccagcctaggtgacagagcaagaacttgaatcaacaaccaaaaaaaaaaaaaaaaaggaagaaaaaagaagcaaaccacctcatgtgtatgccacactcacaggaaattaaagatgtgaacaccaaaaggtgggatcactgggggccatcttagagtagtaatttatatttagtatggaacatataataagaaacacgtatagcatagaacatatagaaatataattcatacttattatatattacgatatgttaaatattttacagcattgtctttaataataataataaacaaaatgaggaaaaacagatttcggaaatagtctttcttcttgtgaactttaaaagccattaaaaaaaaatgatgaaggaccaggcgtggtggcttacacctgtaatctcagcatcttaggaggctgagacaggataattgctttaacccaggagacgaaggttgcagtgagctgagatcgcgccattgaactccagtctgggcaacaagagcaaaactccatctcaaaacaaacaaacaaacaaaacaaaaaacaaaactaccatagccggtatgtcagtaatgagtaagggtgcattctaataaaactttatctaaaaaaataggtagtgggccgaatttggcccatgggctgcaatttgccaattcttgtctagactataagcctcctaagtacagaaacaaacgagcctcctatatgccagactctggtaggtgctagtgatggacaagaaagattggtcctcacctttgatatcttcagtaccctactagagggctggtttggttttgcgtacatggtaaaatcttggacaatggtttttggatggcctcaaatgactcagactcctaaaaagtttcatcttgtatgacttctgaccttaactgttgctgttttctcccatcattgccctcaatctttcatccctagtccaatgactttgtgaatctgttaccatgtggtaggtgtgacctgtgtaaaggtggtaaagaactttggtgtaagacaactctctgagcccttgaagactttattgaaagttgatttgctctttccccagatctttcagtgtcaactgtgtagtaggcactgagtattcacagaccaatctgttcttgtagagtttatggtctggtgggaaaggcagataaatgaaagcaaatgcatgtttacaaatcatgataagtgttaggaaggaaacagaaatgtaggtgctcaagggggccagtggtagcaggaagaggagggcagaatcctgctcaataccatgagtggaagaggacactgaagttgagacctaacgaataagaaattggccaggcatggtggctcatgcctgtaatcctagcactttgggaggccaaggtgagcggatcacctgaggtcagaagttcgagaccagcctgaccaacaaggagaaaccctgtctctactgaaaatacaaaaaaattagctgagtgtcatggcgggcacctgtaatcccagctacttgagaggctgaggcaggagaatcgcttgaagcagggaggtggaggttgcagtgagctgagatcatgccactgcactctagcctgggcaacagagcgaaactgagtctaaaaaataataaaaataaaatacacaagtcctattggattagggccccatctgatgaccttatttaaccttaactacctccttaaaggacctctctccatgtagtcacattgaggggtgttatggcttcaacatatgacttcgggggccataattcaatccataacacccaggaagggtgtaagcaggagaatggcatgcctttggtggtcatgtggaagttaattgtggaaagtctagttagagggatctcgcagcatttccagggagagatgatggtggccatggagatagagaggaggtgatgaattggaggagtatttgaggcaaaaacgactggctttactgttttatggctttattttattttattttattttatttatttatttattggaggcagagtttcgctcttgttgcccaggctggagtgcaatggcgcgatctcagctcactgcagcctcctgggttcaagcaattctcctgcctcagcctcccgaatagctgggattacaggcatgtgccaccatgcccagctaatttttttgtattattaatagggacggagtttcaccatgttggcaggctggtcttgaactcttgacctcagttgatccacccgcctcggtcttccaaagtgctgggattacaggcgtgagccaccgcatccggtctgtttcctagctttaatagttgacttatctgtattcttcgaaactctggcagtcagtcagtagctctgttccctgtgcctagtgtagtactctgcaccttgcaggtgtttactggatgctgagtaaatgcacacctgtctgcagtgtcctggagtggtggtcagagacattatgaagtttccaaatccataccatacacagcacctgaccttagggatcattatttagatctgggaaaatcttccttatgtcatttagggcttcaaacaagtgatttctccctgtttttttttctttggtacactaaaatgacagagccaaattcctcccgtgtgtgtctgtgtttcacacacatgcacactgcagagaagtcgagttgaggacatttcttcactctcagcggagagctccctgctcctgctttctcactgagactgtgcagattgtgtgggtggcgagttggttgtgcaaggccttgcttgctttgagtcacggacatgtgggttgtcaaatccattcctccgtgcttgcttcctctctcaacctcaaagggctggagacagtcttaatatccagatgcctggcagtttggaagcaatgatgaaaaggataacttacaaaatgtttgtataaatgcacttaatgccacagaaccctacacttgaaaagggctaaaaggaagctgaggtgggaggattgcttggggcccggagtttgagaccagcctgaggaacatagggagagcctatctctttaaaaaaaagaaagaaagaaaagaaagaaaaaaaaagccaggcatggtggctcatgcttctagtcctagttactagggaggctggggagcagggtaggaggattgctggagccctcagatttgagagtgtagtgagctaggatcatgccactgcactgcagcctcggtggcagagtgaaaccatgtctcaggaaacaaacagtggtttgtgtcatctgagatgcaaaaaaaaaataacaataataagagaaagaaaaccaaccaacaaacaaaaagttaaaattctccaatggtacagctttaagaaattaaaaaaaaaataaaagtagggagaaacaaagcctggcgtggtggctcatgcttgtaatcccagcactttgggaggctgaggcaggtagattacttgagcccagaagtttgagaccagcctaggcaatatggcaaaaccctgtctcttctaaaaacacaaaaattagtcagatgtagtggcttatacctatagtctcaactactcaggaggctgaggtgggagaattgcttgagcccaggaggctgcaatgagaaaaacaaaacaaaatggctaaaatggtaaattttatgtacatatattttacaacaataaaaaatgtttccatatagtaccttcacagtcaccttgatacatatatatataacaaggctgtagtaaccaaaacataatatgggctaaaaacagacacataaaccaatggaacagaatagggaacccagaaataaatccccacatgctaaagaatgaaactgggcccctgtctctcaccatacacaaaagtcaactcaagatggattaaagacttaaatgggaccacacctataatcctagcactttgggagcccaagcctggaggatcacttgacccaggaattcaagaccagtttggacaatgcagtgagatcccatcgctacaaaaaaaaaaaaaaaaaaataggcatggtggcatgcactggtagtcccagttacttgggatgctgaggtaggaagattccttgagcccaagagttcaatgctgcaatgagctatgattgtcctactacactctagcctgagtgacagagtgaaacccttctctcaaaaaaaaaaaaaaaaaaaaaaaactagtaaaactttatactagaagaaaacatagggaaaatgttttaggacattggtctaggcaaagattttatggctaagacctcaaaagcacaggcaacaacaacaacaaaaatagacaaataggactatattaaactaaaaagcttctactcagcaagggaagcaatcaacagtgtttcctgctgaataggagaaaatatttgcaaaccattcatctaactaaggactagtatccagaaatatacaaggaactcaaacaactcaaaaacaaataatccctgcagccataaaaaagaatgagatcgtggtctttccatggacatggatgaagctggaagccatctttctcagcaaactaacacaggaacagaaaactaaacaccacatgttctcactcataagcaggagctgaacaatgagaacacatgaacacagggaggggaacatcacacactggggcctgttgggggtgggggtggggggggcaaggaatgggagagtattaggacaaatacctaatgcatgcagggcttaaaacctagatgacaggttgatgggtgcagcaaaccaccatggcacatgtatacctatgtaacaaacctgcatgttctgcacatgtatcctagaacttaaagtaaaataaaataaagtaaaataaagacttagtagggaaatttagatttaacatggtgatgccaatttagtggaaaagatgacttttaaaaaatttggctccatttaataaaaaataattttaaaatagtataaaccatgaaagtatacgtactgccaggaaagtataaatataaccagggaattataagtataaccaatgaaagtataagtactgccagtgttaccaggggtccttgctcccagagctcccaagatggtggtgggccacttccaaaatggcggcaggccacttccaagatggtggcaagcctcgtgttctctgacctggggttcttggcctcacggattccaaggaatggaatcttgggccgtgcggtgagtgttatagctctattagaagtcgtgggtcacggaagagaaccgtggaacccagtgactagtgttcagcttgattaggacgaaaccaggcacttagccatgcaggaacaatggcaagcctttagcgcgatcaggagtggcaacgggtgcttccctggatcaggagcacagcgggcgccctgctggattggagggatggaagtcagcggcgggtctgcgacggcagcaaaacagcagtggtggacggcgagcgaaagctcagttctagcggtaaccagaagggtgcagctgcaagatttaatagagtgaaatagagtgaaaacagagctcccatacaaggaggggacccaaagggggttgcccttgctggctccaatgcctgggtttatatcccgatccttgtccctcatcaggcaatagatgagttcatcaggcaatagatgattggctatttctttacctcctgtttttgcctaattagcatttagtgagctctctgattggtcaggtgtgagctcagttgcaagcctcctgtttaaaggtggatgcagtcaccttcccagctagacttagggattcatagtcggcctaggaaatccagctagccctgtctctcaccaggaatgcttgtgcttgctactgaaaagctaaggccagaggtaaagactatggatttggggaatgaatattctgtgaagccataagataatggcctgaggtgctgaggaccagtagtgctaggaactttgcatccatgactatagggctctttagaactgtgccacagtacagcatcatgcagtagaatctaagttgttctttgtaataatgaatgccagcaatattttaaaataataataataccattaaaaagtgggcaaaggacatgaatagacatttttcaaaaggaaacatacaaatcgccaagaagtatatgaaaaattaacagttaatgttcattgaatacttattgcaggctaggtactgagttgagcattttgcatgcatcatctcacttaaaataatgtatgtcccagcctggccaacatggtgaaaccccatctctactaaaaatacaaaaattagccagacatggtggtacatgcctgtaatcccagctactcaggaggctgaggcaggagaattgcttgaatctgggaggcagaggttgcagtgagccgagattgcaccactgcactctagcctgggtgacagagcgatactctgtctcaaaagataataataataaaataatgtatgtcaattgttgaaattttggaaaatgaacaagtgtgtgtgtgaataactgggtgtattctatacatatggctttataacttacctattaacttaaggtcattaatgcaatgtcatcaaatactctttggatcatctagattgttgcacattatcctataatatgagatgccacaatttatttacacagtcgacaattgtaacccagcttgcttttggcttttactgttttacataatacttggtaaaaatcctcatataaatatttgaaaatttcctaagtgtccatttgtgaatgtaaaaattattttagagatctaagatttggtgcaaaacttgcaatcagctacatagttctacttgaggcaattttcactcaaaatatatcataaaccatagtacaaaaatagagcatagacctctccttgtgaagcagttgtttttgccttacattttttttttttttttttttttttgagatggagtctcgctctgtcgcccgggctggagtgcagtggcgcaatctcagctcactgcaagctccgcctcccgggttcacgccattctcctgcctcagcctcccgagcagctgggactacaggtgcccgctaccacgtctggctaattttttatatttttagtagaaacggggtttcactgtgttagccaggatggtctcgatctcctgacctcgtgatccgcccacctcggcctcccaaagtgctgggattacaggtgtgagccaccgtgcgtggctgccttaaatttttaataatcattgtgcaaattatttagcactccagtgttttgatttttctcctctgctgggtaggaataacaataatactgttattcaccatggtggtgtgggaagtttcaaagagcacatgtctataaagtgcttagtgcaaggcttggcatgcagttaacacaaaataaatgcgagctgctgtcattaacaatactgactacacggcactgtgatgcttatgtaaatgccaggctgtgtgtctgtaacctgaggtatttgtgtaaatattttcctaaaataaatctaactaaggttgttcttctcacttgtatggggtcatcttatgcggtagatgctcaaacacaaattccagatacagagtgggcagtggtagttaggaagatagaaaggctagggagtgttcctgggaagtcagtaaacttggaagatctaaggttatattaaaaatgttgtatcagaacaaaggctcaggacgttagtgttagcagaaaccagatatcttagagcagtggtttgtcaactttgccagcaatccacagtaagaaattcaactccggccgggcgcgggcctgtaatcccagcactttgggaagccgaggcgggtggatgacttgaggtcaggagttcgagaccatcctggctaacacagtgaaaccccgtctctactaaaaatacaaaaattagccgggcgtggtggtgtgtgcctgtaatcccagctacttgggaggttgaggcaggagaatcacttgaacacaggaggcggaggtgacagtgagccgagatcgtgccattgcactccagcctgggtgacagagggagactctatctcaaaaaaagaaaaaaaagaaattcaactccactaacacccacaatgcaaataaatgtgtgaatgtgtacaactattttatcaagcagtacttattatatgtgctgtaatctgatattttatagcctgtttcattttattttaatgttgattgttacccactaaatttatttcattgagaccccctaatttgaaatattgccttgaatatatatatacatatatatacacatatatacatatatatacacacatatatacacatatatacacacatatatacacatatatatacatatatacacatatatacatatatacacatatatacatatatacatatatatacacatatatacatatatacacatatatacatatatacacatatatacatatatacacatatatacatatatacatatatatacatatatacacatatatacatatacacatatatatacatatatacatatatatatacacatacatatatatatatacccttgtttaaaaataaaaggtttgcagctccatattttttaaaaaaatcttacccaagcatttaatcagtactgaatggttttgttcttgtcttcatgtcaagttgaatttgggggtactattccagaatatttacatgttagacaatgttctgtaaaaggggcattgtagcagcatgcaggcagtattcaaccaaaaactgggcaagagtcataattcactctggtttctctttccttttaagcaggtagttccaatttgccagcagaatgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaaggtaaccacatgaagtcccggtgactaggtcgcttataaatcctcatgtgggtcatggccacacgtgccaaagatgatcggtctattttgcgtggtctaggagagaatcttctctgatctcttcttaggatgcgactgacagaatggtggatgggcttggacaagtacccattgtccttagtaagaagggctgggagagcatatctgacaagttctgcagagaaaatacattaaggtctttgttagtgtgtgtatatatatatatatatatatatatatatatatatatatatatatatatatatatatatatatatattttgaggcagggtctcactgtgtctccccagctggagtccagtggtgtgaactcggctcactgcagccttgacctcctggactcaagtgatcctcctacctcagcctcctgagtagctggactacaggcatgcaccagtatgtccaactaatttttgtatttgtgtgtgtgtttgtgtgtgtagatggtatttcactatgttgcccaggctcgtctcaaactcctgagctcaagggatctgcccacctcaacctctcaaactcctggaattacaggcatgagctacgatgcgtagccagtgtatatattcttaaaatggagttatgcgggcaagaatctgcatgttactgcacccagaaatttttaaaggatacatatcaatcagtcttagatgttaactattagtattgttaaattggcggtatgagttatataaataaccatccttgtgtatgtgtgtgtgtgtgtgtgtgtatatatatatatatatatatatatatatatatgtatatggtctgcccagggtcaggccagcatcagaggcagggtctagaccaaggccagcaaactttttctgtaaagggccagcaagtaaacattttaggctttgtggaccacgtggtctctgccaatgttgagtgtaagtgaccgcagacagtacatcactgaaggcagtagaacatggcttgcttttaccatgatgccttttcttttgtggcttttctatttcatctcctgctggttctcccaccctggcaaacagatgtgggcttctcttgtagctcttctccatgagcaagctgagacttttctctctggaccccagatttgatatcaggctgaaaatatttcctccatggtgttccctaaaattctagccgaacaaccttagcatcacattcacagaaatcattatcatagtgttctggtttcagcgctccagacacgcctccctgcagccttagtcagagaagcctcggattttagctggttttcccgaggtctctgttactgccattctgcccttgaaggctttctagaagcctctttttcccccatgccaaaccccccctctagtttctctttcttgggttctgctatctggatgagctatttttttctaataattttaacctgtagaagatgtgatatgcatgaaatcccatttctgcaatgattcttcctgttctggtcacagaatctgcctgtggggagattctcagtgtggggagtgcatgcaccccgcgagccccatctcacccaaatgtggggaggccattgactcctgtatgttgtgtgtccgctacctttccatagcaaacatttagatggattacctcttagagtgggtttctggttttgatttcaagctgttgaggattgagcttaagtgccttctgccttgaatcagaaggtactaaactcatgatacttgaccaaaattaaagtgaaattccctgccgggcacagtggctcacgcctgcaatcccagcactttgggagactgaggtgagtggatcacctgaggtcaggagttcaagaccagccagaccaacatggtgaaaccccgtctctactaaaaatacaaaaattagccaggcgtggtggcaagtgcctgtagtcccagctatttgggaggctgaggcaggagaatcactagaacccggcaggcagaggtggcagtgagctgagatggtgccattgcactccagcctgggcaacaagagtgaaactccaactcaaaaaaaaaaaaaaaaaagaaagaaagaaaatggaattcccaccaatctgaacaggaaggtggcctctgtcataacaggtccagactggatattggtgaactagctaaagctgaagcagccagacaagttacaaggaagttctagttgattgcccaaacagtgaataaaacatgcttcttcctcattcctttccccgctaattgcactgcttagtctcctatcacaattttggaatctctaccaaatgtagatatctgatggggtggcaggagaattggctccatggggtccagggtcaactttgctcttggtgcttggtggcacgccatcagacgtgtagtccgagacacagcaaagggaccgggattgggtgcctgcagaaatgtcagagacgcatgtagtgggtggaaactctcatcccctgtttttttacaactctgcctgcccattctggtggttaggatcctttcctgatcattcagtttgcaggtcatatgttttgtagatttctaccctcggtatatgggcattaaaagagctcagtcttggccgggtgcggcgactcatgcctgtaatcccagcactttgggaggccaaggaagttgaatcgcctgaggtcaggagttcgagaccagcctggccaacatagtgaaaccccatctctattaaaaatacaaaaattagcccggcatggtggtgcacacctataatcccagctactcgggaggctgaggcaggagaatcgcttgaacctgggaaatggaggttgcagtgaaccaagatcccaccactacacgccatcctgggtgacaaagtgagactccatctcaaaaaaaaaaaaaaaatgctcagtcttgaatcttagtcatgttttccaagggtgatttatattcctaggggatttgggtggttctcgcttctcaaaacccatatcaaatgactttgcctgtgactttttacaaaaattcttattctaatacctctctgcgcccttcccaagcacacagatgatgttcagtaaatgccagacctctttcctcccatttcccatgtgccctgcctccctcacagccagtctgctctccttctttcctcccttcctctctttgccctcttcatccctctttcctttcccactatattctcatttgtgcaatttcccagttaaggtcagtgtcaccctgacttctctttctttttttaatcatcatctgtctttcttgacatttcacatcctgaataatttccttcagagaatcagttctttaagacatcagaacatgagtcaccctgcgaggtaccaccagactaacaccagggaccagcacccattctagcaaaacactgcctaagcagcctgaactgcgctagtttctttaatgagggttgtagcacagaaagttgctttcttttttttttaaagaaaggaaatcctctagcccaactaagctttcctgttaaacaagtgctttgagagacccattcagagtacttttcactagaaggacctttattgtgttttgtgagaaggaaggacaggcacaaacatgctgttagaatgtgccatggagaaagataagcccacaggttcgagtggagtaactttaccctttgtgtaaagattcagcaaagattctcagaaatgagcgggaatgttttcagtgctatgggatgagctctgtcgtttcctgatgaacacacttctcagcatgtgttctgggaaacactagtttttgtatttttggagttttcttgttgtttgtttgtttgtttttgttttgagatggagtctctctctgtcgcccagactggagagcagaggcgcgatatcggctcactgcaaccccgctcctgggttcaagcgattctcctgcctcagcctcccaagtagctgggattacaggcgtatgctaccacgcctggctaatttttgtatttttagtagagacagagtttcaccatgttggccaggatggtctcgatctcctgaacttgtgatccaccagcctcagcctcccaaagtgctgggattataggcgtgagctaccacacccggccttaaagtgatatcttcataaaataatctggaattaagaatgtggggtctttagcgcatctatgaattaatatttagttggaaccaaaacacagataaagatggctcattgaaacgtatcaatcgtaggatatcctagggaatctgtgaaaagtgctgagggagctgttccacttaataagatgaattttccattttcggcacataccacatatgggagtctactctggctacttattttctttctttctctgatcggttgtaaattaccatccacctccacagcctaaaaacaccagagtaattgatgcttgtaaagccgcagggtgaggggtattcctgcactgagtgattactgatggggaagggtggtgatactgtgccatctcattttattttattctttttatttatttgtttatttatttatttgacagaatctcgctcttgttgcccaggctggagtgaagtggcgtgatctcagctcactgcaacctccgcctcccgggttcaagtgattctcctgcctcagcctcccgagtagctgggattaccggcgcccgccatcacgcccagctaatttttgtatttttagtaaggacggaattttgccatgttggccaggcttgtcttgaactcctgacctaaggtgattcgcccaccctggcctcccaaagtgctgggattacaggcatgaaccactgtgcccggcctattctatttatttttaagatcttgggcaacatgctcattttagagaatttgctttcaagtcatgtaatttatgattgaaccttgggtaagaatctcttgctcatggaaacctaactcagctggtggttttcttcctgctactttgcagcccaagttcagaagtagatttttaatgatagaagtcaccataggaagacactctcctttgcactaactgggggttctcagtcctgcctgtacatcagaacctcttgtggaatttttacaaactctctaggtgcctggacccagcccctgaagatacagagtggttctgggatgaggcaaggggaagaatctatcatttaaaatgaattcagtggcctgaatattttctcccattctgttgtctctttactttgttgattgtttcctttgctttacagaagctttttaacttgtgatctcatttgtccgtttttgctttggttgcctgtgcttgtgaagtattactcaagaaatctttgcccagtttagtgtcctggagagtttcccaagtggtttttttgttgttgttgtttgtttttgtttgaggcagagtcttgctctgtcaccaggctgaagtgcagtggcacaatcttggctcactgcaacctcaacttcttgagttcaagcaattcccttgcctcagcctcccgagtagctgggactacaggtatgtaccaccatgctcggctaactttttgtattttagtagagacagggtttcaccatgttggccaggatggtctccatctcttgaccttgtgatccacccaccttggcttcccaaagtgctggaattacaggcgtgagccaccatgctcagacttccccagggttttcttggagtagtttcatagtttgaggtcttagatttaagtctgtaatccattttgattcaatttttgcatatgacaagagatggggtctactttcattcatctacatataaatatgcagtttttccttgcatcatttattgaagagactgcctttccccaatgtatgttcttggcacctttgttgaaaacaagtttactaaggatgtatgaatttatctctgagttctcttttctgttccattgatctgtgtgtctgtttttatgccaataccacgttgttttggttattatagctctgtcatataatttgaagtcaggtagtgtgattcctacagttctgttcttttggcttagattagctgtggcttttctgggtcttctgtggttcccatacaaattttaggattttttttctatttctgtgaagacagtcattggtattttcatagagattgcattgaatctgtagattgctttgggcagtgtggacattttaacaatattccaatccatgagcatggaatatcattccatttttctggtgtcctctttagtttcttgcatcattgcaatcaatttatagttttgattgcagagatcttttacttctttggtaaacttaattcttagctattttattcatagctattataaatgggattattttttttcttttttttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtgtatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtatctcacagtggttttgatttgcatttctctgatggccagtgatgatgagcattttttcatgtgttttttggctgcataaatgtcttcttttgattagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtagggaagggatccagtttcagtttcctacatatggctagccagttttcccagcaccatttattaaatagggaatcctttccccattgcttgtttttctcaggtttgtcaaaggtcagatagttctaggtatgcggcattatttctgagggctctgttctgttccattgatctatatttctgttttggtaccagtaccatgctgttttggttactgtagccttgtagtatagtttgaagtcaggtagtgtgatgcctccagctttgttcttttggcttaggattgacttggcaatccgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagagacaatttgacttcctcttttcctaactgaataccctttatttccttctcctgcctaattgcccgggccagaacttccaacactatgttgaataggagtggtgagagagggcatccctgacttgtgccagttttcaaagggaatgcttccagtttttccccattcagtatgatattggctgtgggtttgtcatagatagctcttattattttgaaatacgtcccatcaatacctaatttactgagagtttttagcatgaagggttgttgaattttgtcaaaggctttttctgcatctattgagataatcatgtggtttttgtctttggctctgtttatatgctggattacatttatcgatttgcgtatattgaaccagccttgcatcccagggatgaagcccacttgatcatggtggataagctttttgatgtgttgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattaatcttgctagcggtctatcaattttgttgatcctttcaaaaaaccagctcctggattcactgattttttgaagggttttttgtgtctctatttccttcagttctgctctgattttagttatttcttgccttctgctaacttttgaatgtgtttgctcttgcttttctacttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccacgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggatttgctttatgaatctgggtgctcctgtattgggtgcatatatatttaggagagttagctcttcttgtcgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacgtgagatgggtttcctgaatacagcacactgatgggtcttgactctttatccaatttgccagtctgtgtcttttaattggagaatttagtccatttacatttaaagtgaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagtgcttccttcaggagctcttttagggcaggcctggtggtgacaaaatctctcagcatttgcttgtctgtaaagtatttgatttctccttcacttatgaagcttagtttggctggatatgaaattctgggttgaaaattcttttctttaagaatgttgaatactggcccccactctcttctggcttgtagggtttctgccgagagatccgctgttagtctgatgggcttccctttgagggtaacccaacctttctctctgggtgcccttaacattttttctttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaagttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttctgttgctggtgaggaactgcgttcctttggaggaggagagacgctctgcgttttagagtttccagtttttctgttctgttttttccccatctttgtggttttatctacttttggtctttgatgatggtgatgtacagatgggttttctgtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaagaggcagtctgttggttctcagatctccagctgcgtgctgggagaaccactgctctcttcaaagctgtcagacagggacatttaagtctgcagaggttactgctgtctgtaccctgcccccagaggtggagcctacagtggcaggcaggcctctgagctgtggtgggctccacccagttcgagcttcccggctgctttgtttacctaagcaagcctgggcaatggcgggcacctctcccccagcctcgctgccgccttgcagtttgatctcagactgctgtgctagcaatcagtgagattccgtgggcgtaggaccctccgagccaggtgtgggatatagtctctaggtgcgccgtttttcaagccggtctgaaaagcgcaatattcgggtgggagtgacccgattttccaggtgcgtccgtcacccctttctttgactcggaaagggaactccctgaccccttgcgcttcccaggtgaggcaatgcctcgccttgcttcggctcgcgcacagtgcgcgcacccactggcctgcgcccactgtctggcactccctagtgagatgaacccggtacctcagatggaaatggagaaatcaccggtcttctgtgtctctcacgctgggagctgtagaccggagctgttcctattcggccatcttggctcctcccaatgggattattttcttgatttctttttcagattgtttgctgttggcatacagaaaggctactgatttctgtatgttgattttgtatcttgcaaccttacagaatttgtttaccagttctgatagttttttggtggagtctttaggtttttccaaatatgagatcatatcatccgcaaacaaggataatttgacttattcctttccaatttggatgccgtttatttctttctcttgtccgattgctctagctaggacttctggtgaaagtaggcatccttgacatgttccagatctaagaggaaaggcttttagtttttccccattcagtttgatactagctatgggtctgtcatatatggcttttattatactgaggtatgttgttctgtacccagttttttgaggattttttttatcatgaagtgatgttgaattgtatcaaattctttttcagcatcaattgaaatgatcatatggtttttgcccttcattctgttgacatgacatatcacattaattgatttgtgtatgttgaacaatctttgcatttctgggataaatcccacttgatcatgatgaatgatctttttaatgtgttgttgaattcaattttctagtattttgttgaggatttttgcatcaacattcatcaatgatattggcctataggtctttttgtttttgtttttgttttttgatgtgtctttgtctggttttggcatcagggtaatactggccttgtagaatgagtttggaagtatttcctcctgtttattttagaatagattgagtaggattggtattagttcttctttaaatgcttggtagtattcagtagtgaagccattgggtcctgggattttctttgctgagagactttttattatggctttgatctcattacttgttattcatctgtttgggttttggatttctttatgattcaatcttggtaggttttatgtatctaggaatttatccatttttttctacattttccaatttattggcaaatagttgctcatagtagccactaatgatctttgaatttctgtggtaacagttgtaatgtcttctttttcagctctgattttatttatttgggtctctctttttttgctttttttttttttttttttttttagttagtccagctaaaggtttgtcaattttgtttatcttttcaagaaactaacttcttggccaggcacagtggctcacacctgtaatcccagcactttgggaggctgaggtaggtggatcacttgagggcaggagtttgagaccagcctggccaacacagtggaaccctgtctctactaaaactacaaaaattagccaggtgtggtggcacatgcctatagtcctggctactcctagctactcaggagactgaggcacaagaattgcttgaacctgggaggcggaggttgcagtgagccaagatcgcaccactgcactccagcctgggcaacagagtgagactctgtctccaaaaaaaaaccaaaccaaaccaaaccaaaacaaaaaaccgtttttgtttcattgatcttttgtattgttttctttgtttcaatgtcatttatctctgctttgatctttattatttcttttcttctagtaactttgggtttggtttgctcttgcttttctagttctttttttttttttttttttttttttttttttttttttttttgagacagagtcttgctctgttacccaggttggagtgcagtggtgtgatctcggcttactgcaagctccgcctcccgggttcatgccattctcctgcctcagcctccccagcagctgggactacaggtgcccgccactgtgcccacctaagttttttgtatttttttagtagcaatggggtttcagtgtgttagccaggatggtctcgatctcctgacctcatgatctgcccacctcggcctcccaaagtgttgggattacaggcgtgagccactgcacctggctctagttcttttagatgcatcatcaggttgtttgaagtttttcttattttttgatgtaggcacgtatagctataaacttccctcctagtactgctttcactgtgtcccacaggttttggtttatcatgtttccattatcatttgtttgaagaaatttttcagtttcctgtttaatttcttcattgacccactggtcatttaggaacatattgtttaatttccatgtttttgtatagtttccaaaattcctcttattattgatttctagttttactcattgtggtcagtcagatgtttgatattatttcaatttatttgaatgttttaagactcgttctgtgacttaatatacgttctgtctttgagaatgatccacgtgctgaggaaaagaatgtgtattctacagctgttgtatgaaatattttataaatatctatttggtctatagtgcagattaagtcccatgtttctttgttgattttctgtctggaagatctgtccagtgctgaaagtgtagtgttgatgtctccagctattattttactggggtctatcactctctttagctctagtaatatttgctttatatatctgggtgctccagtgtaaggtggataaatatttaaaactattatatcctcttgctgaactgacctctttatcattatatagtgactttgtctcttcttatagttttgtcttgaaatctattttgtctgatataaatataggtatcctgttcttttttgctttccattggcatggaatatcttcttcaatcccttcattttcagtccaggtggagtgtctgttgtaggcaacagatcactgggtcttttttttttttaaatctattcagccactctatatcttttgattgacagtttagcccatttacattcgatgttatattgataagtaaggacttactcttgccattttgttatgttttccggtggctttgtggtcttctcttccttctttcctcccttcccttctgccttttagtgaaggtggttttctcttgtggtgtgctttaatttcctgctttttattttgtatatatccattgtatgttttttgatttgaggttaccatgaggcttgtaagtactgtctaataactcattattttaagctaaaagaaaactaataaactctacactttaacttcctccctctgctttttaactttttattgtttctatttatatcttattgtactatgtcttgaaaagttgttctagtcactattttttatcagttaatcttttagtcattttactgaagagtagtttacatgtcacagtcacagtgttatactattctgggtttttctgtatacttaactgttaccagtgagttttgtgccttcaggtgatttcttattgctcactaacatcgtttactttctgattaatgtactctgtttagcatttcctgtaggacaggtctagtgttgatgaaatccctcagcttttgtttgtctgggaaggtcttcatttctcctttatgcttgaatatattttccttcagcactttaaatatgtcatgccactctctcctggcctataaggtttccactgaaaagtctgctgccagacgtattggagtgccattgtattttatttgtttcttttcttttgctgcttttaggatccttccttttatccttgacttttaggaatttgattactaaatgcctgaggtagtcttctttgggttaatctgcttggtgttctacaaccttcttgttcttggatattgatatcttcctctaggtttgggaagttctctgttattatcctttgaataaactttctacccctgtctctttctctacctccactttaatgccaataactcttagatttgcttttttaagtctattttctagatcttgtaggtgtacttctttcttttttattcttttttcttctgtctcctctgaccatattttccaatagcttaccttccagctcactaattctttgttccacttattcaatcctggtattaaaagtctctgatgcattcttcagtatgtcggttgcatttttcaactccggaatttcagcttgactctttttaattatttcaatctctgttacatttatctgatagaattctaaactttttctgtgttgtcttgaatttctttgagtttcctctttgttaagtttatctgatagagttctgaatgtcttctctgtgctatcttgaatttctttgagtttcctcaaaatggcaattttgaattttctgtctgaaaggtcatatagttttgtttctgcaggtttggcccctggtgtcttatttagtttgtttggtgaagtcatgttttcctggatgttcttgatgcttgtggatgttcatcaatgtctgggcattgaagagttagatatttattgtagctctcacagtctgggcttgtttatacccatccttcttgggaaggatttccaggtattcaaaagaacttggatattatgattgaacccatatctgcattagggggcatcccaagctcaataacgctgcatttcttgcagactatctggaagaattatctggattatcaagcccacactcttgttcttgttgcttactttctcccaaacagaatcaatctctctctctctctttttttgctctttctctctcccccttcccccctccctcctctccctttctccttctctctctccctctgttctgggccacccagagctaggggggtggagatacaagcaccaatatggccatcaccactgagaatgtactgggtcagacatgaagctggcaccacactgggtctcgccatggcccactgtaaccatgatctggctgcctatgttccctcaatgccctgttgtgaagccagccaggctagcttcaagccagtgagttcccccaggctgcagccagatccagagatgccatctgggagccatggactggagtccaaaaccttagaaatctgcttggtgtcctatctattctactgtggctgagctggcactcaaaccattagccagtcctttccactattctgccctttccacaggctcaggggcctctccccatgtccaccaccaccacaggcctatgaggagtgctgccaggttactgctgatgttcggtaaaggcctatggcctcttcagtcagcttgtggtaaatcctttcagtcacccttcagggcagtgagctcccctctggcaaaaagcaagtccagagatgtcatccaagaacctaaggcctagactcagggaccccaagaggggtctctatttgttgctttaccccactgtggccaaggtggtagcaagtgcaaggcaggctgggcgcagtgtctcatgcctgtaatcccagcactttgggaggctgaggcgggcagatcacttgaggccaggagttagagaccagcctggccaacatggcgaaaccctgtctctactaaaaataaaaaaaattaggccgggcgcggtggctcactcctgtaatcccagcatgttgggaggtcaaggtgggtggaacacttgaggtcaggagttcaagactggcctgaccaacatggtgcaaccccatctctactaaaaatacaaaattagccaagcatggtggcacacacctctaatcccagctactcgggaggctgaggcaggagaattgcttgaacccggtaggtggaggttgcagtgagctgagatcgcaccactgcactccatcctgggtgacagagtgagaaaccatctcaaataaaataaaataaaataaaataaaataaaaaatttttaaaaattagctgggcatggtggtacatgcctgtaatcccagctactcaggaggctgaggcatgagaattgcttgaacccaggaggcacaggttgcagtgagctgagatgacaccattgcactccagcctgggcaaaatagcaagactctatctctgaaaagaaagaaagagagagagagagaaagaaaaaagaaagaaagaaagagaaagaaagaaagaaagaaagaaggaaggaaggaaggaaggaaggaaggaaggaaggaaggaaggaaagaaagaaagaaagaaagaaagaaagaaagaaagaaagagaaagatcaagagcaagacaaagcaccctttaattttccttctgcttttctcaagcggaaggaatctctcaccatggccaccacagctgggaatgtgctgggtcacaactaaagccagaatatcttagcctcaattaaggcccacagccttggatattaactgggtatcactactgtttattcagggctcaagggctctttcatcagcaggtgatggatcctgccagagctgggtccttgccctgcaaggcagcaggctcccttctgatccaggattgtctagaaatgttgtctgggaactagggcctgaaacagcctcatgaccctgcctggtgccctatcctactgtggctgagctggtatccaagatgcaagacaaagttctctttactcctccctctcatctcctcaagcagaaggaagaggtctcttttggagcagtgaggttggcggggaggggccgagcaagcattccactagctgctctggctggtgtctcagtaggtcatgtgcctgctaagtcaactggctccaagtccagctcagcactaggacttgcctaagagttgtagttcatggggcctacactgcctttcaattttatttagagccccagggcactttggccctcggtgacgaggtttgccagaattcaagttctgaccaaggtacaggagattcccctctggctagggctggtctaaatgctccctctatggtctggcatcagctgagttcagcctgcttttgctttctactgtctgtaacagggcagcactgagttcagtgcaaagcctcacaatcgctgcactgtccctctcccaagcgtacagattttctctccatgccacacatctggtgctggggctgggggaggggtggcattggcaattcaagactatttttcctaccctcttcagtcctttttcagcaatataaagttaaaaccaggtactgtgagtgcctgattttttggtttttataaaggtgcttttttgtttgtagatagttgttaaatttgatgttcctatgggaattacaattcgtgcgagcttctatttggccaccttgctcctctccatattcgccatatatatatatatatatatgccaatagagggaaggagaggaatcacaaacattgctttaaaacagtaatacatgtaaatgatccaattagaaaagggtccagaatgaaaatgaagttttccttcctgcctctcctgtccctcagtcatgcagtttcctttccaaaaaaaatactgctggtctgggcacggtggctcacacctgtaatcccggcactctgggaggccaaggcaggaggatagcttgtgggcagcagttcaagaccagcctggtctgcaaagcaagacctcatctttacaaaaaaatttaaaaattaggtacgatggcgtgcactttagtctcagctactccagaagttgaggtgggaggatcacttgagcccaggagttcagaggctgcagtgagctatgagcatgccactgcactccagcccaggtgccacagtgagactttgtcttttaaaaaaatgacaaaaagaaattacggttaccagtttctcaaaatatgtccttccagagagatacacgtttgtatgcgcaaagaatgcttgcaaacttgcttcctcatatacccatacacatatgcagaaacagatgtgcacgtgtgtgtacatatatgcattcatattgtgtatgaattctatgcatcacacagctgaaagcacaagatggtagatacccttctgcttttgtctcttaacagtgtaatttggaggtaattcctaccatatttatggggtcacctcattctttttttgctgactgcataggctatcattgtaatcgtgtttaactggctgttcccagtaggcatttgggttgtttctagtcgttctgataaatagggctgcattgaaaatccctgcagtaggtacatgggggatatttcctagaagtgtgattatttggtcagtgcatgtgtgtgttaaattttgagatctggccaaattactctccataaaggctacctcagagtgtctgtttctctgctctcttttgaacctagaatgtcatcccaagcattaccatgtgccaatgttttgctattataggataaaaactactatctcagtgaagaattgcatttctcttttaggaacccaaatatcttctcacaggtttaagagccatttgaggccaggtacagtggctcatgcccattatcccggcactttgggaggccgaggtgggcagatcacctgaggtcaggagttcaagaccagtctggccaacatgatgaaacccggtctctactaaaaatacaaaaattagccgggcatgatggtgggcgcctgtaaccccagctactcaggagagtgaggcaggagaatctcttgaacccaggagacggaagttgcagtgagctgagatcgcatcattggactccagcctcagcgagaacagcattgaatttccctttgtatgaactgtcttttcatgtcctttagccattctctcttcaattgtttctatggtttttttttctttttgatgttggactttttatctacttgttttccttgtttgctgcagtgtgtaccaaccagtgcagcttcttggttgttggtgggtctgtaagcaagcgttcggagccagcacagagaggatgagaggagggctgcactcatctgctcttccagatggcactgatcaaaggacgtggtgatcatgggaacactctggagagcacgtagccatatttagatatattgacaacacaaccatttagtagactcagggtgactttaagccacatgtcacatggcagctgttaaaatcatctctgtacatgtacatggatagttctgatggcacacccttgttagctttgtagcttttagctaaagggccatatggtgaaggtgcattttttgcatttcttatttcttctcttttctttgtcaatatatccattctagaaaatgagatgagccaggcacagtgtggtgcatgcctgtaatcccagctactctgaaggctgaggcaggaggatcacttgagcccaggaatttgaggccagcctaggcactgggcaacatagtgagactccgtctcttaaaaaaaaaaaaaaagaaaagaaaagaaaaagtggccaggcatggtgactcaagcctgtaatcccagcactttgggaggtcgaggcaggtggaccacctgaggttaggagtttgagaacagcctgatcaatatggtgaaaccctgtctctactaaaaatacaaaaattagccgggcgtggtggtgtgcacctgtagtcccagctactcgggaggctgagataggagaactgcttgaacctgggaggcagaggctgcagtgagctgagatcgcaccactgcactccaccctggatgacagaacaagactgtctcaaacaaaaaaaaaatgaaaaaagaaagaaaaaaggacaaaaaaagaaaatggggcaagatgcttactctttctgtaaattatctttgtagttcaagtgtccagtaaagttctctgttccaagcagacacttaaaataaatatttgctcaaaaaggtcaattcctccacgtgctgttttgctgcccttcctaaaggcatgtgtatcagtgcagcacttcttaactgatgttaataagtgttctgtgattttttaaaaagtgcctatgattatattaattttggaaaagctattttaaatattaaagcattttaaacatttaacttataaaataaaatcagtttatttactacaggacttctcacagcctttaatgtacaagcaaatccaccgaacttccaagagagggttgcaaggtgctgtcttctgcaagtgtgtctgtccatggagctctgttttcatattttcatggtatctcattgaaatacagctcaagcaattagcctaaactcatagatgaataaagagtagacatcaatttgtttgtcccctgatttgtctgaattaggccaaacaaggatctttaactggaaatagggttattgattacttgactgcagtcagatttctaaaattgagtaaaaacgtgtttgcggttcaattgcagacaaagacatactggttactttctccaggctccccacagtattggcagaagtgtaaaattaagagatcaaggtcatttctggtaacccctcactgcacctactcgaggtctgatgccaccctctctgtctgaatcatccaaatcaaaattggccagggatgagggtatagtgctgggaccagacagagccaccaccagctggtggcttaattatgaagcaaatttatagagccacaagggggatggaccagaagtggactgggaaagatcattatgtccagctccttaacagggcagtttcttctttccacttgagttatttctaaaattgactttttaaaaatcccttattggccttttctgtcttcttgagaaatcttgtctgtttttcttctcagccttcctgaaatgcgtaacagtggttctgaacagtgttctagaaccctggtggtggggatgtgtcacaagtcatctgtgtgctaaagtaaaccattaaaagcacatgcatttgcaaattaccaccaaatagaatggattcaagagtaccttatgtaaggtcttatctacctactttgagaacgcctttttgagtggaatgagctgttctgattgcctatgtgattacagtgcttatgagtggctttatatttccatttttattttcccttttgataagattgcacttgagctacaaagataccaggaacattttcatttgtaataacacaactgttatgattacccgatgaaaggcagccaaaatgatgcgagaaaaatgttcaatagtgatattgtggctttaaaaaagcaatcaggttaattatttgcattcctcaatagtctacacttgttactttttttttttttttttttttttgagacagagtttccgtctgtcgcccaggctggagtgcagtggcactatctcggctcactgcaacctctgcctcccaggttcaagagattctcctgcctcagcctcctgagtagctgggattacaggcatgcaccaccatgccccattacttttttgtgtttttagtagagacggggtttcaccatgttggccaggctggttttgaactcctgacctcaagtgatccatccacctcggcctcccaaagtgctaggattacaggcatgagccaccatgctcggcctacacttgttactcttgccatattgtctatatttcctttggagtaggagtctagaaaatacatcattttgccaggcacagtggctcacgcctgtaatcccaggactttgggaggccaaggctggtggatcaccaggtcagaagttcaagaccagactggccaatatggtgaaaccccgtctctactaaaaatacaaaaattagccgggtgtggtggcaggcacctgtaatcccagctactcaggaggctgaggcagaagaatcacttgaacccgggaggcagaggttgcagtgagccgagatcacacaatctttattattatagttgttaagactgatatttttgtaattttttactttcaagtgtcttttaatatattcccatctccaaaaatagttgtgccacactcattgttaatttctcttctctgccaatttggtggggattcatcaacacctagttctctccattatgtgcgtcactcaagggagcttcatccagcatgcatgttcatggagaacttggtgccaaagaggtgcttcctcattctcttttcttttcttttctgtttgtttttttgagatggagtcttgctctgtcgcccaggctagagtgcagtggcgcaatctcagctcactgcaacctccacctcccgggttcaaacaattttcctgcctcagcctcctgagaagctgggattacaggtgcccgccactgcacctggctatttttagtagagacggggtttcaccaccttggccaggctggtcttgaactcctgacctcgtgattcacccgccttggcctcccaaagtgctgggattacaggcgtgagccaccgcgcccggcctgcttcctcattttcttcctgatttatagcatgcttgcctccagctttcatagcagcagcatgcttatgccttcctcgaggcatcaagatgtcagcaggatcgattccttctgagagctacaagggagagatctgttctaggcttctctccttggcttgcagatggccattttctccctgtgacttcgcatcgtcttccatctatctctgtgtccaaatttccctttttgtaaaggtatcagtcatgttgaattagggtcctctctaatgacttcactttaatttgattacatctgcaatgagcagtttccaaataaggtcacattctgagggatggaggtttaggacttcaacatttgaatctggggaagacacaattcaactcataacaacatgttaatttgctacttacgaacttttctcccttttttttaaagaatgtacatggcaagtcaaagcaaacgatcgcaagtaccacgaacaacctcactttatgaacacaaaattcttgtgtattaaggagagtaaatatgcggtgagttgttaactttctgaattgttttcattaaaatgcagttttttccagtagctggcatgcttactaccttcatgctacacctgccttccacgtaaccacctgcctggggctactgataatcatcattgtttctatagaatgtcatttttattgatgtttacctttggggtgggtagcgggtgacttgaaacaaaacagaattatgtagattgaaattttctctctcttttttaaattttaagctctcttagaaatgttttatgaaagaatatacaatgatggcacagaagcctcctgtttgaaagtaatgagtttgaaaggaatctcttaagaacttatcttccccttctctgcctggaatggatttagagattttaaacatatttttgactcaaaaatgcttattacctttggaatgtgataaagaatgcttaaagattaaatgcgaaatacaaaaattagcctggagtggtggcatgtgcccacagtctcagctacttgggaggctgagccaagagaatcgcttgagcccaggaggcagaggtttcagtgagctgaaattgtgccattgcactccagcttgggtgacaggagtgagactctgtctcaataataataataataataaatattaagtgtgggcttaaatgttgtaagatgtgtgttttaatgccaagggcttccatagcagagtaccacaactggatggcttaaaacaacagaagtttactctctcctgatgcagggatcagaagtctgaaatcttggtgttggcagggttggctccttctggagcctctgcaggagaatctgttccctgcctctcccctggcttctggtggccactggcaatccttggagttccttggcttacagatgaagtcaccccaatctctgcttccatcttcaaggggcactcttcctgtgtgtgtctgtgtgcaactttcctcttatagggaccccagtccgaataagcacctcattaaattagagcctgtcctaatcacgtatgacttcatcttgattatctctgcgaagatcctatttccaaataagatcccattcatagatattagtgttaagacctgaacatatcttttgcaggacacaatgcaacccactacagtaccttttgctctttcttacatagtaggctctgtctcctcacttaaataaaagcctcacttttcctggctttggccatgttgttgtctacctttaccctgttttctaacagtctctaatgggtcaaggaatctgacagcaggatttatttggtcacagtctgatgtctgtttcttgttactgcctctgtcataagactccaagtagtcattttgaggcttggctgcttggctagaattaaaagcttaaaagaaatatcagtatctttctttcttcttttcttttttaaggcagagtctcactctgtcactcaggctggagtgcagtggggcgatctgcaacttctgcctccctggttcaagcgattctcctgcctcagcctcccaagtatctgggattacaggtgcaggccaccacgcctggctaatttttgtatttttagtagaggtggggtttcaccatgttggctaggctggtctcaaactcctaggctcaggtgatccacccacctcggtctcccaaagcgctgggattgcaggcataagccaccgcacccagacaaaatcctcaatatctttctgacagatgatgttcctttgtcactgtaagctgtgggacttgtgacttttgcagatgtgtatacattgtgataaatacagcatcatttagaatgactcttattttttccaacagaataatgcaattaaaacatacaagtacaacgcatttacctttataccaatgaatctgtttgagcagtttaagagagcagccaatttatatttcctggctcttcttatcttacaggtaatgccctttgctatcttaaatctgtttgaattatagtgactcgataacatttaagctgtagacacatataatgtgaataatcttgaaagtgttttatattagcatcagggttctgtacataaaggaacagtgcctcatacacagaaccagctcaatcagtgttatatgaacagggaaagggagcaaatggaaatattattctaattctgtattttaaaaaatttcatgttatactgatatgggtgttaaaattggtatccctgaagtgaataaaactaaaatccagccaggctcagtggcccacgcctataatcccagcactttgggaggccgaggcgggtggatcacctcgggtgaggagttccagaccaccctggctaacatggttaaaccccgtttctactaaaaatacaaaaaattagccaggcgtgatggtgcatgcctataatcccagctactcgggagactgaggcaagagaatcgcttgaacccaggaggcggaggttgcagtgagccgagatcacaccattgcactccagcttggacaacaagagctaaactccatcttaaaaaaaaataaaataaaatccttactttgtaaaattatttgcaccttaaaattaaagctattttgtgcttgtcttttatcattgtagttagatgctgaatttcccccccaaaaagatcattgattttttattaaaattttggtcataaatttcagtaagttatttttgtgaactgtttttacattttaaaaggcctacttaaaaattttttttcctaattgtggcaaagcatccagttatccagagagcatgagtttagctgtgcaagaactgttgctgtaaccgagggaactctacacacactagttagcgccagaatcaacctttagtgtctgccgtgcggattacatagcttaagctcagaatatccacctggttttttcagattctttttttttttttttttgagaccgtgtttcgctcttgtcgtccaggctggagtgcagtggcaccatcttggctcactgcaacctcctcctccttctcttgggttcaagcgattctcctgcctcagccccctgagtagctgggatcacagttgccagccaccacgcccagctaatttttgtatttttagtagagacagggtttcaccatgttgaccaggctggtctcaaactcctgaattcaggtgatccacccgcctcagcctccccaagtgctgggattacaagcatgagccactgcgcccggcactttatcagattctttacggcaagcattggatttggaaaagttatacctgctgggattgaccctttaaggttttatgaaaatggggtagaatgtgtgtctaggtggggatggaggatgcgtggagaggagagaaaaagaagagacgatggtaaggagaaatggataggcaatgatttaggaaactgtaagaccttcaagtcagatagtaaaggatggccctgttatcaaaggagatgcttagaaaggtgtgtgtagaggttagcactgcaaactccaaggtgctgctctgtaggaagtagaccattttcccttacttccttctagcagggaagaggagtttcacatattcactgtgatgtgggaagaaggatctttttgtcttctaactgcaccccagttatcttctctctctcttttttttttttttttgagatggagtttcgctcctgttatcaaggctggagtgcaatggcgtgatctcagctcaccaaaacctctgcctcccaggttcaagctattctcctgcctcagcctcctgagtagctgggattacaggcatgcgccaccacacctggctaattttgtatttttagtagagacggcgtttctctatgttggtcaggctggtctcgaacttccaacctcaggtgatccgcccacctcggcctcccaaagtgttgggattacaagcatgagctaccgtgcctggcgcagttatcttctcttaaggtcagcaatccaaattagggtaacagtaatagccgtaggcagcttcttaacttgtgttgtcactacacttaattcttctagtctagaaggtcaggcctggcatgacctccattttgcagagaaaagctgaggcctagtaagctaaagtaacttgctcaaagtcccataagccataaatgatagagctgaccaagacttggatctaggagttgactccaaagcctgtcattttaaccactacattatacagcccagtgatcaggaggatggttatgaaataactttattaaacttgcatcccaatctttgttcaaacttagaggctgtcttgatggaggaaggccagctcactttcttggataggccaatagtgatgatcatgaaggaagcactttcttctaatgccctcagagatgctctccctaatccctcactttcagaggcagctagtacctcttgccatcattgccttcagcatgggatcctcagaaaccactgactgagaaacctgcagtatagaacctactatgcatgcattccttaaaagttaagatgactttggccaggcacggtggctcacacctgtaatcccggcactttgggaggctgaggcaggaggattgcctgaggtcaggagttcgagaccagcctggccaacatggtgaaaacccatctctactaaaaatacaaaaaaattagccgggggtggtggcacacacctgtaatcccagctactcaggaggctgaagcaggagaatcgcttgagcctgggaggcggaggttgcattgagccaaaattgtgccactgcactccagcctgggtgacagagggagactctgtctcaaaaaaaaaaaaagaaaaaaaaagttaagacgagacttctcccttgccactcctaccccctcacccccagttaaatatgattttcacaaaagatttagagcaactcttttttaggtatcataatacaaaacttccttggtgtccagttaagtttgcaatgagataatttcaggagccactgccctctaggctctgttccaggtatccagaagctagagagaaccactagaaggaggttgtccaaatgcttgaagagcctttcctatatactctgcaggatgtagacttatgtgatgacggtgatgagacttggaattagcaagcttagaattagcaataagttacctgtaagcttgatatgccttcatggacacacacataagcccttttattcttttaggcagttcctcaaatctctaccctggcttggtacaccacactagtgcccctgcttgtggtgctgggcgtcactgcaatcaaagacctggtggacgatgtggtgaggatttctcatacaacgttctactcattgctttgagttgactttaagttctcgtgccttccttctctattgagatgtttaaaacagcatttccccatcttccttctcaaggctcgccataaaatggataaggaaatcaacaataggacgtgtgaagtcattaaggatggcaggtactgtgtctaattagtaactgagtttcaaggatgtaatgcataactctgcctagaaacacattcagagataattattacaatgtagaaggctattagtacattaactgtttatttttttcgagatagagtctcgctctgtcgcccaggctggagtgcagtagcgttatctcggctcactgcaacttccacctcccaggttcaagcaattttcctgcctcagcctccgagtagatgggattacaggcgtgcaccaccatgctcagctaattttgtacttttagtagagatggggtttcaccatgttggccaggctggtctcaaactcctgacctcaagttatcctccttgatctcccaaagtgttgggattacaggtgtaagccaccatgcctggccttaaattatctttttaatgagtatgtacccctgttgtaataaatctaataaggatagtgataaaaatagataaaaagatgactattttgagtactaaattccataggaaatattcattaaaatttttaacatatcaacacttttaaaagttttaaactataatattgttttaaagattttcacatatacaaatgatatacccagtggacgtaatgaacctgctataaataataaacttaatttcactggaggcagtcgtctaatcactatgtgtttatctgccattcatttatggccaaaaatgacttggagatttaaaatactttttaaatatatgtttatgccccagttcccctaatgaatttagtatacaattcttaactccagcattaaaaaaaaaatttggcttatctttcaattgacgaaattgtagatgttttacatttcagtatttctgaaattttaaaatagaaatttgcatgtaagtccgaaatgacaaatggataggccagcaccttcttagcagggctactggaaggcaattctgaatactgaaatattggaggcaattctgttagattcttctatccgatgttccagtttcctctgaggaggccccctgtgctctaccctgctaatgctcaagttcctataggtgtgaccccactgcaggggctgctcaggccatggccctgccagacatgcaccctagacttccaaattcaaggcaacccagagctcctctttaccagtgtaggtaggtatggtacaggctaaacatatgggttggccaggcacggtggctcacgcctgtaatctcagcactttgggaggccgaggcaggaggatcacttgaggccaggagttcgaggccagcctggaaaacttagtgagactcctgtctttttttttatttttttgagacggagtctcgctctgtcgcccaggctggagtgcagtggcgcgatctccgctcactgcaagctccgcctcccgggttcacagcatcctgcctcagcttcccgagtagctgggactacaggcgcccgccactgcacctggctaattttttgtatttttagtagagatggggtttcaccgtggtcttaatctcctgacctcatgatccactcacctcggcctcccaaagtgctgggattacaggcgtgagccaccgggcccggccgagactcctgtcttaacaacaacaacctcctctgctaggctcattgggacacttattctattttactgaatgaagtgtttcctaatcctagaattgtaaataaagccaattaagatctttaaattgttgtgattttgtcttttgacacttgaaaggtaactttggaacataattttcttatttgcaaaggaaaaaaagccatctaaacatatttatagcttggtatagtctatatttgcattagagtggaagtacggctgtaagtcaggttactttcctcagtgttgacacataaaaagtcttggaatgaggccttagttactatttttagcacttgaatttgcagttctgcctgaagcctcctgctcaaaaaacaactcattactgatccctgagttggtgctttcgtcacagttgactacgttaatttaacaaacacttatggagtactttctgcatgttggaggcaggacagtatccttgagaaatttatagttcaagacagaagatgagacacctacacacatcattctaataaaatccatatcagaataaaaaagataaaaacaaaatgctctgacagtacagggaagggaaaattcactttagcgagggaatgtggggaaagatgtcaagacgtgagcaaagccctgaaaatgatgccctagggaggctgaaggggctgtgtaaacacaagttgtggtgacaacacaaagctccatcagacaactgaccataatccaatttgagtgtagcctcagggccttaaagggaatacagtgtctttgtcagttaagcctttacaattaagaagttaaccggccaggtgaggtggctcatgcctataatcccagcactttgggaggccgaggtgggtggatcacctgaggtcaggagttcgagaccagcctggccaatatggtaaaaactcatctctaaaaaattagtcaggcgtgaaggcacgtgcctgtagtcccagctactcgggaggctgaggcaggaggatctcttgaaccccaggaggcagaagttgcagtgagctgagatcgtgccactgcactccagcctgggcaacagagcaagactctgtctcaatgaaaaaaaaaattaataaataaataataaagataatttaaacagcagagagtaggcaagctctgaagccccacgaagactctgggaggcccaggtgggtgccataatgtaggtgcttctgtcctgggaccagcatggagcaagtgatgggtcactgagaaggaacacagcagggaggcaagttggacataagcaaaaacaaaagggggtggcaagtatttccctgccacgcacataagtggcccccataaactcttccttacatgacctagatgaaaagaatgtatcaaagtcattcatcattgcttccttcagaggtcaatacaattttcatgcccccctttaatatgtttacatccattaaagagcaaaattttagcattttctctgtgacttgcatattttccagaatctataacatccagaaagaatagtaattcccttgcctgtaacttaaaatgtcaataaatcctcattatttttaatccttaggttcaaagttgctaagtggaaagaaattcaagttggagacgtcattcgtctgaaaaaaaatgattttgttccagtaagtgaacaaattctgcttctcttgttccttgttctcccccagcccctgtgctcggcttttccctcagggtctcggtgttatttgtgtgttttgttttggacaggctgacattctcctgctgtctagctctgagcctaacagcctctgctatgtggaaacagcagaactggatgggtaagtgtgtctcgatgggcctgatttaaagctggcctttgaaggcacattcattccactgaaatcggggcattgtggaccagacggcttgatatctggccttgcctctgccacctgctgctgtccctactgatctcacctttgcgcctctgtgaagtggagctcttactacctgcgtttctccacctctcagggaaggtaaaaggatcagacaggagcatatgtgtctgagccctttatcaactgctgagcagcgtccagacagatatgaataatatcgaggttattatctgtgtcagagaaaggaacagatttttaaagtctttaccaataggcaatttatttatttatttttgagacagagtctcactctgtcgcccaggctggagtgtagtggtgctatctcagctcactgcaacctccacaccccctgggttcaaacaattctcctgcctcagcctcttgagtaactgagattacaggctccagcccccacacccagctaatttttgcatttttagtagagatggggtttcaccatgttagccaggctggtctcgaactcctgatctcaagtgatctgcccaccttggcctgccaaattgctgggattacaggggtgagccacagcagctggccccaggaggcaattttgaattctccttgtgttggttttggttactatgctatcatttaaaagagaatgaagttctgtttttgaccagttttctgaccagttttcaaggcatttattgagtgctcacgaggttgccggcactttacatattagctcatttaatcctctaaacgaccatgtgagacgaatattattcgtctgtattacccatgaggaatcggaggcccagggaggtgcagcagcccgcccaaggtcacacagtaagtggtagagtcgggacattgctccctctgctcctcgcgcctcacgctccagatgtgcatacactgctttacagagagcggaaatcatgagactgaaaactagggctgtcattgcttcatagatcaggcaattgactgttggaaatctatcacactttttttttttttttggcggaaaaaaatacttaaagccaattaaccacttcttaattgtacaggctaattggttaaaaaccaattaaccacttcttaattgtaaaggcttaactgacaaagacactgcattctctttaaggccccgaggctatacccaaattggattatgggcagttgcctgatagagctttctgttgtcaggttggtctcaaactcctgacctcaagtgatctgcctgcctctgcctcccaaagtgctgccattacatgcgtgagccgcggcgcccgactgtttattctcaactataaaactgctattatttccatgagagattctaaagctttacaaagacataagatcctaacatgccctgccagaacagaatggtgaggttgagaatgaacttccctagggaaaattcctgagtattcgtgaatcctatataaagccttcagtcgtgagacggcagcctcacccttgagagcacctgccccggcctgcccttgtgcccacccacgaccttaccttgcactatggtggggcagttgggagtaaagctaagacttccttttccaaataaaattgtctttcaaaaacatgtgatccagttattcactctggaaaagaatttgacagaggcgaaacagaatttctgtaacaaatatgtgttatagaatcattttaatgtgattaaatattagacactacattttcaaacagcactttggtagtcctagctgatggtaaagttaaagttaatgagaaggatgtttgtgggtacctctgtcctaaccttcacaacaacaaacagtgaagggaaccaacatttcccaaggtcagaaattttctcgacttcaggggataaccttttccaaacctgaagttccaaggtgaacagagtttgaaaatagaaacagctaattatttaggcttcatgtccaggtatggctaatgtaactttggatgattaacttccactttgaactcaaaaatttgttcatttaattcattttttccccattcctttagagaaaccaatttaaaatttaagatgtcacttgaaatcacagaccagtacctccaaagagaagatacattggctacatttgatggtttgtaccaaacatgtcttactttgctttaaattttagttgcttggttcaattcctattgattaaaaccagaaagacttttgtatgtgattaattatgtgaatcttatatttttaaaaggttttattgaatgtgaagaacccaataacagactagataagtttacaggaacactattttggagaaacacaagttttcctttggatgctgataaaattttgttacgtggctgtgtaattaggaacaccgatttctgccacggcttagtcatttttgcaggtacgttcagagtttcttgggaaattaatcagctatgatctttaaagacttagaggggattgcttttctgtcctttgtccatcaaaaccaaaagaagagtaatagcatcatgagcttttttttttttttttttttttttttgagacagagtctcactctgtagcccaggctggagtgcagtggcataatctcagctcactgcaacctctgtctcctgggttcaagtgattctcctgtctcaggctccagagtagttgggattataggcatgtgccaccatgcccagataatttttgtatttttagtagagacagggttttgccatgttggccaggctggcctcgaacccctgacctcaggtgatccgcccaactcagcctccaaaactgctgggattacaggcgtaagccaccatgcctggccaagaagagtaattttattggtgagctagtgaattgatttttcccaactgatgactacattgaattttccattttcaggtgctgacactaaaataatgaagaatagtgggaaaaccagatttaaaagaactaaaattgattacttgatgaactacatggtttacacggtatttatttttcatctcagtagatctctcatctagattgctgtcttttgcactaatattatcgtatgtttttctaatacaaaatcttacctctttaggtggaatagaaaaattattgggcactccaagcttcaaatgcaggaagaagggatttttttttccagaaatgccttactttttctcagaaatgccacacttttaacaggagaattcccttgggaagggaaatttcggttgtagggtgccctgagtgctttgatgacgggaactggaaaaccaggaagccctagataaattagtgaagctggactcctgaagtcaatgtagggttgatttcattgctgttactttcccatagaggcagttctcttagaagcaagcctcccccagcacccccaacatatactgtatagctccaaatacaaggcaaggctaaaaataaagtatgtcgaggacactcaagaccactcccaggtttgatgattcactggaaggactcataggcctcagcacatagtcgtattcacagctgtgagtcattacaacaaaaggacacagagcaagatcaccaaagactcatggagcaaagtgcaaaggaaaccaggcacaagcttccaaaagtcggccgtcctgcccccactccccaccaaaccacacacacaataggcacttaattctcccagcagcaattaatgacaccacatgtgaaatgttgtctataccagggaagctcatgagagactcagtgtcaaaggtttttaacaaaaaaactctagactccccaaaagaatgcagatggtcagcataaaccatgctgtttgcacagttaggcatcatgagtttttttattattattattatttgtttttttttgagattgagtttcactcttgttgcccaggctggagtacaatggcatgatcttggctcactgcaatctccgtctcccaggttcaagtgattctcctgcctcagcctcccaagtagctgggattacaggcacctgccaccacacctggctaatttttgtatttttagtagagacggggtttcaccatgttggccaggctggtctcgaacccctgacctcaagtgatctgcctgcctcggcctcccaaagtgcttggattacaagcatgagccactgcacccggcccatgagctattcttatcagagaataaaaaataactgggaaatcctccaaacatctaagttaccagataccagcccagggcgaaccttgcaagccggccttcggaggaagcagtctcagacctgctatgtttgctcttttctgcccacgtggtgaccccaaatattaagcactccttctatttcccaatgaaaaattttttcaagtatttaattcaatttgaatgcatacttctaaaacttattctttgattgcatatacatgtttaaaatcacataaaaataataatttaagaaacattttcccctgctttctcatttcatgaaaattgtatttgaacttttcacattcatctttggtgtcatggttgtggttatccactctcaaagagcctgtttggcactctgctctttccacgacaaagttgtgagatatagcacttttggactccatgtccagaaatttaaatttgtctctggaaattttattcccacttgcgaatctccaagtaccactaggatggttgactttttattccttccataaatatatgctcataacttctacaacataatacttatcatattgcttcttaagtgatcttattttacaatgtcatgcaatacttatgacattacaccttaaggaataatcgcccaaatataggtgaaattttcttgccctgaaaaaaaaattctggctgggtgagggccacctgtaatcccagcagtttgggagactgaggcatgcagatcacttgaggacaagagttcgagaccagcctggccaacatggtgaaactcgtctctactaaaaagacaaaaattagccggccttggtggcgcgtgcctgtaatcccagctactcaggaggctgaagcataagaattgtttgaaccagggaggtggaggttgtagtgagccacaatggcaccactgcactccagcctgggtgatacagtgagacgctgtctaaaaaaaaaaaaaaaaaaaaaaaaaaaaatctgttgaatatcttctataagcattccagttttccagttcagccttgttggaagttgtttcatgctaagtaagatatcttccccaaacagtatgttattgttcaaagtaaacgtaattgagagaatgccctgtaatataagattcttcaaggatttgaatataagacaccaccttctctttggagagataattttgggaacaaaaccttaccttctatgggagatgtaggatacatcagtcaattgcagcaatcaaatagactttcaaagcgttatgatagtgctgtttttatttgacatatattatttttcagactactaaattctcaatcatatgaagtattgagtaaggttaattagcatctaggaaatgcaagaggttggaaatccatcttcagaatgcatttaaatgttttctgtcttctagatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcaggtaaggctgtcctctctggcattttgctttaatggaagaatgttgtaccttctcccaacatagtgccttcatttctagtgatcactgtttcaaaggtcacaaagaacaggtaagaaaatcacgttcatttcagaattgagggtaagagaggaaaaggaaattaacatttgagtatccactctgtgccaggcaccttttatctcatcctgtttgcagataagggtagggaatttcaaagatcgattgctactcctgtagtcattgtcttattagtaaggttcccttctcaccgggttccaaagcccagacttcagaaagggactgggaggaggggaagatttagcaggtgatggaaaaacttagttttcccttttggaagtggtcctcacctcttatctgagcctttattatcatctgccacacccaaggtggagaacttgtgctttccggccactacctcctagtaggaaagaaactccctgtccttcatcaacctctcaaaatgttctctttttcatctcaaatctcaaccacaacaacaaagtcaggggcatatctccgataagtggtaagcagctgatttggtgatacttcttcattttttacttttactttttttttttttttttttgagatggagtttcactcttgttgcccaggcaggaatgcaatggcatgatctaggctcactgcaacctctgcctcctggatccaagcagttctcctgcctcagcctcctgagtagctgggatcacgggtgcccatcaccatgtctggctacttttttgtatttttagtagagacaggtttcaccaagttggccaggctggtcttcaactcctgacctcaggtgatctgcccacctcacctcccaaagtgctgggattacaggcatgagccaccacacccggcctttttctctttttaatatgaaagttcactgcccttggccaaactgactttgagacctttttgggagggatagtgctttggaataaacccagcagccagagttcattcttagttctgataaagaatagcccagagacataggaatcacatacacacctataattagaggcatttattttattttagtgtcattatatgtgcatttgctttatttttaatttgattacatgtagttactgttgttcttttaacatgaaggaaagccctggggcagccatctgttccacagctactttgagaaaaaccgagttgagtgttacctttgtcaagggaactattacatagataattttgcctaaaaccatcaatgtgtattataaaagaaactgtatacataattttatataaaggtatgtcatgtgacaaatacgatttcttttttcttggagataaaggtcctttgaaaacatgctggagcaagttcttccagatagtatctctgctttgacttcaaacctcattcagaataaacccaaccccagggccccaagtgtgatctggtgctcagccttccactccgcccgtaccttctgcacctcagcccacctccctgggcttctgccactctggccccttgatattcttcctgcacagggcctttgtccctgctcttttctctgccaggggcattccttacataggtatctatctgctcccctttcactacaaaggcctttactcagacaacaccttattaccctgacctttcctgactcattctgtttctgaccacttctccttcctggagatcttcatatctccttaccttgctttgctttgatttttgtttgtttgtttgttgtttgtttgttttgttttgagacagagtcttgctctgtttcccaggctggagtgcagtcgcgcgatctcagctcactgcaacctccacctgctgggttcaagtgagtcccctgcctcagcctccttagtggctggaattacaagtacatgccactatgcctggctaatttttgtatttttagtagagacggggtttcaccatgttggtcaggctggtcttgaactcctgacctcatgatccgcccacctcggcctcccaaagtgttggaattacaggcgtgagccaccacacctggccccctgctttgattttctgcagagaactttcacctctgatagagcctctctttattaatttatttgtctgtctctactagaaagtaacctccttaagagaaaggactttgttttgtttacagacatgtcccctgcacctagaatggtatctggtacatagtaggcacttaggaaatacttacggaagggagagaagtggggagagcatcatttttccatctgtttaacttgttaaggacttccttggcccacctaacaattgctggctatgtaaacagcttccttataactgagataggtaatgtcccttatagttttaaaattcagatgatccttttataatatcttattttggatattctataaccttatcataatttagggatcatgatttggggtatttgccaaaagccttttgccctgtttgagagcacagtggagtctgtaccctagggtactctcactccctctgccctaccacttagggcaaaggtgaacatggccattccagtgcccctgggtgctatggggaatgggggaagagtcaagcttgctgtgtccactgctctgtctgcagtgttgctgtgtcttccattctgctgggctgtgtattctgaacatgggtgccttggctaaatgtgcccaggagtgagtgggaaatctcactgagcaattttgagtggaaattacttgtctaaaatcagcttgaccctgaagcctgagaatgatgcatgtggttaggagaaaccagaggctgagtgcatgggcttgtctccttgtagagggcttagtttgggctgatataacaaaagaccttcgaaatttattgctcagagttctggaggctgggaagtctcaaatcaaagcatcggcagattcagggtctggcaaaggctcactttctgctttataggcacagccggtgccttctagctatgtcctcgcatggcagaaggggcaagcaagctcctttgagccactttaataagggcactaatcccattcataagggtggagccctcatgacctaatgaccttctaaaggccccacctcaatactgttgaattggggattgggtttcaacatatgaatttggagggggattctaacattcagaccatagcagtaaataagcagcttgctctcgtctgtacaatgagaataaaatctctactacttgccactcgtatccgagctctctacggaaaataatcttctgtcttcctagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggtaagtggaagccgtcactcattttctgggtgagtggggctgcctgccgtgtgcaggtcattacttggactatagcctgtctcctggcattgctggtgccctctcgatgcagagtcctgctgctagggccattctccagctaagcaccagaggagcaccatggacagcactggggacacatgcgtgggagaggacagtggccagaagtgggctcacagccaggcgtggtggctcaggcctgtaatcccagcactttgggagggtgaagtgggcagatcccaagaggtcagggatttgagaccagccttgccaacatggcaaaaccccgtctctactaataatacaaaaattaaccaggtgtggtggtggcgcacagctataatcccagctactcgggagactgaggcaggagaattgcttgaacccgggaggcagaggttgcagtgagctgagatcacaccactgcactccagcctggtgagagagcaagactctgtctaaaaaaaaaaaaaaaaaaaaaaaaaattagaagtctcattactatatgatctagcaattccacttcaggttatatactcaaaagaactgaaacaggggctcaaagagatatttgtacacctatgttcatagcagcattattcacaatagccaaaagatagaagcaacccaagcgttcatcaatggatgaatggataaataaaatgtggatacgcacaatgaaatattattcagtctaagaaaggaaggaaaatttgacacatgctacaacacagatgaacctgaactcgtttatgccagaggttgcaattttttgaatttttgcaatcagaacttggtgatgaccttgagcagtaggatataaataactcccacatgcttagcgttccaataatggaacactaggcataaatgggttaaggacattatgctaagtgaagtaagccagtcacaaaaggacaaatgttgtataattctacttatatgaagtacttagaataatcagatttatagagacaaagcagaatgatggttaccaggggctggagtcaggggaattgggagttactgtttaatgggtacagagtttcaattttgcaagatgaaacagctgcacaacagtgtgaatatacttgatgccactgaactgtatgcttaaaagtggttaaaatgggctgggtgcagtgtctcatgcctataataacaacactttgggaggtcaaggtgggaggattgcttgaggcccagaattctagaccagcttgggtaacaaagcaaaaatttttaaaaattagcagagtatggtgctgcatgcctatagttccagctacttgggagactgaggcaggaagatcccttaagcctgggagttgaaggctacagtgagccaagatcacaccacagcactccagcatggctaacagagcaagaccctgtctcaaaatagcaacaacaaaaattggttgactggtgtgcagtggctcacgcctgcaatcccagcaccttgggaggctgagtcaggcacatcccttgagcccaggactttgagaccagcctgggcaacatgacaaaaccccatctctggccgggcacagtggctcatgcctgtaatcccagcactctgggaggcctacgtgggtggatcacaagctcaggagttcgagaccagcctggccaatatgatgaaaccccatctctactaaaagtacaaaaattacctgggcgtggtggtggatgcctctagtcccagctattcaggaggctgaggcaggagaatcgcttgaacccgggaggtggaggttgcagtgagcaaaattgtgtgtgcctgtagttccagttacttgagaggctgaggtaggatcacctgagcctgggtacgtcgaggctgttgtgggctgggtttgcaccactgcactccagcctgggtgacagagtgaaaccctgactcaaaaaaatcaaacaaaaaatcggttaatatggtaaattttattatgtgtatttcactacaattgtttgttttctttgttgtttttgtttttgagacagtgtctcactctgtcaccaggctggagtgcagtggtgcgatctcagctcactgcaacccctccgcctcccaggttcacatgattctcctccctcagcttcctgggtagctgggattacaggcacacaccaccatgcctggctaatttttgttgttgttgttgttgcttttttgtagagatggggtttcaccatgttgaccagactggtatcgaacccctgacctcaagtgatccatctgcctcagcctcccaaagtgctggggttacaggcgtgagccaccacacccggcctacaattgtgtttttggttttgtttttgtttttttgagacagagtctcactctgtcgcccaggctggagtgcagtggcacgatcttggctcactgaaacctccaccttccgggttcaagtgattcttctgcctcagcctcccgagtagctgggactacaggtatgaaccaccattcccagctaattttgtatttttaatagagatggagtttcaccatgctagccaagctggtcttgaactcctgacctcaggtgatcagcccatctcagcctcccaaagtgctgggattacaggtgtgagccaccacacccagccaattgttttaaaagttgatttcagttctaattttctgaaacatttagaaatttaattttatgtaaatttagagataatattaaggctaatactagattcaaatagagtgctattttaaatatacttaatagcacaattgtttaaaatgatatagggacatgcatatatacttcctacttgtaggcaccgtgagtgccttttctcataagaagtatcagtgaagatggtagggcactgaggggctgaggacgtggctcacatatgtgagtccttctgacttgggagaggtaaagcatttcaaaggatatgattcaggcccctaggagaaggtagtggagagggacagccactggtatttgaatatctagaccaggggtcatctaacgttttctgtaaagtgccagataataaatattttagcctgtccaggccgtatatggtcttaccaccatcactatataagcaaagccaggtaaggaggggcctctggacataggtgtagaatcaatttgttttgtcctgtttgtttctcaggggaccatcgggatgcctctcaacacaaccacaacaaaatagaggtaagacctttaagccgaagaatcgtttgggatgctggggatgtcagggtcccagcagggccatgcttcctttgaaggtctagggaagactctttcgttgcctcttccctgctcctggtggttgcccacagtccttggtgttccttggcttggagacttggaaacacaactctgtgtctctgcctttgttgtcacgtggtgtcccccgtgtgtctgtgtgtctctgtccacatttccccttctaataaggataccaatcattggattaggacctaccctaattgagtatgacctcattttatcttgattacatctgtaaagaccctgtttctaaataaggtcacattcataggtaccagaggttagaatttcaacatatcttttgggggaacatagtttagtccaccacaaagtaccttttgactaggcatggtggctcatgcctgtaatcccagcactttgggaggctaagtttggcagatcaattgagtcaaggagtttgagaccagagaaaccccatctctacaaaaaaatacaaaaattagccaggtatggtggtgcatgcccgtaggcccatctactcagaaggattgcttgagcccaggaggtggaggttgcagagaactgagatcaagccactgcactccagcccgggtgacagagtgagacccatatatggtcatatatgtttccaaaaaaaaaaagggggggagctttttatttaagacagttgtgagcctcttgacatttaagaatgtgctaaaatcctaaggtggtttttgcataattgaaaccttgcctttgaagaaaagttcatgtcatttgttaagtcaaaaatattttataaaatcatattttgtttttctccatttctttcagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtgagtgtttctctggcatctcaggcattagagaccaggttttttgtttccaggtaactcctgcttatggctcaaatgcatgtcaagtagtacacaaatctgtctcatattagaatgcagtgaatatttctcagcacttaccactagatggtttatggaagagcaaagtaggaaacaagcttcttgtccctgaaaatttacacttattcatagctatagctccaggtgtatttttttcactttgcaaatgaaatcttgttgaaagaaatgattggtacttgaactatgatagaagaaactaacttttcttagcacatttattactgagcattgactgagagtgaaaagtcaagctttatctgtatcagaaatggactttgaacttgactaatcttttctaccaaataatttcagatatatgctcttatttactagattctgttatagtttgggtttgaaataatatgagcctcagcctggatctctttaaggtgcctttttccatttaaaggagcataattaatgtgaatttcatgggaacaagccagaatggcttgtaggttcctttgcagaatccttcgatgcagtttgtgccagctttgtcacagcaagtttgtcctgtatcaaggaaagctagtcattttatcacaaatggacataatgataaattatatagacacacatgcactttatagaaagagcaaaaggagttcttttggtgtttctgtaataaagcgtagtctgccttcacttcattccctcacttcatccacttcactacatcttccactttttacttcagtcagtgcggcatacataagtccctctcttttctcaaccttaatgtttcatatgtagcaggtatgaaatttccagagaaggaatatgcataaaaactaaatgtgtaggccaacgcttggtggctcacacctgtaatcccagcatttggaaggtcgaggtgaatggattgcttgagctcaagagttcaagaccagcctgagcaacatggcaaaactccatctcaccaaaaaatacaaaaaattagccaggtgtgatgggacatgcctgtagtcccagctactcaggtggggatcgcttgagcccaggaggtcaaggctgcagtgagccatagtctcaccattaccctccagcttcggtgatggagtgagaccctatctcaaaaaaaaacaaaaaacacctaaatgtatagaagctgtacatgatacctttcagcaagtttcaaagaaacccattttccaaggatgaatctaatattgcaatgaagcaaggtaacagagttcagattagggtggatacatggaagggtttatcagcagatgatgtggggaaggatagaaaggggcgataccaggtcctgaatcatggaagcagaggtctaagtctatttgactcaccaagccaattttacccaggcaataagcataaagtatgatattacaaagtcacctggttctctttggttttgactcataagcacaattattgtactcttctctgggtacgtgataggattttaagggctaactggccaacttaggcaaatgtaaattcatcctgtggtccctattctatctttccccagtgggatattatgggaagagccctggactacatgctagagatgagtcagcccagtctgggtccctctctgagaaccaccttcctcggtgttgtagtaagaaggttggatgtacaaagttccttccagcagggctgggcgcggtggcttacacctgtaatcccagcactttgggaggccgaggcgggcagatcatgaggtcaggagttcaaaaccagcctggccaacatggtgaaaccccatctctactaaaaatacaaaacattagccaagcatggtggcatgtgcctataatcccagctacttgggaggctgagacaggagaatcgcttgaacctggcaggcagaggttgcagtgagccaagatcacgccactgcactacagcctgggcaacagtgcaagactccatctcaaaaaaaaaaaaaaataacacaaagtccctccagcctgacataccgcagctctttgtccactgtcagctgaggtcaagggttgtacgaatagagacatgttggcttctagtgcaggagcttagagaaagaaattgctttcggcttttaaccataaagtaccaggaaaggatcccttgaaagggaccttggggactacaccttcaagttttgttttgtgtttttgagacagtcttgctcttgtcacccaggctggagtgcaatggcatgatctcggctcactgcaacctccacctcccaggttcaagcaattctcgtgcctcagcctcctgagtagctgggactacaggggcccaccaccacgcccagctaatttttgtatttttagtagagatggggcttcaccatgttggccaggctggtctccaactcctgatttcaggtgatctgcccacctcaacctcccaaagtgctgggattacacgcgtgagccaccacaccctgccacatgcatttgttttctgctactctgtagtgaattagtgtaactcagctactgaaaacacctgttcattagcttacggttctgtagggcagaattctgagcatggcatgactgggttcaccgctcagcatctgactaaaatcaagtttgggccatgttctcatctggagctcagtgtctttttccacgttcacgtgtggttgcagcaggattcagttctctgtggttgtagaactgaagtccccatttctttattctttatcaactgggttgccctccactcctagagactgtcctcattccctgccagctggtccacttcaccttcaaagccagcggtggagaatctcccttaaattgaacctttttcatgctgctccaagtctctccccaagaagagttctgtcctaagctcatctaattcagtcaggaacacctggataatctattttaaggtcagctgattaggatcgcacatctgcaaattcccttcacagcagtacctagattagtgcttgattgagtaaatgggagaaagtgaatgtacagcactgggatgggaaccttgaggccattgcagactcccgcctgcacagaggtcatgtgagagcagaatgtggaaggcttggaagccttcacttcacctggaggttctgagttaatgatcagagagcttgtttcaggagttttgcgcatcacgggtgtgagagtctggagcaggtaggcactggagattggcacagaggctgaaggtttgcattagtatggggtctttgggaaggataacaaagccatggatgtgggagacacttggcaaatcatttaaagggggtgagaggattgaggagaaaaagacatctgagagctagggcttgtttttgtgagcgtgtgtggttttttttttgttttgttttgttttgttttgttttgtttttgagaccaagtttcactcttattgcccaggctggagtgcaatggcatgatctcggctcactgcaacctccgtctcccgggtttaatcaattctcctgcctcagcctccgagtagctgggattacaggcatgccccaccacacccagctaattttgcatttttaatagagatggggtttctccatgttggtcaggctggtcttaaactcccgacctcaagtaatcctccagccttgacctcccaaaggtgctgggattacaggtgtgagccaccacacccagtctttttttttttttttttttttttttgagactgagtctcgctcctgttgcccaggttggagtacagtgccgcaatcttggctcactgcaacctctgcctcccaggttcaggtgattctcctgcctcagcctcccgagtagctgggattacaggcgcccacaccaaaccctggctaactttttgtatttttagtagagatggagttttgccatgttggccaggcttgtcttgaactcctaacctcaggtgatccacccgcctcagcctcccaaagcactgggattacaggtgtgagccaccatgcctggccaggtagtttattgtcacttaattagagtgagccgggtgcagtgattcacgcctgtaatcccagcactttgggagtctgaggtaggcggatcacctgaggtcaggagttcaagaccagcctgaccaatattgtgaaaccccacctctactaaacatacaaaaattagctgggcgtggtggcgggcacctgtagtcccagctacttgggaggctgagacaggagaattgcttgaacccgcgaggcggaggttgctgtgagccgagattttgccactgcgctccagcctgggcgacaaagtgagactccatctcaaaaagaaattagagtgaatcagctgaggcagttgtgaaggagagaagaaaggtgcatttagctttctctgccaccattaccctgaagctagggaatcaggttgatgagaactgagaggtgggatttgtggtttgagcatctttctttgattacatcaatttcatgagccacaaattagtgtgtgaaagaaaaagaaggtctttctggttgcctctaaatgtgccataaataaagagttttcttaggaaggttgctttgtttttgtttgtttttttagtttgtttttacaccttcaatttttattttaggttcaggggatacatgtgcatgtttgttacatgggtatattgcatgatcctgaagtttggggtacaattgatcccatcatccaggtagtgaacacagaacttaatagttagtttttcttttcttttttattcttttttttttttgagacagagtcttgctctgttgcccaggctggagagcagtggcgcgatctcggctcactgcaagctctgcctcccgggttcatgcattctcctgcctcagcctcccaagtagctgggactacaggcacccgccaccatgcctggctaattttttttgtatttttagtagagacagggtttcaccatgttagccaggacgaaaggtcagcctgctgcgttggctgggaattgaagtcgggtcaattgcttggaaggcagctatgctcaccactataccatcaacaccacactcttttcttttctcttctttttttttttttttgagatagaatctcgaactatcgcctgggctggagtgcaatggtgtgatctcggttcactgcaacctctgcctcccgggtttatgcgattctcctgcctcagcctcccaagtagctgggactacaggcacccgccaccatgcctggctaattttttttgtatttttagtagagacagggtttcaccatgttagccaggacaaaaggtcagcctgctgcattggctgggaatcgaagtcgggtcaattgcttggaaggcagctatgctcaccactataccatcaacaccacactcttttcttttctcttctttttttttttttgagatagaatctcgaactatcgcctgggctggagtgcaatggtgtgatctcggttcactgcaacctctgcctcccgggtttatgcgattctcctgcctcagcctcccaagtagctgggattacaggtgcataccaccacacgtggctaattttttacatttttagtagagacggggtttcactatgttggccaggccggtctcaaactcctgaccttgtgatccacccgcctcagcctcccaaagtgctgggattacaggtgtgagccaccgtgccctgccctaatagtaagtttttcaacacttgttgccctccctccctcctttctcttgaagtccccactatctatttttgcagtctttatgtccatgagtacccaatgttaagtgagaacatgtggtaggtatgtggtcttctgttcctgagttaatttgcttaggataatggcctaatctctattgtgacaaaggacatgattttgttcctttttatggctgcatagttttttagtccaagtgtcttccagcagtcataaggttggaatttggaccaagtcactgacgttcttcccatctctgttagtctgcaattctgtgattccattatcagaaggtaatggaaaacatttttttttctttaatgataaaaatatcaaggtgtttgctctagatatgagtgtcttacttgtgggaactttaccactttttattattttgttccttttctctgctggaaatgcgtttgctgtcaatattatgccatatatcgctgtgccaacttaagttgccgaagggaaaggctttgttctcaccgctgctgatttgtctctggttaaatagtttgccctctagcatttgtatatgattgctagatggccggatttaggaagtgcgtttatagcttctagtgaatgactttctgagtgaacaaatacagagagaccctaagtgtcatctttaattattaattaggaagtgattaatattgacttaaaaagtgaatcctctgagccaattgtgaaggaaggaaggaaggtgtgtttagctctctctgccaccgttaccccagagcaccaaccattccaagtgaggctgctcatgcatctgtggccttcatcctggtcaaagtattttggaaaactaaatgctctttctgtccaaagtcatctggccacggaaatgcttttccttctattttgagacaaaataactagagtagaaaaatagaagatcttgggtaggcagagtattttttaaactttttattgaagtacaacatgtgtatacagagatatgtacgtatcataagtatataactcaatgaattttcacaaaccaatactcttgtaatgagcacccagatttttaaaaaagaacattatcaatccccctagaattccctttacattcctttccagtgattacaagaaaagtactttcctgactacgaataacacaggttagctctgtcagttttttggcttatttcagtggaatcatgtagcatatgtactcttttgtgtatctggctgtgagatttattcctcttcttattggttttttcttttttcctaaaagagactgcatcttgctctgtcagccaggctggagtgcagtggaatatcaaagctcactgtaacctcacactcctgggctcaagtgatcctcctgcctcagcctcctgaatagttgcaattataggcacgtgccactgaacctagcttattcttattgttgaaatgtagttgtgaatagaagacaattttccattatttaacttttaaacattaagatatcggatagtgatcaaactaaggttggttggtttgtttcaacttttctttctttctttttttttttttttttttttgaaatggagtctcggtctgtcaccagggtggagtgcagtggcgagatctcggctcactgcaacctccaccttctgggttcaagtgattctcctgcctcagcctcccgagtagctggaactataggcacgtgccaccatgcctggctaattttctgtgtttttagtagagacagagtttcactgtgttagccaggatggtctccatctcctgacctcatgatctacctgcctcagcctcccaaattgctgggattacaggcgtgagccactgcacccagcctgtgtggtttttttttctttttttttttaataaggagaatatagctatggtaaagaaaaaatagcctgggcaacatggtgagatcctgtctctacaaaaaatacaaacattagctgggcgtggtgatgtgcgcctatagtcccaactactcaggaagctgaggtgggaggatcacttgcgcctgaagcgatcaaggctgcagtgagctgagatggtgccactgcactccagccttggtgccagagtaagactgtctcaaaaaaacaaaaaagaaagaaagaaagaaaacatacttttttagagggaagataaactggtacaaccttcttggaaaacaaattagtattgtataccaatgagttttaaaattatcagtgttctctggctcagtattttcctaataggaatctgctcttagaaaataagccaggggcccaggggcagtggctcatgcctgtaatccgaacactttagggactgaggcaggcgaatcacttgagtccaggagtttgagaccagcctgagcaacatggtgaaaccccgtctctacaaaaaatacaaaaaattagccaggtgtggtggcgtgtaccagtaatcccagctacatgggaagatgaggtaggaggatcactgagcctggggagattgaggcttcagtgagccatgatcgtgccactgcactgcaacctgggcaacacggtgagaccctgtttcagaaaaacaagaaagaaagagaataagccaggtgaggtgacatgagcctgtagccctagcgactcattaggctgaggcagaaggatcacttgggccccggagatcaagagcagcctggacaacatagggagacctctgtctctaaaaagaaaaaagaaacagaaaaatctttacacacatacaaaagggttattaaagtgtgactttttgagagtaaaaaaatttggaaattaagtgtctgtaatgggaaaatgataacatatttacatttgttcaaatgtttataaagaatttaaaaagggatggcaatatgctcagatacagcattaaaataatcaggatgtaaatgtatattcagcttgatagaaacaatttcagatacagacattttaaaaggcactggagggaatgataaaatgtcaacacctgttgtttctcctgtggatggtgggattatgggaattttccctcattctccaccaatgtttcttttttagtttatattactgtttataagtcaagataaaacaaagaagttttaatcttggcataacccttccaagtcaatgactcgttttcctggggatgttttgggctttgcagcccatctgacccccacaggagcctcagcagaggcctcaacaatgagctctgcatttgtttttacagcttttctgggatttctctcgcttccttgttaggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattggtaagtccccctcagagtctgtctatgaatcgctcatttagatgttgcttgtgcccattgtattgagtggcatcaggataaagcagccagtgaaagagctacttggctcctgggagatttctgcagctttactgaaactggtattgttggctgggcgtggtggctcacgcctgtaatcccagcactttgggaggccgaggcgggtggatcacgaggtcaggagatcgagaccatcctggctaacacggtgaaaccccgtctctactaaaaatacaaaaaaaattagccgggcgtggtggctggcacctgtagtcccagccactcgggaggctgagacaggagaatggcgtgaacccgggaggcagagcttgcagtgagccgacatcgcgccactgcattccagcctgggcgataaagcaagactccgtctcaaaaaaaaaaaaaaaagaaactggtattgttttcttcattcttcactgtgttccctactcaaaggggtagccacagtatctctgaatcttgcaaatgctgctgacgttcttttttaatccctctcttttttttcttttcttttctttttttttttttttttgagatggagtcttgctccgtcacccaggagtgcagtggtgcgatctcaggtcactgcaacctccgcctcccaggttcaagcgagtctcctgcctcagcctcctgagtagctgggattacagctgctgacattctttaaccacgtgggctgccagatgctgaatctggggcagcaggtggaacatttctgaagcagcaggtagacatttgtagcagtcttttattttaaacaacacatgctcttttattttttgagcacctctgagtgctctcttctgtacttgatggcagggaagggaggactcagcaggaaaagatttctgagaaaagcaaagctatgcttatgaatcaaaatcatatctgcaatgcaggcacataacagaccaccaagtgaagatgaaaatcacttcctaccactgaactgctttaaattcgtaatttgaaataatctcaaacttatagaaaagttacaagaatggtttaaagagccctcatactcttccatatccaccaattgttaacataatgaaatttcatttacatatctctatatatagatctaatatatatctaattatatatatgtaatttcattatatatacctatatatatacacacatatatatgtacacacacatacatacaggttattgttttctgaaccatttgagagtaaattgcgttagaaggagcaagattacatgataaaaaaagaaaataaaaatataaaaaagagaataaattgcaggcctaatgtccctttcccctaaatactgtactatataccatagtaggtatttcctaagaacagaagcactcacttatatatacagtgcaatgttcagaaccagaaaatttaacacagtacaatattatctaatcaatagactttatcagattttaccagggaggttcattctttgtttttctggtccaggatccaatctaagatcacaggttatattaggtgatcatgactctgagtcaaggacggttcaatctctttttgatctttcatccattgatatttttaaaaagcacaggctggttattttataggctatccctccatttgcgtttgtctgatgttccctcatgattagagctaggttacacattgttggcaggaagagtccgtaagtgatgctgtgcttttctttaagtatcacatcagaaggtgtatacacacacacacatttatatttatatatatatacatatatttatatatgtatatttatatatacatgtatttatatatgtgtgtatatatgtagatatatgtatgtatatatgtgtatatacatgttatatatatatatatatatatatatatatatatatatatatatatactttttttttttttttttttgagacagagtttcactcttgctgcccaggctgaagtgcaatggtgctatctcggctcactgcaacctctacctccctggttcaagtgattctcctgcctcagccttctgagtagctgggattacaggcatgtgccaccatgcctggttaattttgtatttttagtagaaacaaggtttctccatgttggtcaggctggtctccaactgccgacctcaggtgactggcccgccttggcctcccagagtgctgggattacaggcgtgagccaccctgcctagccagaaggtatatattattggtttgtctcattaatggggatgttaactttgatcacttggttaaggtggtatctacaagccttctccactatgattgaatttttaaccaataaaaatatacaggtttaactattacaccctccttaggcacacttactgaacgctttctgtgtcccttacacagatctagactgattatcatgcttgccatctaccttgatttaaaatctggttaacagtgagggatgtattacaattattgcattaatcaaaaaacccaaaaaaaatggtcattaggagtggtgttgtggtcgaagtattaaaagcagtaagtgttgtgagttcataggtgagaaactacctgttggttggatggagaaaaagtctacaaaagaaagtaactagaacatggcatagcacatggtagggagtcagtaaatatttgttggaagaataactgaggttataaaaaacagagctgactgtgaaggaatctttttatatttatttcactattacattcaatgtagataatgacttaccagttttgttgaaggcaacacttttctagaggaactgatggttttaagctaacagtgaattatgagatagtaacatttcaaattaactttataaatgtagttttctattaaaaaatcaaacttagctgggtgtggtaactcacatctgtaatcccagcattttgggaggctgaggcaggaggattgcttgagcccaggagttcaagaccagcctgggtaacatagtgagacctccaatgtctataaaaataaaaattagccaggcatggtggcatgcacctgtagtcccagctactcgggaggctgagatgggaggattgcttgagcctggggggtcgaggctacagtgagccgatactgaactgctgcactccagcctggacaacagagcaagaccctgtctcaaaaaatatatatataaaaaatcaaactttgttgtgtttatttccttcttttactaccagtaagaaccccagaaggcaatatcaagctttactgtaaaggtgctgacactgttatttatgaacggttacatcgaatgaatcctactaagcaagaaacacaggatgccctggatgtaagtttcacttttattctttctgcaagggattctgaacttactctctgatgctgtctgttaagtttgcatgaaagctgtatgttaactgctgaccctccctttgctttgcaatagttggggtggaaagagcagtaaagtaggaatacagccacctgggtcccagttctgcccctgccactgacttcctgggatatcaccatggtgccctctcccagcatgtgggtcttcaaggtctataggactgaggcaggggaatggcttagctctcttccagtggccttgagcaagctacataaccatactaggttgtagtcttactatgtgtgtggtccccaagacctccactaacttcaagttgtagtgcaaaggaaggaaagcattcatatgtgacaggatgacagagctgactataggtcacatcttgtctagccaagatggcagaagcggttcaactgattgagtatttggtgtctcatgcctgtagtcccagcactttgggaggccaaggcgggtgtatcacctgaggtcaggagttcaagaccagcctggccaacgtggtgaaaccccgtctccactaaaaatacaaaaaaattaactgggtgtggtggtgggcacctgtaatcccagctacttgggaagctgaggcaggagaatcgcttgaaccccagagggagggggtagagtgagccgagatcgtaccattgcactccagcctgggcgacaagagcaaaacttggtcaaaataaaaaagatgtgactataaagtaatgagatgtttactggttcatgttgaaactgtttaaaatgtttaaatcaggctgggtgcagtagctcacgcctgtaatcccagtactttgggagggtgaggtggcagatcacgaggttaacagatcgagaccatcctggccaacatggtgaaaccccgtctctaccaaaaatacaaagattagccagatgcagtggcacccgcctgtaatcccagctactcaggaggctgaggcaggagaatggcgtgaaccagggaggcagaggttgcagtgaaccgagatcgcaccactgcactcaagcctgggcgatagagtgagacttcatctcaaaaaaaaaaaaaagaaaaagaaaaagaaaaaaaaagaaaatgtttgaatcgttcatcatgggaaaattgccagatactcttttccattaaaagctttgacctcagctttaacaatggcttgtgtattttagaattggtttgagggaataatgcttagtggagagttcataggtgattggacttgtatcacagtttgttggaacaagttataaagttgtcaggttcgtgcttatgtcattacaccccaaggcagctcccttggtctgatattttcctagtcatgaagagaaaaagagaaaatgagaaaatgagaaaggtaatagaagatttagaagaaaggtaagcttttccctttggaaactggaagtgcagtcctggaccctatagaagtttagaaaagcaaagtctattataaagtgatgtttaggctgggtgcagtggctcatgcctgtaatcccagcacgctgggaggctgagttgggcagatcacatgagctcgtgagttcaagaccagcatgatgaaaccccatctctacaaaaaaaagtacaaaaattaccaggcgtggtggtgcacacctgtagtcccagctacttgggaggctgaggtgagaggatggcttcagcctggaaggcagaggttgcagtgagccgggattgcatcactgcatcccagcctggatgataaagccagaccttgtctcaaaaaaaaaaaaagtgacatttaatcccctctctaaagtgtatttgtacagaatctgtcatgtttaatgatctctttttaaattctgttagtatattacttcaaagtaaaatttcagacttgatcctgaattacataaattaactattctttgcattggtggatttatttttttaaataaaacagatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattgtgagttttagccttaataactttttctttgatattctaagcagaattgaaatttttattaagttttattgaatatttgatctcatgcttaagagataattgtaacttcagcatttgacactggcacaatggaagaaggttatttcttttattcaccaaaataggagcagaacagaagttgccattatgagaaaccaaaagacaaaatacattaggagaagttctaatttaattccataatttgtatatcacttattaaaatttattataatttttaaacaataacaaacctgcatctaatacttattacattgggggaattaccgaaacaattcatattctgcaaaatcttgaaataagaaaaatatattgtttctaaaagttttccaaatttaatacatagtttttgtagggtttagataagtggaaaatattcaacaaatagctagtattgcaactggtttacggtttatgtcagtataaagccacaaatacacaagaaaagtgtatttttaacatccttgattttgtacttgcatttttgtcttggtaaattaaatagttcatcctttagggaaaaagtttttaggtgtgttggtttgcagtaattgtgaaacatggcagccttccctgttaacactggccattggccccaggagagcagcaaccaggatgtataattagcccttctttttacaggttggcaacctgtaattacagaaaacttttggtttgtttgctaattccttttttttttttttttaatatacattctagctcctgggagctacagctattgaagacaagctacaggatggagttccagaaaccatttcaaaacttgcaaaagctgacattaagatctgggtgcttactggagacaaaaagggtaattcattgtgcagggaagcatatctgttaattcacaaatatttatagctgccgtttcctttgcccaagatgacctcctcagacttttcatcctgtacaaacactgtttctttggacggaagatgctttttctgagaaaccctcctctgtttttccagcacattcttctgcatcctttcctgatccccctcagtagcagtttcttccttataatttagctcctggccatgtcttgctgattataattggtcttatctctccagccagacgtgggttcccgtcctgaaagggccatccctcttgtccctctgtccttccagtgctttgacatttggtgggcacagagtagaacaatacaaagtactgaacaataactttggttttcttgccaattttattgcttggcaataaaattgtatacctaaggaaagaacgattttaattttttaactttagaactcaacaagcacttgtttggtattgatactttactttgtaagccttccacaagaaatcaaataatgtctcttgcgctgaaatcgtcaacgggttacacactctgcaaagttatgggaagcacagccctgaccttaaataaatgccaaattgggtggtaatttaaaaggaaaaaaaatcttcacgtaagggttggtggaaattattatgcttccctctgcccccgccccccgccaataacagagtaattgaaccaggaactgagagtgtttagtaatttaatgaacattggtttactaaataaccagtttatatgtttgataatatagcacattttattattgaaaacatttcaaattagactttgactttcacttgttttattatggagaaaaggatttttcttctgcatgtgattcctacagattgctatagaaaaatagtgtgtttgtgtgaatctggttatgttcatgaactaaaaaatatcattactaggtaaaatcaattattcagttcaacagtaagaatgagcctggcaaacatgacaaaaccccatctctagaaaaaacacaaattgtttggtggcttggcagcgagttgcgtagtcccagctacttgggggctgcgggtggtgctgagatgggcagatcacttgaatcctggaggttgaggctgtagtgagcagagattgtgccactgcactccagcctaggcagtgggagtgagatgctgtctcaaaaaacaaaataaaataaaataaaaacagcaggaatgacatttgacttaattttattctattgtagaaactgctgaaaatataggatttgcttgtgaacttctgactgaagacaccaccatctgctatggggaggatattaagtgagtaaaagcctgcagtatgaaattacgtaatagctcatctttgcaaatgcaagactgtctgtagaagatagcagatatgaagaaataggggttacgatgtgtcacttggggcagtttcctcatgtttaaatgaggcaagacaacaacaggcagttccaagtaatcaaggtgcagcctaaatttgagcagattttacttttagggaaacttggggcccttcagaggccatttttctccattccttctcagctcaggccaggcgcagtggctcatgcctgtaatcccagccctttgggaggccgaggcgggtggatcacctgaagtcaggagttctagagcagcctggccaacatggtgaaaccccgtctctactaaaactacaaaaattagctgggtgtggtgcccggtgcctgttatctcagctactcgggaggctgaggcaggagaatcacttgaacccaggaggcagaggttgcagtgagccaagatcacgccactgtactccagcctaggtgacaagagtgaaactctgtctcattaaaaaaaaaaaaaaaactcggttcacctactaaaaattccgtaaaaagcctgtaatatcgctagcaaattaatatgaattatagtcctattttgctttttctaggaacttttacttttgaaagggaaatagaagaaaggaaaaaaaaaacccaaaacttttgcgggaaggaaatgtgtgggtgggttacatcatgtaggtcccctgtaatctagtctaggtggggcaggcctgataattcaaatgttagcatatgctgaaacgtttgttagctttgaatcagagtcgcagcagacctggaaatgtatgatgaaaaagccctgtcttgttctgaagctataaatatgctgcacacagttactgtgatgtgtttactgatggcctgacagttcctcaagatttttccctacagagcttctctcaggccagcatgaggtcagattaaactgttaacatacacatttgccaggtgtgataaagtgatgagggaattgatggtcaatattagtcttatttctaatgatggtgataaagcattttctagttgttctagtatattaggtattccgtcaaattagacaaaatcagtagccttatgatctaaatcagttccatttagaactgatttagtttatgtgcccaaatagaggtacataagccatgcccctttgtgcttttaggttttaaaaaagtagcaacaggctgggcacggtggctcatgcttgtaataccagcacattgggaggccgaggcgggtggatcacgaggtcaggattttgagaacagcctgactgatatgatgaaaccccgtctctactaaaaatacaaaaattagccaggcatggtggcatgtgcctggaatcccagctactcgggagactgaggcaggagaattgcttgaacctgggaggcagaggttgcagtgagccaagatagtgccactacactcctgcctgggtgacagagcaagactccgtctcaaaaaaaaaaagtagcaacagacaaataaatgcttaatgcttaatgagtttactttagtagttttgggcttcaagtaatctgattaattactatatggctttgtttattttttgtagatggggctgtaaaaaaatttctggtctctcttttgaaagtcttaaaaattggtcccgaagctaaagtaaaagataaaatgtatgcaagtagcaaatgttgtgaccatgcccttagctgagtttacctttatagagagaggaatcatcttcccaggtggctcttaaattgatgattcctataaaatgatttgaatagaaggtatcttcattttttttctcttacggcctttcaatgatttgtcttagtcactcacttttaacttgaaaatgagaattaaattgatgtggaaaagggatactagatacttaatcctctagtgcagtgattctccgtggggagtgagtttgccttccagggaccctttggcactgtccagagacacttgcttgtttcagctgcagagaagtgctcctggcttctagtgggtagaggccagggatgttgctaaacatcctccagtgcaagggatggccacacaaaataaaggattattaggcccaagacatcaagagtgcaaaggctgagaagccttctttggaaggagaagaacaatggctttttgtatgtaatagtaagagtcctgagccagaagttacaagataactgagtcctcattctagttttcctatcaacctgcagcaggcaaatcacatcaccttcctctggcttgatttccttatttgtaacatgaagagattggacaagatatttaaggtcccttccactccaaaatttcatgactcatttttctatcacatgaaagtgttacacgtagccttgtcacatatatcattttaacacaaacatttaatttgttgatataaagcactgagaatttctcaaacacagatatagttttgtttatatgaaaataagtttattcctaacaaacaatagccagtattctaattcagatcaagattgcctttccttttttttttttttttttttcttagaaagactctgtcacccaggctggagtgcagtggtgcaatcttggctcattgcaacctccgcctcctgggttcaagtgatcctcatgcctcagcctcccaagtaactgggattacaggcaccgccaccacgcctgggtaatttttgtatttttagtagagacagagtttcactatgttggccagtctggctgcgaactcctgacctcgactgatctgcccgtctcagcctcccaaagtgctgggattacaggtgtgagccacagtgcctggcctaagattgcctttcttctgttgctgtgtatacattttcaactgtatcttcctttgactgtctttgaaaaatgatgaattacatggtacccccatggtggatgaatcgagacatagtaaaattacatgtcgctcagttaaaaaaaaaaaaaaaaaagggctggccaggcgtggtggctcatgcctgtaatcccagcactgtggggggctgaggcgggtggatcatgaagtcaagagattgagaccatcctggccaacatggtgaaaccctgtctctactaaaaatacaaaaattagctgggcatggtggtgcccgtctgtagtcccagctacttgggaggctgaggtggaagaatagcttgaacctaggaggtggatgttgcagtgagctgagataacaccactgcactccagcctggtgacagagcgagactctgcctcaaaaaaaaaaaaaaaaaaaaaaaatgggcaaagcactttgagtagacatttttccaaagaggacatgcaaatggctgataaacatgtgaaaggaggctcatcatcactaatcattaggggaagataaatcaaaaccaaagcaagataacacctcacaccctttaggatggctactatcaaaaacaaaacacaatagaaaataacaatcattgttgaaggaacctttgtgtgttgttgatgaaatatataaaatggtgcagccactatgcaaaacagtatggtgatgtttcaaaaaatttcaaaaaggattaccatatgatgcaacaatcccacttctgggtatatccacaaaataattgaaagcaggatctcaaagagatacatgcacacccatgttcacagcaacactgttcacagcagccaagagatggacgcaacccaggtgcccatcagtgagtgaatggataaacagaatgtggtgcttccacataatggaatatattcaactttaaaaaggaaggaaattatgacatatattatatagatgaaccttgaagacattaagctaagtgaaataaaccagtcacagaaagacaaatactgtttgatttcacatatatgaggtatctagagtgctcaaattcattcaaacagaaagttaactggaagttaccagggactggagggcgagtgaggtgaggtgttattgtttaataggtatagagtttccgttttgcaagatgaaaaagttctagagattggttggataacaatgtgactatagttaacactactaagttgtacacttaaaaatggtcaaagcccgggatatggcaaaaccctattgctacaaaaaatacaaaaattagccaggcgtgatagcgtgtgcctatagtcccagcaactcaggaggctgaggcaggagaatcacttgaggctgggaggtcaaggctgcagtgatccatgatcatgccactgctctccagcctgggtgacagagtgagaccctctctcaaaaaaattataatgaaaataaaataaagaaacaaaaataggtaagatggtaaactttgtttttttgtcacaattttttttaagtcaaagttatctcagagtcaagggcctatttagggtcttacactttaaacactgaaatttggtttcccctagttctcttcttcatgcaaggatggaaaaccagaggaatagaggtggcgtctacgcaaagtttgcacctcctgtgcaggaatctttttttccacccggtggaaaccgtgccttaatcatcactggttcttggttggtacgtatcattagtgtatctgtgcctttaactcaaaagaaagaagttcatttggagccacttttagatgctttcacatgttaactgccaacctaaaagtctcttagcctatacatgaaagtgtggtttttccaagtttgagacttaataatatatgatatatgaaaggatgtataccaaagaggtaaaagtggttatcttggtttactaattaatgggttttttcattttcttctttatagattgttagattttctaaatttttgttgcatatatattttataagctggatgtggtggcatgcgcctgtagtcccagctcctctggaggttgaagcaggagggtggtttgagcttaggtgttcgaggctgcagcatgcaatgatcacacttgtgaatgaatagccactgcacttcaacccaggctatacagcaagaccccatctccattgaaaaatatatatatagctgagcacagtggctcacgcctgtgctcccagcactttgggaggccaaggcgggcagatcacaaggtcaggagatggagaccatcctggccaatatggtgaaaccccgtctctactaaaatacaaaaaaaataattagccaggcgtggtggtgcacacctgtagtcccggctactcgggaggctgaggcagggaaattgcttgaacctggaaggcagaggttacagtgagccgagatcgtgccactgcattccagcctggcaacagagtgagactccatctcaaaaaaaaaaaaaaaaaaaatatatatatatatatatgtgtgtgtgtgtgtgtgtgtatatacatacacacatacatatatgtgtgcgtgtgtatatacatacacacgcacacatatatatacatgttttggttataaaatcaaatttatttgtcaaatataatcagtgacataatccaaaaattatccttcacataatttaaatcttgggaatggtactcctggggtaaaactaaagtgaatgtaaccttttccctctctgatttcacagaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggccaatgacgtgaacatgatcaaaagtgagtcatgcacccacggccagtgaggcccaacgtgctagagaggagaaatggctggaatgtgtagggggtggattttctttttttagattttacagcttaggttttcatagagcagatgtttcataaagtcacttaaccatgacaacgcctgtgaccctacccccagaaagcccacagcccatcaggaggaaagagtatcactgacagggcttctgaaggatgcgaagaggaaaataaggtctatggggggaaatttatccttatatttttattcttttatatagatgttgtgtatttttttctctcttactggttctcttcccatattttgggtttattaaaagccctgatattggctgggcacagtggctcacgcctataatcccagcattttgggaagccgaggcaggtggatcacaaggtcaggagttcgagaccagcctgatcaagatgctgaaaccccgtctctattaaaaatacaaaaattagccaggtgtggtggtgcacacctgtaatcccagctactcgggaggctgaggcaggaaaatcacttgaacccaggaggcggaggttacagtgagctgagatcgtgccactgcactccagcctggacgacagagtgagactccatctcaaaaaaacaaaacaaaacaaaaaaccctgatatttaataagttttgtaagacataaattattgaactctggctggtgcttgctttgacaatatcattctccttcatctaagcatttctttctgggactttcttcctacctttggtaaatctgtgggaacttcatcattgggtcacctggtgtgagtttagagtaacatgtttagcactgaagaaaagcttccacgtgctctcatcatcctcctcacctccctagaaggctgcctttttctggatgctagaatttaagtccacacaattaaaatattgagtcctgccatgcagaaatacagttgtgctggtattaaagcctgcagaagcacacccacagccctcatctctatgtctgaattctgttcctttttcctccctctgtcactataagggagtatcttgtattaaaaatactcaaactaatgacctggatattcatcctcatcctattgccaaaatccggtgtcaccttgggcttatgctcaggtttcagttttctcatcggaaaagaaaataatccctaatgtcacctccagctctgtcgtattattatcactgagctgaagtattacctgactgtacataggtaattgcatgttcctgtgatgctgggttgcttaaatgcattatatataactagacttttcagtctattttgtgactcatgagtctgtctctttcttttcttagtctcctcctcctccttgatgtatactaagaatattccaactttatcttcctcaacaggagtcagctgtatgacgtatgtcatcttgccttctttatcagtgcgtatgtctgtggtcactagcagtttaattcatccacactgtttttttttttttttttgcatgtgcttgccctaccatgcgaatggtattgcttgctcggagttagatctatctctttcctccatagccagccagctctagtttattttccattacgtacctttaacgtaactagccgtgccaaaaggacaagtcaaacatgatttttattcagttataaagtagccttctagataatgggaggggacgggtttgctttggagatttatcaactgattatgtgacttagacttgaaacattttgttcctctgagttcaccaatacataatgagagggattgcacaaagtcaatgtagataatcttagaggggcttgtttttcttaagttgtcttaaaatttttattaagcactgttatatgccaggtgcatttaaaaaaaaaacaaggtctccctctgtggcccaggctggggtgcagtggcatgaccttggcttactgcaacctccacctcctggcctcaaacaatcctcccacctcagcctcccaagtagctgggactacaggcatgagccaccatgcccagctaatttttgtattttttgtagagttgggaatttgccatgttgctcaggctggtcttgaactcctgggctcaatcagtctgcctgcctcagtctcccaaagtgctaggattacaggcatgagccacctcacctggccccaggtacttttatatataagttatagagcatccctttgggataaaaatataggaaactttaggggtctccttagaagttatacaagtagtattagtgcctttatgtactttgtaaaagctgtcatttcttccaaccacatcaataacaatatacagaaagtttagccaagtatggggcacacaccggtagtcccagctacgtgggaggctgagacggaaggattacttgagcctgagaagttgagactacagtgagccatgtttgtgccactgcactccaccctgggtgacagagcaagaccctttctccaacaacaaaaaagaacacacacacacacacacacacacacacacacacacacacaaagaaattgttggtcataaagtagtcgagtgaaattattcaagtgtcaaaaaataatctgagcatttgctaacattcacgtttagcagtgtagtctggaagaagtgaaggaatcatgacccaccatgtttctgcccctagcaaggatccaaggactatcataggctgccttctccctctatcctacctgaagatatctcataccagctgggtggatgttgtctcttcttggtcttagaccctgagaatgtacgtgaagcaggagagagataaaggcaaggtggggcatggtggctcatgcctgtaatcccagcactttgggaggccaaggcaggcagatcacctgaggttgggagttcgagaccagcctggccaacatgatgaaaccccatctccactaaaagtacaaaaattagccgggcatgggggtggcgggcacctgtaatcccagccactcgggagcctgaggcaggagagtcactggaacccaggaggcagaggttgcattgagccaagatcgcaccactgcactccagcctgggcgacagaaaaagactccatctcaaaaaaaaaaaggcaagagggattattgctgtagcgaggaaatattctttttgttaaggaatgataaaagaatgtctaccagtgaggcacctaacaccgcatttgagatttcaggaaactctaaatgcctgtacttaaattttacaaaaaagaccaatgttaccttatagtgtatctgttcagtgcttttggttgccctgggaactatgacagtgttcatttcacatttgtccttggtctgctcagcgggaaggttgaggactggataccagggcctggggcagggcttcctcttcctcagccacataagccaagagaatctcagcattttcctcagtggcttgttcaggaaagaaaaggccatggtttggcaggaaagagcaagtttggcaaccatgctggtcataggaaatatttgtgtgttttcaaagagaacataaatattatatgagatgcagtttgttctgtttttttagaagtgttactgaaaacgtaggtttggatacatcactacagttatgttttgaatttgccagaccttgtgttctgtaactagggcaggatttttgaagcttctttttagttggaacgccgcagcattgcagccacttttcagggtctgagcaatgataggttgtgttctccaacatatcttttctaaatgatcttgtctatcttcacattcgttacttttaagacccagacaaaactaatcattctctaatttgaaagtgttatttatgactattggaagcataaataaaattgtgactttaattttatatattctggaaaccttcccccgtaaagaaaaaaaaaatgtcttaaggtcccagagggccatgaataagactttgaaagtttaatagtttcttggttaaaactcttttgattacaagtattggagaacaaccaaagctagcttaagaaaaaattaaatttgaggagtgggagacgaggggagggaacctagaggatgggtcaataggtgcagcaaaccaccatggcacacgtatacccatgtaacaaacctgcacgttctgcacaggtatcctgtaacttaaaagaaaaaaaagaaaaaagtaaatttatttaaacacctcctgttgtccaagaagaagccaggcctcaggaagatactggaacaaggacatagatttgcaccaggaaccccgtgtctgtctgtctctctccccttctctctccctttcctccttcttcccctccttctctctctcccctccctcccttctctccccactcttctctccccactcttctctccccccattctctccctccattctctccctcctccccacccctctctccccactactttatttctctgccccttagaaatcttcaggaagaaatatatctatttcggccaggcacagttgttcatgtgtgtaatcctagcactttgggaggccaaggcaggtggatcacctgagttcaggagttcaaggcctgcctggacaacatggtgaaaccccgtctctacaaaaattagctgggtgtggtggcgcacatctgtaatcccagctactcgagaggctgaggcaagagtatcgcttgaacccaggaggcagaggttgcagtgagccaagactgcgccattgcactgcagcctgggtgacagagtgagacttcatctcaaaaaaaaaaaaaaaagagagagaaagaaatataactatttcttacctcaagaatttagaccttaaaattctagacacaaaataactgacttctaattccagaatatcaagagagagactggctcagcttgggttttctgtcagtcagggtttagcacaggaaacagaccccagttggtatttaagcaagaaaagattcatacaggggactaggtactttcaaaagctctggatggtctacagaagcagggtctaggctgggtcacttaccagaagagcttctactcttctggtaagtgataagaggttcctctaaagagcttccaaattaagaagcctttatagttgcctgtcaacatccaggtagctggaaagtagatatgagctctgctgcagaaatcccaaaagaggaagcgatgctgggctctgattcacttctgcttccaagtcataagtggatctaaacagtggaacctaattcacaaagagcctagctgcaagggagtctgggaaatgtagggtttttatttcctttcccacctctctaattagaacaaggatggaatgaagttgggggagccgatttgtagtatctaccacaaattacatatctgcccatgactgacacagctgttgccaaagaggcaaggacacagtgtacacatgggtgcctggggctcaccctgtggatggaagggatggctgtgatcttggcagataatccaaatggaattcgtcacccacatgagatcctttcccagatatttatggaggccctactgtgtgctctgtttagcaacttgtaactcagactttgagttgagttcaagagctgggggtgagggatggtgagcaagagcttctgtattattgttccatcaatgtctgtctttgttttttgtttgctatggaaccatttttatcaactgatgttttgcctcacaatcggtttatgatccacagtgttttctccctctgccccatagctgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcaggtaatgtaatgttgttattattgttatttactaagtagagctcttaaatgaataaaaatctagttctgaaaagacaatttatttcttctatatttgtagttttggggctgtgtctccttacagttggggcataattaagaatgatcatgacttctctaaatgtttctggtgctgtaaaaacattttaccttagaaaggaggggatttggccaggcatggtggctcacgcctgtaatcccagcactttgggaggctgaggcaggtggatcgcctgaagtcgggagtttgagatcagtctggccgacatggtgaaacctggtctctactaaaaatacaaaaattttccgggtgtggtggcaggcacctgtaatcccagctactcgggaggctgaggcaggagaatcgcttgaacctgggaggcagaggttgtggtgagccgagactgcgctattgcactccaacctgggcaagactttgtctcaaaaaaaaaaaaaaaaaggaggggatttgcttgtatgtttttatctttatctttggttattttttcatgttgacattaagagtagcgataacagggctgggtgcagtggctcacgcctataatcccagcactttgggaggccgaggtgggcgggtcacctgaggtcaagagttggagaccaacctggccaacatggtgaaaccccgtctcaacaaaatacacaaaaattagccagacatggtggcgtgtgcctgtaatcccagctacttgggaggctgaggcagaagaatcacttgaacctgggaggcagaaggtacagtgagccaagatcacgccactgtactccagcctgggcgacagagtgagactctgtctcagaagaaaaaaaaaaagaatattgataacaggccaggtgcatagagttttgcctataatcccaacactttgggaggctgagatggggagatcgcttaaggccaggagttcgaggccagcctaggcaacatagcaagacccccatctctattaaaacaaacaaacaaacaaaatgttaaataaaggaagcagatgagtatgtgctaactaggctggcatgtgtctttgttggtgacatggagcctctgtcatcccctcacagactgcatacgaggattggttcatcaccctctacaacgtgctgtacaccagcctgcccgtgctcctcatggggctgctcgaccaggtaggagcctcgcacaagcagggacacttctggacagatgagaatgcgttagagaagtcccaagcaaacgtttcaatgcattcttctggtgtttacttctttctgatcaaaccctattataattctgttgtcaggcatcaagggtcatggctgtgcttcttgttttgtaataaggaaagaggatttctctgtagtcccagctactcgggaggctgatgcaggagtatgacttgagcccaggtgttcaagtctagcctgggcaataaagtgagaccccatctctaagacaaaaaaaaaaaaaaaaaaaaagagaaaagaggatttctgtgactgggttgaattcattggcacacatatttgttatgttccttttagacagtaagagcttactatgaagatacctgaaggcagggcatggtggatcatgcctgtaatcccagcactttaggaggctgaggcaggcaaattgcttcaggtcaggagtttgagaccagccctggcaacatagggagaccccatctctacagaaaaatttaaaaattgtgggcatggtagtgcacacctgtgaagtcccagctacttggcaggatgaggtgggaggatcgcttgagcctggaaggttgaagctgcagtgagttgtgtttgtgccactgcactccgggctgggcaacaaagtgagaccctgtctccaaaaaaaaaaaaaaaaaaagaaaagaaaaggaaaaaaaggcacccgagagtccaatatgtctccacaataataatttactcattttaaagtcagtttaaatcctttccaaaatttatgtagctagtgcatatttttatctaataccaattcttaaaaagaaagaagcactataaagactaaaaagtaataatttataattaactcatcaacttgtatgagaaaattttttcccaaaggatttgcaacaatatatattcactcaggaggtaaaaacagtagcctccctacatatttttggacattactaatttgttttctttccataagtagcaaagtaataaacttatacctagcccttctctgaattaaatattaagtaatggtggtctaagcaatgaggttgagctctgcacaccacaaatattgcaggattgatcgattatcttgttcagtttttgccttcctaaaatttaacagcaggctgcaactttttgtgagatattaattataacatatctctgactgctttgacctgatgaataaaataccatcattttgttttctccttaaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccaggtacgtggctttcattggccgtattcagtgtctattggtacctacttatatttctgtatatagggtggcatgcacatccacctgactcccactgcacctgtgccacttacaaaatataaatgctattttcatctcttataccaagcacattttctatttcttgcctgagtcaaggatggtttagtttctggtccagtattcaagccacatcatgcctaacttgctgaattctgttttcaggattgttagatcctttatttcttgctaactccccaaaatgagtgctctgtttttctctggtttcccaacagattggcttggatacttcttattggacttttgtgaatgctttttcaatttttggaagcattgcactttattttggcatcatgtttgactttcatagtgctggaatacatgttctctttccatctgcatttcaatttacaggttggtatttccaaattccaaaaataaatgtacagacaaatgtcattagtttagattttgacataacttctgttaagtaataaaatatacaaggtggaatggctgggcacagtggctcacacctgtaatcccagcattttgggaggccgaggcaagtggattgcttgagcccagcagttcaagaccagcctggacaacatggctaaaccccatctctacaaaaaatacaaaaaaattagccaggcatggtggcacatgcctgtagttctagctactggagaggctgaagtgggaggattgcttgacctgggacgttgaggctacagtgagtcgtgatggcactgctgtactctagcccaggtgacagagcgggaccctgtctcaaaaaaaaaacaaaaaaaacaaagcacaacaaaacaaatatatacaaattattattgctagtgaaaattaatgtcttgtctggaaattaaatggtgatggtgggttgaaagggcataacatgatgggaggaagacaaattaaaatagctttacaatagcgctgtacgtgtgttgaattagataacttaagacttaaaaggctggataaaagcctattctttctttcccataaaacctaatactggggctagatgtggtagctcacgcctgtaatcccagcactttgggaggccaatatgggtggatcacttgagctcaggagtttgagaccagcctgggcaacatggtgaaaccccatctctacaaaaaatacaaaaattagccaagcgtggtggcgcacacctgtagtcccagctattcaggaggctaaggtaggaggacacctgagcccaggaggttgaggctgcagtgagccatgatcacgccactgcactccaacgtgggtaacagagtgagaccctatctcaaaaaaaagtcagaagtcttgatcacctaactttgcatttttaatcaatgcaatgtcaacaaatgtgctttttttccttatttgctcacttatgtaaatttgccttgtttcaaataatttaccttcccaattttgctttgcttagtctgattttaaaatgtctgttctttgagccataatggatattttggggaggccaatccagttgtaaaactttaccataaatgatctatttatagattatgaaatattaactatgttcttttttttattttattttttatttttgagacagagttttgctttatcacccaggctggagtgcggtggcacaatttcggctcactgcaacttccgccttccgggttcaagcaattctgctgtctcctgagtagctgggactacaggtgcacaccaccatgcccggctgattttttgtattttagtagagacggggtttcaccatgttgcccaggctggtctcgaactcctgagctctggcaatccacccaccttggcctctcaaagtgttaggattacaggcatgagccaccacacctggcgaaatattaactatgttcttaggaaaaaagaaccacagtgatgcatttgccatgttctttacaggcacagcttcaaacgctctgagacagccatacatttggttaactatcatcctggctgttgctgtgtgcttactacccgtcgttgccattcgattcctgtcaatgaccatctggccatcagaaagtgataaggtataaagaatatagtcctttcccaactctgtccctcacagaaaccaaagcgtttcccaacagcacgtttcctgcaaaattctaagctcatgggaagtttggtaagaatgatttttcatgattgcttctctttaactctatctcacaaataagtcttttggaattgggagtttagtgtgcttgctttttaatacaaaaattaccaaacataaacaaaaaagggagaacagaatgagccccatatatctatctcctcagtttaacaattacagtattaacattttgtcatacaaatcagattgggttttttttctttatttaagaaaaatgtcaccttctgtagcaggatcctttgagctacaaggaacagaaagctgtgactcaaaacatctctacagtagtgcgtcatcattaatcattagtaggcttcaggcccagttgattgagcaatttaatgttgtcaagaaaggattgggctggttcttgccatctcttctctcagaaaccttcattattagcttcatatggatgctggaagatggccagagcagttctgggtatcacttcctgacctatcagtgtcggggggagataagagcctattctgtagctccttaggggccgtggaacttctcacccaagggccccagtacagtgccctcaggtctcacgtgccaaaattaggtcacttgcccattctggactagtttagcaagggaaatcaacctgcccaccgcccatgagaaatgtggctgtgaggggttggggggggcaatctgaatacaatcaatttccattagaaagaaggagagagtagaggctactgaggcaaccttcagtatccctcgggtctcccttttgcagtgccaacagtatgcagtaacaacccaggaaagaggccctactgaattttctctttgactgtacccatctggtctgaactagaaaagggcactagcttcagaggagtgggaatcttggctttgcattttctagctgtgtgaccttggaaaagttaaataaccttcccttggcttcaatatatatctccaggtaggtaggtaggtagatcgattgatcaatcaatctatgtatagatatagagagatggatatagatttatatcatcatatatatatgtcgatatagatagatagatagatagatagatagatatagccaagcactgtggttcatgcctgtaatcccagaacttttggaggccgaggcaggcagatcacttgaggtcaggaccagcctggccaacatggtgaaattctgtctccactaaaaatacaaaaattagacgggtgtggcagtgcgtgcctgtaaccccagttactcaggaggctgaggcaggaggatcgcttgaacctgggaggcagaggttgcagtgagccaagatcgtgccattgcactcaagtctgggtgacagagcgagactgtctcaaaaacaaaaaaaaagatatagacacacatacacacacacacacacacacacacacacacacacaagtggggacagaactgcctgcatcaaaatggggcaggtgtcaggggagttcatcagtgttcatttctgtcaaccgtctggccaggcctcctccctggtgtggatcttattttcatccctccccatctctcccccttgcagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagtatgatcttctaaagtatttaaa

SEQ ID NO: 18 - DNA, 87591 bp, Homo sapiens
  source 1..87591: mol_type = genomic DNA
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgagtgagtcctgaggggcctaagtgagtcccgcccctggcgtccgcgacctatcactgcgtgcccggcttgcggcgtccgaggcctccctgccaatccgcacggtgcctggaggggccggagcaagggtgttcaccttgaaaacctgtagcgtttctcgtggaggcgggtataaccagcagaagcacctgtgtgctttttcatactgtttaacccttgggatttagacggatctggctcgtctctagccagctcaacacttaacataagcttttgggcaacttattaaatctctgtgggtcattttaataataattcttccttcacaagtgtatcgttagaccatagatagcaaaatgataggcgctcagtaaaaaccatgtgcttattctcgtgccccatgaaagagtgatggtaggttctttctcctttgtggaagcaggaaaactgaacttgggcatactccactaacatgaaatgggggatgtgcgcgtgcaggaacttgtggaacttctgcccgcagaatgcctggtcgagctctttagggccttagcatgcctcgccttgatgggtagcaaaggcacgtgtcggaagcaggtggcctttctgggagtgcgcaggctactctcgatgtttggctggactgagcagttgaaacactgccacccaccgcctgggttttgaggcgagaatccagctggccttcagagataagctgggcggcccattttggagaggtgatccctgacttgaaaccaggcttgcccagtgtgtccgtgactggtgggtgagtctggaccgttgtgctgaacgaattaaccaacgggaaggtgcagaagtgaaactcttacagatgaagagtattcaggcacaactcacaaccatgagggaggcactgggggagggatggggtcttaaagtgaggagatttgaacagctctatatttgtctaatattgattcagatgtcataaattcgcatttgacaagggtccaaaggtaacagttccttttgacacttgagagtgaaatgtaaatttagtgatggtttgtggtgctaggagtgctttctctcccctggggctacttctaacctactctgttagggctgagggagatgttagatcatcctctggaaaggcctgtcagtgctcctgtacactctttctgttggggcctattgctcaattcttccctggaacatcgcctagccctttcccaggtagatcctactaggtttagatgaagcctccagaagctgtttttcttttgccaaagttaacttaggaggctgatttaatatgaaccccctcctgcacccctttttatttttatgttttgatacggagttttgctcttgttgcccaggctggagtgccatggtgcgatcttggctcattgcaacctctgcctcccaggttcaagctattctcctgcctcagcctcccaagtagctgggattacaggtgcccacgaccatgcctggcaactttttttttgtatttttagcagagacagggtttcaccatgttggccaggccggtcttgtacgcctgacctcaagtgattcacccaccttggcgtcccaaagtgttgggattatgggtgtgagccactgcacccggccctgcaccccttttaaaacaatttttgaccatttccgtagattttcccagaagaggaattagtgggtcaaagggtgtaagtttatttattttttttgagacagagttcactctgttgcccaggctagagtgcagcagctcactgcaacttctgcttcccagcttcaagcaattctcctgcctcagcctccagagtacctggggttacaggtatgtgtcaccacatctggctaatttttgtatttttagtagagatggagtttcaccatgttggccaggctggtcttgaactcctgacctcaggtgatccacccgcgtctgcctcccaaagtgctgggatgacagaatttttttttttttttccttgagacagggtcttactctgtcacccaggctggagggcagtggtgtaatcatggctcactgcatccttgaccttctgggctccagtgatccttccacttcagcctcctacccagctaatttttttttttttttttttttggtagagacagggtctcgctttgttgcccaggctggtctcaactcctgggctcaagcagtcctcccaccttggccttccaaagtgctgggattacaggtgtgagccgcagtgcctggtcagtataaatatattttaaaaatctgtatatatgttgccaaattggtttcctgaaaacttactctactttacatgacagtgtataggattgcctgttttttgttttgtttttttttttttaaatgcaacctcaccagctttggctactttcctaaggggaaaataatagccaatttgaggtattttttgtttgtttttgtttttttcggggagggggggataggacagtaggctagggtatttgcctcgggttgagagcttgggagtccaagcaatggaggtttttttttttttttttttttttttaagatagagtcttgctctgtcacccaggctggagtgcagtggcgcggtcttggctcactgcaagctccgcctcccgggttcatgccgttctcctgcctcagcctcctgagtagctgggactacgggtgcccaccaccacacctggctataattttggagttttagtatagacggggtttcaccatgttagccaggatggtctcgatctcctgacctcgtgatccgtctgcctcggcctcccaaagtgttgggattacaggcgtgagccactgcacatggcctctttttttttcttaagacagggtctcaccttgttgctcaggctggagtgcggtggagtgatcgtggctcactacaacctctgcttcccaggttcaagtgattctcctgcgttagcctcttgagtagctgggatttaaggcacgtgccaccacacctggctaatttttgtatttttagtagagacggggtttcaccatgttgagcaggctggtctctaacttttgacctcaggtgatcctcccatctcggcctcccaaagtgctgggatgacagaatttttttttttttttttttttcttgagacagggtcttactctgtcacccaggctggagggcagtggtgtaatcatggcttagtgcatcctcgacctctgggctccagtgatcctcccacttcagcctcctaccctgctagttattttattttattttattttttggtagagacagagtctcgctttgttgcccaggctggtctcaactcctgggctcaagcagtcctcccaccttggccttccaaagtgctgggattacaggtgtgagctgcagtgcctggtcagtataaatatattttaaaaatctgtatatatgttgccaagttggtttcctaaaaacttattctactttacgtgacagtgtataggattgcctgatttttgtttgttattttaaacacaacctcaccagctttggctactttcctaagggggaaataatagccaatttgaggtatgtggttttttttgttgttgttggggaaggggacggtaggctagggtatttgcttggggctgagagcttgggagcccaagcaatggcggcttttttttgtttgtttttgttttttgagacagtgtctcaccctgtcacccaggctggagtacagtggtgcgatcttggctcactgcaacccctgccccctgggttcaagcgattctcttgcctcagcctcccgagtagctgggactacaggtgggtgctaccaagcccagctaattttttttgtatttttagtagagatagggtttcgccgtgttagccaggatggtctcgatctcctgacctcatgatccgcctgccttggcctcccaaagtgctgggattacaggtgtgagccactgcggctagcttttttttttttttttttttttttttttttaaaagacaggttctcgctttgttgctcaggctggagcacggtggagtgatcacagctcaccacaacctccgcttcccaggttcaagtgattctcctgcctcagcctcttgagtagctgggattacaggcacgtgccaccactcccagctaatttttgtatttttcagtagagaccaggttttgccatgttgtccagctggtctcaaactcctgggctcaagcgatgctcgtctcagcctcccaaagtgctgggattacaggtgtgagccactgtgcccagccgaggctcctggtagattgagagctctgacctcatctcctcaaagaagcttttttttttttttgggacggagtttcactttgttgcccaggctggagtgcaatggtgcacaatctcggctcactgcaagctctgcctcctgggttcaagcgattcttctgcctcagcctcctgagtagctgggaagacaggcgcatgccaccacacccggcttattttgtatctttaatagagatggggtttctccatgttggtcaggctggtctcgatctcctgaccttgtgatccacccgcctctgcctctcaaagtgctgggattacaggcgtgaaccaccgtgcccggcccaaagaagcatttttaaactcttctcaagtgagctctttagcattttgtgtcccactccccttctactcagccactccctgctgtggggtcatctctgtgtcacagtgtcactgtcaggtgtggggtccctaaacaggggataggatagtaggagaaggagaagcccacagaggaggcaggagaagaaccaggaagtagcgtgtccttgaggtgggagctgggagcagtagggaccctcgtgaggtgaggtgtgcttctgtaggtctccctagaaaaaacctgtgtcagatccttcactaagcctgctttagtttccaccacctgcttctgcattctttttatggctccttaggtctccagtaagtatttgtggaactaattaattgtgttccagggtcaggttctccttatccccacttctctctaccttttcctcgtcctatttccttattcatcttccacagttgggtggcttctggcgcacactgtctgtcctgatttccatgtcatctaaagtctactaataacacctatctgccttgggcaggttggatagaatgaaagtacttgcattgagatcaacgggcaaatctgcccttcaagccctcccatgaacagcccttgctttgcttactaaattgtctgtgatgacatcactgagtgatctttgttccattgtagggaaagctaacagccagggagaggatcagtctcttgctggaccctggcagctttgttgagagcgacatgtttgtggaacacagatgtgcagattttggaatggctgctgataagaataaggtatttgttcaaatggtggtgtgaacactttttaggtgtggctcagctggcctacccactagaataataataaatctataaggcttttatctgaagtcctctgcagaggcactgcagacatcaagcccagataatttttgtatttttagtagagatgggctttcgccatgttggtcaggctggccttgaactcctggcttcaagcaatccacccacctcggactcccaaagtgttgggactacaggcgtgagcgaccgtaccctgccttgtgtttctttatacgtcctccttcatgtaagcatagagaagtggtggccctgggtcttgattgttttgcttttaggagggtacataaggcctaagatgacagtgccattcactcctattgatgaagtagtagccctgtgcttgctgttgtagagctgggaaagtggggtgggattccttcatgttccttgttcatattgacgttttaggaatttgggttttgtttttgtctttcattgaggcatagtggccaaactcattagaagaagtatttggattttttaacctttatttttgcatttttctggtagtttcctggagacagcgtggtcactggacgaggccgaatcaatggaagattggtttatgtcttcagtcaggtatttcataactccaatagtctgaacttttcttggagggcagagccaagaggaaaatatgtgaaagaagccaatcttggggaatgaaaacttgcttgtagtttggggaaaatgagggatttgctttgcttttcagtgcgtgtttccagaatattgtgtgttttttacttaggaagagtccttagtctgttttgggggggatcacagggcactagccttgtacaaaggtatcccaagaaccaggaatttattccaagtgaatgagattcctcttagctgggttgggtgtgtgcctgtagggcatctgtgtcctgggcagtgtatgtggactagagagagtgcagtgggtgcagcctcgcaaaggggacttgactctcagaaccagagtccccctgagctttgggctttcatgaatatgttcagaaaattttatcagggtgcatcaagacagatacagtttgttcacacacatagccaaagctatcaatatgttattttacacgcaaaagggaatgaaggttgttaatcagctggccttgcaatagggagagtagcctgatttatccaggtgggcccaatataatcacagggtccttaaaagtggaagagggaggtagaagaggagcttataaggatgtgatatgagaaggacatgatctgcagtacctggctttgaagatgggagaaggggaccatcagcaaaggagtgcccatggtctctaggagctggtaaaggcaagaaaacacattttcccctggagcctccagaagggagcacagtcctgccaaccttaattttagcccagtcaatcctgtgtagcgcttctaaattatagaactataagataatacatttgtgttgtttcaaggcactgaatttatattaatttgttatagcggtaatagaaaactaacacagaatatgttgtgtactattttggatttgacttttttctctccagaggtggaaatatgtatataatttaaaatgcttaggtctttttacagacctaaagtttgatattaaaattggctaggcgtggtggctcatgcctgtagtcccagtactttgggaggctgagatgggtggatcacctgaggtcaggagtttgagaccagctggccaacatggcgaaactccatctctactaaaaacacaaaaattagctgggtgttgtgggtgcctgtaatcccagctacttgggaggctgaggcaggagaatcgcttgaacctgggaggcggaggttgcagtgagccgagtttgcgccactgcactcgagcctgggtggcagagtgagactccatctcaaacaaaaaaataataaaatagttatacttggttaatttaaaatctgtcgtagttagtatgcatttaccaattaaattacctttgaaatgttttaaaactgttataaattggtctaccaaatgccgaaatagaaggaatcacatttgttttgtgcaatttatgagagctgagaaaaacttgtacagaaggaaccattgaaaagagagatagaacaaagatgttttctggacatgatgttcactcaccactattaagcagatggaagaattcactgaattgatacttttgaccacctcttatgctcatgtggtagggtgggagtgaggagaaggtggagatgactgagacaagagttcccaccctgaagaagcgaatcattttataggcagaatggcacagaacggatgtaactacagagcacatggagtgagaggttccaggcaaatgctgtagacccaagacaagggaaaatcacatccagggttgaggaaagctttaggaacaatggggcaattgagacaggccctgaaggatactgagggtagggagtgatgagctagtgttttttaatagtgatctccaagatgttaatatcttaggtgctttttctggggagcttctgttcttctggggagcctcctcagtcccttgcctgataattggctgttggtgtattctgagggggagagaaaaaaaggggccagcactcattcagtgtataggctcctaatcttgcatgttttcagcctcaccttttcctcttttaggctagcgattgtgagtttagaacccttctggttaatttcctttagagaacaaacattctctgtcctctcaaggtgaaggagaggccctgtggggtctgactgcttctaacagagacttctgttagtctctgttttcagcctccttctcacctccactttccatggttcctgggttgtcttctccttgattacccccactgcaggtgtgtaagcttccattctctccctctaaatcaggtattttcttgtgctttcagttccccccaaatttgtttaatccttcctatgctattgtctccttgttcttattctcacagctgattctgttcttaattcctaactgtctttttgagggggttttaggagaggttatgcccacaataagccctttacatctgaacataatgaagatccataagcagaagaagcagtgagagctctgattcttgttttttaacctttctttttaaaacagcaaataataggctgggcacagtggctcccgcttgtcatctcagcactttgggaggccgaggtgggtagatcacttgaggccaggagtttgaaactggcctagccaacatggcaaaactgtctctaataaaaatacaaaaattagctgggcctggtggcacgtgcctgtaatcccagctactcgggaggctgaggcaggagaatcacttgaacctgggaggcggaggatacagtgagccaagattacgccactgcactccagcctgggtgacagagcaagacttggtctcaaaatgataagtaaaataaaacagtaaatatttcttaaaaacagaagtgcttgactgtttgatatccatagaatctgatattagagttaattctgtgtgataggttttccttcagaactgcaaatcatttcttttttttcctttcaaatcatttttgtagagcaaagactagctcttttgctcttgacaattcatgaacttcctttaagatattttattctatggaataatctataaatcagacttcttttctaattttttaaacttctgaaaatgctttaaaaactatatgtatgtatttttttaaatacagagtctcgctctgtcgcccaggctggagtgcactggagcaatctctgcccactgcagcctccgcctcttggattcaagtgattctcctgcctcagcctcccgagtagctgggattacaggcacacaccaccacgcccagctaatttttatattttagtagagatggggtttcaccatgttggccagggtggtctggaactcttgacctcaagtgatcctcctgccttggcctctcaaagtcttgggattacaggtgcgagccaccatgcccgggcaactttttttgttttgttttgttttgttttgttttgttttgagacagggtcttgctctgttgcataggctggaatacagtggtgctgtctcaactcactgaagcctctgtctccagggctcaagcaatcctcctgcctcagcctcccgagtagctgggattccaggcatgtgccaccatgcgcagctaacttttttctatattttttgcagatacgggcttctgccatgtcgcccaggctggtctcagactcctggactcaagccatccacctgccttggcctcccaaagtgttgggattacaggcatgagccaccacgcctggcctaaaaacttttatctgtgaattttctatttcttcctcccactgggttttcatctctagccagtcactatatttgacttgctgatttgtattttctttttaggattttacagtttttggaggcagtctgtcaggagcacatgcccaaaagatctgcaaagtaagtgtttaatactcaaattcaatccattgctttcctcagttacatagtgcttattgagtatctttggggtacaagacactgagctaggtacttggggtagggcagaggtatgcaagatgtgctaccaacccgaaggggtgcataacaattttcgtaccatggatctcttccatgggctggcaaagcctgaaccctcctgtttttacatgcctaaaataaaatttgtaggattttaaaggattaaaaatgtttttaaaaaccacatttagaatatacgtgctcccttgttaatgcatttaataacaagatttagcagtagatctagtaactaccgtaatttcaaagtagtcaaaggtgaaatatttcagggtatctgcaacaactttaataggacgtaaaaatatctgtggcttctaataatggcaaatcacagatatttctaatactgaggctcattgcctatatcaataatgaagagaaatgttaacgatcagctagcgttagtaaagataaagatgtaaattttttcctgttcaagttcatggactcccgttcacagatctcttggggttctgaggatttcaagtgaagaacctcttgtctaggtggaagggccaggtgctagaaggtaaagaacagtgcgagcattgtatgctgatatttaaaaactactgctagagattagatgctctggagaggaataaaactataaataatagagaattttggaattaaagttggagctactagtaactggaacatctggattatagacatggtcctgtcatgtattactcctgagaccttgggccagtcacttaacttttaaaccttaatttttctcattttactccctctgttatgatgggtaaatgaggtaatggaagtgaaagtactttttaaactgtcaaggactgtaggaatattgcttattatgctgtcggaattactaacccatgaggaaaatctgtcacattagaagtaaaagcaggcccgggcctgccctcagattaacagatgggtcaacatctgctttcatgaaagtactactttgccattctgtctactgtaagttctgtcaaagcagtacctgggaacaaaactggctgctggaagacgttacaacgtgagcctgtggttctagaaatggttgccatgagttgttttatcccctgctaatgggaagtgctttggctcttgggtgtttgggggctttaatcagcctattaaatatctggtcctttgtcttccatgaaggtacccaatcgtgatggggagtgaaaccagtgttactgcctcctgttttgaaaagtgcactcagaacgttttccagaaaacactgtggtattttgtgaatgtcgttttttatatcaagaacatttgtctcaataaaagatttctctgctgtctcagatcatggaccaggccataacggtgggggctccagtgattgggctgaatgactctgggggagcacggatccaagaaggagtggagtctttggctggctatgcagacatctttctggtgagaaacctgttaatagagaataaaaaaatacagggcttaagttctctaagccatggcctggccagagcttctccaactctcctcattgttctctgccgcattgtgtctgttctgtgggtcctttctgtgtcactgggggtgggatgaagggtagatgaaaagcaagagagagtgggaagagagggttttcattttttctaacagagggccactcacaggggaaattacagttaaagatcgttcataagggaaaagcacttgaaaatgtttttctttttttgaaagcaagggagaggaaatatgaaaagttaaaatgaactgatgtgcttgaattagaagttttaaaaaatgtagcaccttttttattttttagttaaaacactacaggattattaaataaagtccaagccacagtgcaaagaagaatgaaatcaccccagatcctaccattcagaaacatttggcgaacctcattactgatatctctttgcttatttacagactgaaattatgagagaaagaaatgaaaagaaacataaaataatgtgttatgtgaagtataaagtatatttgtgagagatacagtaagaggctgggatgagggagagagatactgcagacagaaactggcaacatttccagggagaagaaaggaaggagacaggcagacattgtttttaatcaggccagccactcttatcatccctgctctgcaggcttacttctgtggatggcttggcctaagcagtttaggcctggaagtcattcctgtttagaaacaaaagagcggccctcagagacgtggtgataaaccaccacattttagagcttgactggattttagaatatcatctagttgaatacatctttatgggtctggaggaggttttttttttttttttttgagacagagtctggctctgtctcccaggttggagtgcagtggcccgatctcggctcacttcaacctctgcctcctgggctcaagtgattctcctgcctcagcctcccgagtggctgggactataggcgtctgccaccacgcccagctaatttttgtatttttagtagagacggggtttcaccatattagccaggttggtctcgaactcctgaccttgtgatccgcccacctcggcctcctaaagtgctgggattacaggtgtgagccaccgcgcccagctggtttttttttttttttttaatatttatttatttagagacagtgtcttggttggccaggctggaatgcagtggcatgatctctgctcactgcaacctcagcctcctgggctcaagcgatcatcccacctcagtctcctgaatagctggcaccacaggcatgcaccaccacatccggtgaatttttttttgtattttttttatagaggcggggttttgccatgctgcgcaggcttatcttgaacttctggactcaagcgattggcctgcgtttgcctcccaaagtgctgggattacaggagtgagtcaccacgcctggcttttaatttttgttttcaagggctagtctttactttcagatcttcattgcttaattaattgcttactaatgctgcttgtcatattgatacctccactcacttattcctgcctgtgttattttttggtaactttttattttgataaaatttcaaacttcagcctgggcacggtggctcacacctgcagtctcagcactttgggaggccaaggcaggtagatctcttgacgtcaggagttcaagaccagcctggccaacatggtgaaatcctgtctctattaaaaatacaaaaattagctgggcatggtggcacatgcctgtaatcccaactactcaggaggctgaggtgggacaactgcttgaacctgggagacagaggttacagtgagccaagattgtgccattgcactccaacctgggtgacagagcaagactctgtctcaaaaaaaaaaaaaaaattcaaacttcacagaaaaatgacaagaatagtatgggaactcctatatgtccttttcccagattcaccagttgtttacattttctccatttgttctgttattctctctccatatatacatatttgcatgttacatttttctgaaatatttgagaataaattggagatactatgtcttctttacctcctaagttcttcattgggtatttctaaagaataaagatattctcttaaataaccagaatacagtaataaaaatcaggaaatttaacatcgattcatcgatgttattctaattcattatccttattcaggacttaagtcctttatagtgtgtgctctgggcatgtgtgcactttctatgtgcgcgctctcgctctttctgtctctgtctctcatatatatgtgtgtgtgtatatatgtatatatatatatgttcctcctggccaggatccaatccagaataaagcattgactttagatgttatctctttttaatcttttttgatctggagcagttcctgtctttgttctccatgatcttgatattttaaaaaatagctttggccaggtgtggtggctcacacctatgatcccagcactttgggaggccgaggcaggtggatcacgaggtcaggagatcaagaccgtcctggctaacacggtgaaaccccatctctactaaaaaaaaacaaaaaattagccaggtgtggtggcgggcgcctgtagtcccagctacttgggaggctgaggcaggagaacggcatgaacccgggaggcagagcttgcagtcagccaagattgcgccaccgcgctctagcctgggcgacagagcaagactccgtctcaaaaaaaaaaaaaaaaaaaaagagcttaatgcttaatagggccgggcacggtggctcatgcctgtgatcccagcactttgggaggccgaggtgggtggatcactaggtcaggagttcaagaccagcctggccaagatggtgaaaccctgtctctactaaaaatacaaaaattaggcgggcgtgatggcgagcgcctgtaatcccagctactcgggaggctgaggcagggaattgctcgaacctgagaggtggaggttgcagtgaactgagatcatgccactgcactccagcctgggtgacagagcgagactccatctcaaaaaagaaaagtagctttattgagatataatttacaaaccataaaatccacccattgtgaaaatataattcagtaattttaaattaatttttagagttgtacagccataatctagttttcaaacctgccactcactccaaaaataccttcttgcctgtttgcagtcagttcccacctaaccacagtcaattcctcacccaactttcttattttacaaatttttccatctgactcctttcactaagcaccatgttttttgaggttcatttatattgtaatatgtatcagtttgttcctttttattggtgaataatatctattgaatattttatgtattttcatcatttaccagttgaaggatatttggattgtttctggttcctggctatcatgagtaaatgctactgtgaacatttgtgtattactttgtgtggatatatgttttcataacccttggatagataggtacctaagagtgggattgtaggttttatgataagcttgtttataactttttaagaaattgccagatggttttccaaaacaactaaaccatttacattaccatgagcaatgtgttcagggttgcaggttctccatatctttgttgatacttggtattgtcagtctttttttgtttttttttttttgagacagagtcttgccctgtcgcccaggctggagtgcagtggtgcgatctcggctcactgcaagctccacctcctgggttcacgccattctcctgcctgagcctcccgagtagctgggactacaggcacctgccatcacgcccggctaattttttgtatttttagtagagactgggtttcaccatgttagctaggatggtctcgatctcctgacctcgtgatctgcccacctcagcctcccaaagtgctgggattacaggtgtgagccaccaccatgcccagccttggtttttttttttttttgagatggagtctcactctgtggcccaggctggagtgctatggtgcagtctgggctcactgtaacctctgcctcccaggttcaagtgattgccctgcctctgcctcccgagcagctgggattacaggcatgtgccaccatggctggctaattttggtatttttagtggagacagggtttcaccatgttggccaggctggtcttgaactcctgacttcaaacgatccatctgccttggcctcccaaagtgctgggattacaggcgtgagccaccgcacccagccagtctttttttgagacagggtctcactctgttgttcaggctggagtacagtggcatgatcacagctcactgcagcctcgacctcctggggtcaagcgatcctcctgcctcaacctcccaaagtgttggaattacaggcgtgagccactgtgcctggtccagtctttttgactatagccattttagtggtgtgtaatggtatctcactgtagttctagtttgcatttctcagatgactaatcatgttgagcatctttatgtacatattagtcatttgtaaaccttctttgctgaaatgtctattcagatcttttgtccatctcgtaattgggtttttgagttgtaagagttcttcatatattctggatacaagtcctttatcatatatatgatttgtaagtattttctcccagtctgtggcttgtcttttctttcttagtggtagctttatttttatttttattttttattttttgagacagcctcaccctgtcctccaggctggagttcagtggtgtgatcttagctcactgcaacctccacttcctgggttcaagtgattctcgtgcctcagtcacccaagtagctgggattacaggtgcatgccaccacgtccagctaatttctttgtatttttagtagagatagggtttcaccatgttgcccaggctggtcttgaactcctgagctcaggtgatctgcctcccttggcctctaaaagtgctggggttacaggcgtgagccagcacactcagcctatttttattttattttttagagacagggtcttgctctgttgcctgggctagagtgcgttagtgcaatcacagctcactgcagccttgaactctgggctcaagcaatcctcctgccttagcctacggagtagctaggactataggcacacactagtacacccagctaatttttgaaaaatttcttttgtgtgtagagatggggtcttactacattgcccagcctggtcttgaactcctggtctcaagcgatctgcctcggcatcccgaagtgcagggattacaagccactgccccaagcctgtggtggctttttttttgagctagggtctcactctgtcacccaggctgaagtgtagtggtgtaatcatggctcactgcagcctggacttcccggggtcaggcagtcctcctgcctcatcctcctgagtagctgagaccacaggcacatgctaccacatctggcaattttttttcattatttgtagaggtgagggtcccactatgttgcccaggctgttctcaaacttctggacttaaactgtcctcctacctcggcttcctagagtgctggtgttactggcatgagccgatgtgcccagcctctggtggcttttgaggtggagaagtttttaattttgaagtccagtttatcaagttttcttttgtgggtcatgcttctattgtcatatgtaaaaacttgtaatacaaagtcatgaagattttgttttcttcatggagttttttttgtaggtttggctctttttttttttttttttttgagatggagtttcactcttgtcgcccaggatggagtgcaatggcgctatctcagggattatgggtgcctgccaccaaacctggctagtgtgtgtgtgtgtgcgtgtgtgtgtgtgtgtgtgtagatatatatatatatatatatatatatatatatatgtatatatatatatatatatctacatacacaagtacatataagagagcccagccagctttcttatagtaggtctgtgatccattttgagttaatttttgtatatggtgtgacagaagagtctaacatcactcttgtctcccaccattaattgacataactattctttccccattgaattgtcttgacacattgataaaaatatcagttgatcataaatgtaagggtttgtttctgaactctcagttcttccattgttctatgtctgtccttaaaatagaaccacactgtcttgattactgtagtttataggagttttgaagttgtgtaaaatcctccaacttggtttttttttttttttttagatgtagtctcgctttgtagcccaggctggagcacagtggcatgatctcagctcactgcaacctccacctcctgggttcaagcgattctcctgcctcagcctcccgagtagctgggattacagtcacgtgccagcacacctagctaatttttgtatttttagtggagatagggtttcaccatgttagtcaggctggtcttgaacacctgatctcaggtgatccacccgcctcggcctctgaaaatgctgggattacaagcgtgagccaccgcacccagcccgatcagctcttaactctacaaaaatgcctgctgagatttgataggaactgcattgagtctgtagatgaatttggtgagaatttacatcctaacatattgagtcttccactccacgtagatggaatgtttctctgtttatgtagctctatactttgtctcagcaatattttgtaatttgcagcatacctgtcttgcacttcttttgttaaacttatacctaaaatatttcactctggccaggtgcagtggctcacgcctgtaatcctagcacttggggaggccaaggcagggggatcacctgaggtcacaagttcgagactagcctggctaacatagtgaaaccctgtctctactaaaaatacaaaaattagccaggtgttgtggtgcatgcctgtaatcccagctactcagaaggctgaggcaggagaatcgcttgaatccaggaggcggaggttgcagactccagcctgggtgacagagcaagactccgtctcaaaacaaaacaaaatattttactctttgtgatgctatttagaatggaattatcttgttaatttcctatttggattctttgcaaatgtatagagatacaattgattttcatatgttgatcttgtatactgctttgctgaggttgtgtattagcttgaatagggggtgtgtgtgtatgtgtgtatttctttggattttctatatacacaatcatgtcttctgcaaatagaggcagttttacttattcctttctaatctggatgccttttatttctttttcttgctaattgctctgcttagaacctgtagtacagtgttaagtagaagtggtaagagtggacatccttggccgggtgcggtggctcacgcctgtgatcccagcactttgggaggccgaggtgggcatatcacgaggtcaggagatagagaccatcctggctaacacggtgaaaccctgtctttactaaaaatacaaaaaaattagccgggtgtggtggcgggtgcctgtagtcccagctactcgggaggctgaggcaggagaatgccgtgaacccgggaggcggagcctgtagtgagccgagatcgtgctactgcactccagcctgggtgacagagtgagactctgtctcaaaaaaaaaaaaaaaaaaaaaataagagtggacatccttgtcttgttcctaatcttaaggagaaagcattcattcttcaccattaagcatgatgttaactggtgtgtgttttttttttttttttggacattctcttgaaggttgaggaagttcctttctacttctaattttttgagtgtttttatcatgaagggtatttaatattgtcaaatgcttttttctgcatctgtgagataatcatgtgttttttgttctttattctaatgatatggtatgtaacattactggtttttagaatgttaaaccaaccttgtatttctgtgataaatcctacttggtcatggtatatcatccttttttggaaggtgctgggctctgccagtatttccttgagtacttttgaatcaatattagtaagaaacattgacctacagttaccttgtgattttttcttttggttttggtattacagtaattctcacctcatagaatgagttggaagggttgcctctgtgaggtaggttccctatgcactggttatgaacttttctgatttcagtaagacagaacactcacacaagttacatgaagtgcccggccacatctgttgttttttgacatttttttttttcccgctgtaggcagagtcttgctctgtttctcaggctggagtacaatggcgcgatctcggctcactgcagtctccaccttgtgggttaaagcagttctcctgtctcagcctcccgagtagctgggactacaggcacacgccactacacccatctaatttttgtatttgtagtagagacagggtttcaccatattggtcaggctggtctcaaactcctggcctcaggtgatccacctgccttggcctcccaaattactgggattacaggcatgagcccctgcgcccggctgttttttgactttttaattatggccgtttttgtaggagtaaggtggtatctcattgtggttttcatttgcattttcctgatagtgatgtgagcattttgtttcatgtttgttggccatttgtatatcttcttttgagaaatgtctattcatgtcctttgcctactttttgatgggattattttttcttgctgatttgagttccttgtagattctgcatactggtcctttgtcaggtgcatagtttgcaaatattttctccagctctgtgagttggctctttgctgattacttcttttgctgtgcagaagctttttagtttaattaggtcccatttatttttgtttttgttgcattagcttttggggtcttagtcatggattttttgcctgggccagtgttcagaagagtttttccaatgttgcagaatttttatggtttcaggtcttagatttaagtcttggaagtctggtaatgtgatgccttcagatttgttctttttgcttagtattgctttggctatctggactcttttttggttccatataaattttaggattgtattttctagttctgtgaaaaatgatgatggtaatggtagtgttttgatgggaattgcattgaatctgtagattgctttgggccatatgatcgttttcacaatattgattcttacctccatgagcatgagatgtgttttcatttgtttgtgtcatgtatagtttctttcagcagcgttttgtagtttcacttgtagagatcttcacctccttggttaggtatattcctaggtattttattttattttttgcagctgttgtaaaaggaattgagttcttgatttgattgtcactttggttattgttggtgtatagcagagctatttatttgtctatattaattttgtaacctaagactttactgaattcctttatcagatctaggagtcttttggatgagtcgctagagttttccaagtatatatgatcatatcactgataaacagtacttgtttgacttcctcttttccaatttggatgccctttatttctttctcttgcccaattgctctggataggacttccagtactatgttgaatagaagtggtgaaagtgggcatccttgtcttgttccagttttcagggggaatgctttcaacttttccccattcattacgatgttggctgtgggtttatcatatattgcttttactattttgaagtatatccctcctatgcctagtttgagagttttttgtcataaagagatgctggattttattgcatgctttttctgcatgcaattgagatgatcatatggtttttgttttaaattctgtttacgggatttatcacatttattgacttgcatatgttaaaccatccctgcatctctgggatgaaactcacttgatcatgttgtattatctttttgatgtgctgtgggatttggttagctagtattttgttgaggatttttgcatccatgtttatcagagacactggtctgtagttttctttttttaatgtcatttcctggctttggtattagggtgatactggcttcatagaatgatttaggaaggattccctctttctcaatcttttggaatagtttcagtaggattggtaccaattctttgaatatctagtggaattcaactgtgatccatctggtcctgggcttttttgttgttggcagtttaaaattactgattcagtctcactgcttgtttttggtctgttcagggtttctgtttcttcctgatttagaggattgtatgtttccacgagtttatccatttcctctagatttttcagtttgtgtgtgtaaagatgttcatgttagtcttgagtgatcttttgtatttctatgatattggttataatatttccagtttcatttttcattgagcttatttggatctattctcttcttggttagtctaatggtcgaccaattttgtttattttttcaaggaaccaagtttttgttttattttttgcttcaatttcctttagttctgctctgatctttgttatttcttctgctggcattgggtttagttcgtacctgtttctctggttcattgaggtgagacagtagattgtcagtttgtgttctttcagactttttgatgtatgtacttaaaactatgaactttcctcttagcactacttttgctgtatccccagaggtttttataactgtgtcactactatcattcatttcaaatttttaaatttttatcttgatttattgttaacccagaaattattcaggagcagattatttaatttccatgtatttgtatagttttgagcatttcttttggagttgtttctagttttgttccactgtagtctgagaagatacttgatatgatttcaattttcttaaatttgttgagacttgttttgtggcctgtcatacagtctatcttggagaatgttccatgtgttgaggagaagaatgtatattctgcagttgtttggtagaatgttctgtaaatatctgttaagtccatttgttctagggtatactttaagtccattgcttctttgttgagtttctgtctcaacaaaaagagtctagtgctgtcagtggagtatcgaggtcccccatttcactttgttgctatttcatttcctaggtctagtagtaattgttttataaatctgggagctccagtattaggtgaatatgaattcaggattataatatctttttgttggattgttccttttattatataatgaccttctttttctttctttttttttttcttttttcttttttttttttttttttttttactgttgttgctttaaaggtctattttgtctgatataagaatagctactttgcgaggccaagacgggcggatcgcgaggtcaggagatcgagaccatcctggctaacacggtgaaaccctgtctctactgaaaatacaaaaaattagccgggcgtggtggcgggtgcctgtagtcccagctacttgtgaggctgaggcaggagaatggcgtgaacccaggaggcggagtttgcagtgagccgaggttgcaccactgcactccagtctgggtgacagagggagactctgtctcaaaaaaaaaaaaaaaaaaaaaaaaagaatagctcattctgcttgcttttggttcccatttgcatgggatatctctttccccccctttaccttgaggttatatgaatccttatgtgttagatgactctcttgaagacagcagatatttggtttgtgattttttaaaaatccattctgccattctgtatctaagtggatcatttaggccatttacgttcaacattaatattgagatgtgagatactgatctgtttatcattttagttgttacttactttgtttttttttcattgtgttattgttttataggccttgtgggttttatctttcaagaggttttattttggtgcatattgagcttttgtttcaagatgtagaactcttctgaagagtaatgctggtttggtagtggcagattccctcggcatttgtttatctgaaaatggctttatctctccttcatttaggaaacttagttttgctggatgcaaaattcttgggtggcagttattctgtttaaggaggctaaagatagaaccccaatcccttctagcttgtaaggtttctgctgagaaatctgctgttagtctgattggttttcctttataggttacctgatgcttttgtctcatagctcttaggattctttccttcatgttgactttagatagcccgatgactatgtgccttggtgataatctttttgcaatgaatttcccaggagttctttgagcttcttgcatttggatattgaaatctcaggcaaggccagggaagttttcctcaatgattctctcaaataagttttctaaacttttagccttctcttctccctcaggaccaccaagtatttttaggtttggttgttttacataatcccatatttcttggaagctttgttcatttcttctttctttttttttttttctttcttgagatagggtcttactctgttgcccaggctgtagtacagtgttgtgacctttgtctcctgggctcaggcaatcctcacacctctgcctcctgagtatctgggactacaggcacatgccaccactcccggctaatttttatgttttttttgtagagatggaaatttgctatgttgctcaggctggtctcaaagtctgggctcaagcagtccacctgccttgccctcccaaagtgctaggattataggcatgagacactgaccccagcctatttatttcttttgattcttttttctttatttttgtctgattgggttaatttgaaagccttgtcttggagctctgaaattcattctttgacttgttctggtctattgttgaaactttccattgcattttgtatttccctaagtgtgtttcatttccggaaattctgattgttttttctttatgatatctatgtagaaaatttttccttcatattctgaattgttttttaagttttttttttatgttggttttcacctttctatggtgtctccttgagtagcttaataatcaacctactgaattatttatctgattatttcaaatatttcgttttagtttggatccattgctggggagctagtgtgatctttcgggggtatgatagaaccctgttttgtcttataccaaaattacttttctggttctttctcgtttgtgtagagtatttcttctaattgttcttgaatttatttttgatttggctgtggtttttttaagtttctttttcctcttcactaaggatgtgactttagtgtttatagtttattatagcctaatgtgattcttaatgcttttagggggaagactgtatgagttccttggctatagagagtctttgtatgatggcttctttagatgctggttgtatttatttatttatttatttatttttgttgagatggcgtctcgctctgtcactcaggctggagtgcagtggcacaatcttggctcactgcaacctccacttcccgggttcaagtgattctcctgcctcagcttcccgagtagctgggactacaggtgtgcaccactacgcctggctaatttttgtatttttagtagagacggggtttcaggatgttggccaggctggtcacaaactcctgacctcaggtgatccacctgccttggcctcccaaagtgttgggattacaggcgtgagccactgcccctggcctgtatttaatagatatgtacttgatgtgtgggcaagttcactgtctcctatggggttgagatggaaaggtctcttgaagctcatctcattcccctgtggtgtgtgcttttttatttatttaatttttcccctgtattttatttactaagttgatggttaaggcttcaggccagtaggggagctgtccctgggtaggaaccagttgtggctaaagcaaatgggtaaatgcaatactcagtaaggcagagaggttccacccttgatgaaagtggctgggggaactctcaattagatgcactgaggtcttatcaaggggaagggtgggagccacctcagctcctttgccaggccagtaggaaagctattcacctcccagactcgctcctgccctagtgttccagctattcggatcagacaggcatctcttttcatctgtaggactgttgttgttccacacagagaggaatttgtgactctgcctctcttgcaagcctgaacttgggccagggcgggggtgggggttgggggattcctcctgtggagatgcagtcactctgtagtgttccaggaaggctgtctataggttcacctttgccaagctcctgtggagaagccccaactgtgtctgtgtagtggtggacaaggtgggagagaagataccttctccaggacccttcatgagcagcaaagctgcctgattgttggggtagagctgcagactttcccttctgagcccagcactgcaattgtgtctctgctgaaaggaacttcccatcagtggaaagatctggaactcaaggcctgccatctgaattcttttgtcccatggggtattcccttggtgtggtggtctcctccttcccttaggagtaagaattcctgagagccaggataagttgattgctattcttctgggtctagccacccagtggggctgcccaactccaggctggtgctggggaatgtctgcaagggatccggtaatgggacctgtcctcaagtctcccagcaagggatataccaacactagtgctgatgggagtgtcaggtgagtgaggtagactctttgaggttccttggttacagaaagccttagtgtgctggctttctcgaatgctggttataatagtagtgaactggtcacgtggacagatgcaggacctcctggttagccagggttttgcaggcaatgatgatagcttaggtcatgcactggttttctcctttctgttcacagtgttattctacctagagatgctgtagtggactgtgttggttggcatccagcctggaggtagcgtttacaaaagggcaccagctgcagtagtagcagtgggattcgagcttgtcctgtgttgcccaggaggtattctggtttctcaggtgacaacggggtccataaagctgccaaaagtttctgtcctttgtattaagtaaccagggtgggtggaggggtacagccaggtgggggctgggtcaggtgggtctacactctgtctctccatgtgtggggaaagccgtggctcctatgagggttgggggggcggttctcaggtcattagggtaatgttccagagaggaatataactgcctctactgcacagaagagatcgcacagtgtgtggggagtaacaggtggcactaagcctcacccagatcccacacggtcggaaaggcagatctcactccctctgtgctctgctagctgcactgggctaagttccaggcagcctaggctcagaactcaaacctgccccaggccataagctttccctgtgggaaagcagctgtggctttcaggccatgctcctcccaggccacctgcagggccaggcacctggctcctgcacttgtggctgcagtgcacttccccctgcccctgggaggtatgggttctggacaaaggagttcatcctcactcagtgttatatcttgaaatggggagattctttcaacctgcgaccactacctgagcttgttggctgacttccccaaggtcccctgtgaggtacaataaagaatggcttaccttggtctgcactggagactgggaatgcctgcaaagcacttcccgccactgtttctacttttatatttcttactgctccctaaatcagtcccagccctgggtaaggttaaggccttcccccatggcctggattttcaggttccccagtgggaacctgaaagcagcttctctctatctcacactctggagacttacagtttttcccttgtcttatggtttaggctgcagactgccacttctttaaaaggtctgtggattctttcagttttcctgttaagttcctgcgtggcttcttggaaaaagagtcaccatgtgattctcaatacactattctgttcttctaagtgggagaggcatgctaacactgcttcttatctgccatcttggtgggggtggaaaaaccaaaacctctcaaagtattttctaacttctcttgtagattcttcttttgcctattgcttatttagaagtgttttgattaatttttacgtgtttgtgaatttttcagttttcctattgttattgaattatagttttattccattgtgatcagaaaagatgttttttatgattccaatcattttaaatttaagatttgttttgtggattaatgtatggtctctcctggagaatgttgcatatgcacttgacaagaatatatactctgttgttgggtggagtgttctctataggtcttttatatgtattagttcatagtgttgttcaagtgtactgttaacttaccgatcttctgtctagttgttctgtctgttattagaagtgaggtgttaagtctgcaactattattgtgcacctatttctccccacaattctgttaacttttgctttgtgtattttagggctcttgttgcttcatagattttggggctctgttaggtgtgtatatttttttaactggtatattttctagatgtgaaccttttatcaatatgtctctctagtaagtttttgatttaaagtctctttagtctgatagtaatatagccacctagggtctattttggttaccctttgcatggaatatttttttccatcctttagtttacctcttcatgtctttgtatctaaagtgaagctcctgtaaatagcatacagatagattctgtctgtatgcaatctgtcaatccctgtcttttaatagaagagtttaatccatttatacttagcatgattgctgaaaaagaaggatttacttctgccatttagttatttctgtatgtgttttggttttttatgcctcagttcctccattatggccttggggtggtgatatttagttgagttgtttgcctttttgattcacttctttcattttaatcatattttaaagtttgttttcttagtggttaccttggggattataattaatatcttgaactagttggaagaataccaggttagctttagtagtacatagacatactgcttctgtaactctccatccttccttttttatgttgttattgtcatagattatatctttatacatgttatactcattaacaacagatttattgtttcatgcatttgcattttatttttatttatttatttatttattttttgagacggagtttcgctctgtcgcccaggctggagtgcagtggcgtgatctcgactcactgcaagctccgcctcccaggttcacgccattctcctgcctcagcctcccgtgtagctgggactacaggcgcgcaccaccatgcctggctaatttttgtatttttagtagagacggggtttcaccgtgttagccaggatggtctcgatctcctgacctcgtgatctgcccgtctcggcctcccaaagtgctgggattacaggcgtgagccaccgcgcccggcctttttatttatttttgtaaattttattttttgtgcagactcctctgctggggccgcaactgctgagaggagcagcacatttgccttttaaatcacataggaaaaagacattacaaaccaaagtacaacactacttttatatttacctaggaagttacatttattagtgttctttattttttctcatgacctcatgttactgtctaatatccttttgtttcagactaaaggactccctgtagaatttcttgtatggcgtgtctattgcaaatgaatgctctcagcttttgttgacttggaaatgtcttaattttcccttctttcttgaaggatagttttgctggatataaagttattggttgaccagttattttgtttcaatacttctttttttctttttgagacagagttttgctctgttgcccaggatggagtgcagtggtgcgatcttggcgcacagcaactctgcctgccaggctcaaatgattctccctcctcagcctcctgagtagctggggccataggcatgcaccaccatgcctagctaatttttgtatattttgtaaaggcagggtttcaccatgttgcccaggtgggtctcaaactcgtagactcaagcagttcacctgccttggtctcccaaagagctgcaattacaggcatgagccattgtgcccagccttctttcaatattttgtttttatttttattttagacacagggtcttgctgtgtcacgcagaatagagtgcagtggcatgatcatggctcattgcagcattgaccttataggatcaagcagtcttcctaccttggccttctgagtagctagtagaacaccactatgcccgaccaaccaaaaaaactttctgtagagatcagggctcactatatcgtccaggctggtctcaaactcttggcctcaagtggtcctcctgcctcattctcccaaagtgctgggattacaggtgtgagccagcgcacctgacttttcagtactttaaatatgtcccactgccttccggcctccatggttaatcttgctgaggatcagttgcatgggatcagttgcttctatcttgctgctttcaagtttctcttattgtgttttgacagtttgactataatatgtctccgtgtagatctctttgagttcatactgcttggagtttgttgagcttcttgggtatgtatacttatgtctttcatcaaatgtgggaagttttcagtcattatttcttcaaatctttgaccctttctttctgttcttctgagattcctataatgtgtatattggtatgtttggtttcccacaggtccctcaggctctattaatttctccttttcttttttctggttccttatactagattattttgttttgtattccagtttcctgatccttttttctgcttgcttaagtctgctgttgaacccctgaaatgaatttttcatttcagttattgtcaactccaggctttctgcttggttccttttcataatttctgtctctttgtggtgttctcattttgttcagacattgatttcctgatttcctgtagttttttccccccacagctttctttagctcattgaacatatttaagacagttcatgtgccatctttgactattaagtccaatatctgggtttcttcagagatgatttttgttaaattatttttttcttgtgaatgggccatacttgcttatttctttgtatgatttgtgatttttgttgaggatgagaaattctgaatattatgtttggaagtttggaagtctagttctcctacttttcaggaatagccgatttttgcttgtcaactgctgggtccatctgtttgaacttttgcaagctgtttttgcaaagagtatgttccttttttaatatggacattgaaattttagttctcttatcactgtgtttaaccagcaatctgacagtaatttccttaaatgtctgtctcccagaagtgtggaggggtgtggaacaaactacctttttaaatcccttgtggctgggaagctgcttgagccaatcagggttgaaacaatgccagcctctatgcttagcccctcagccatcaaaagcagtggtcagtaatcagaacatacaaccttgatttttcaaggttgaaaaaccaagatgcaaaggttctaatttcccaatctggcaccaactagctacactaggaacatcctcgtggctacctgccatgggttgttggctgggggattatagcagccatgttattaataaatgtgaagtttactgaaatttacttgctgttttatcaaattctcctctgggccctgaagtgtttgagtagactccagagttcaaaaatagttgctttagacagctgaatagttgttttgatctcagatattcttggagcttcctgttctctcttctgtgatgtcactcagtttttttatggtaagcatatagttttagtgtaccattttaatttctagtgttttttagctgtattttttgagttatttttagtagttgctctaagggttactatatatctcttaatttatcacagtctgcttcaaattaatactgacttaattctggtaagacaggaactttgctccaatgtagctccattttctcccccttcatttgtgcttttattgttatgtaatactcaaaacagtgttaattattgctttatacagtcttgtttttcaaagtattaagaaaagagaactatacttatgcagtgtttataatcacatatttatcattttcagcactcttaattggttcttgtggatttgaattatagtctggtgttattttctttcatccagtaggacattttgagctggtatgggcaatggtggcagccttggttaagaatgccacaggctttcactgttcttatctcaagtttagtagtttttcatgaataaacacttctcaatttgttacatttggctcatttttagaaccccaaaatactcgtttttgacaatgctgtccagttgtttttggggagagaattttctgaactcttcactctgccacagctggaagtctcccctactaccttgatatctttgcagaaagcatagattacattttgcactgtccttagctgtgtatagattgggcttagagccaaggcaggctgaaaagtgaacctacttttcctaagctgatgggacttaggagaaggaaagaatttggaagtagggcaaagaataattgggccttttatcatcttgcctgggtcttttgagcccccacatcctatctttcctgaggcttagtccttcacaacacagtgtccttatggaggctttctggctccttctaccgccttctctcctgcattccttgtctggggatgggcagagtagacactgggtactcagtgtcaagaagcacctgcttgtacccttgcgtgccttctgtggagggtgtggagggactcaaaatagaggtcagggtgccaagataagtgttggctctgcaaactctgcatgaggttttcagtcttctttcaggcagctttgcacagatggggggctttgcatttggagctgtggtgaggatggtgggatacactctgtacctcatgcccttagtgaaggttttagggaactgctgcccaggaggggaggggagagaaaatacttgcctcagaaagtaatatgctgaccatcctaccagttacggggagaaaatgcacatataattcttaaagaacttcactgattaggtctgttgcctcctgtatagaatttctgtgggaaaaaagccaaatgttatcttattgttgtctttatctttccacagataatgcctcaaacatctctgtaaccagatgcttttgcttttctgttttggcagaggaatgttacggcatccggagtcatccctcagatttctctgatcatgggcccatgtgctggtggggccgtctactccccagccctaacagacttcacgttcatggtaaaggtaagaaagaagggcctgtttttggtgccgtttgagatttgtgcagttccttacctgcaataaaaataattcctgacccagatctaggttgttacctgcattctcattggctttcagcatagtgatgataaggtgttaatggagagagggttttggcatgaaatctgtagcttgtgggggttcagtggcaggggatgcttatgtacttcattggtgggtgattttacttgttgatctgaattgcaaatgattttcaggtaatcaaagaatcctgtcctttgaccagatagatgactgtttactgagtcctattcaagaagtttctcatggaaggcttttctgtaatctgtttattgggaagttgtttcttcctttatttcttcagctccttgccattttattacattgtgtccataatggtaaaggataaatctgatctcacacttcattttcagaggtacatatctttattacatgactttaatggacttatattttaaaaatatttttaaatgaagtctatttgaagttatacatgagtaattaccattcatctcaaaccttgctttaaaaaaatcagccttttcttcttaaaatattaataaaaatgaacattggatgccaagacagaatggttggggggaaaaagtagtgatagccatccaacttgaggagaggagttctagagggagtgtaaatgggaaaccctttgttctcaagggaagttaggcagtaggaattcaaaagtttcacaaagtgcttaccactttgacccaactattctgttcttagtgatataccgaaagtagtgtaagtgttcaacaataagagtgtcttttattaatcaaatttaagatgggccatacacagtgtctcacgcctgtaatcccagcacttgggaggctgattcaggtggatcacttgagctcaggagttttagaccagcctaggcaacgtagcgaaaccccatctctacaaaaaaatacaaaaattagctgggcgtggtggtgcatacctgtggtcccagctacttgggaggctgaggtgggaggatcactcgagcccagaaggtcaaggcagcagtgagccaagatcgtgccactgcactctagctctgggtgacagaggaagaccctgcctcaaaaaaaaaaaaaaaaaaaaggtaagatgaccacttctcttacttggtggacaatgcagaattttctgaactttgcttactaagtctatatatacacacctagctggtgctacccccattctctcctccttcctgcctgttacgaagggaggtgtgggatcaattcctctggctagagccatcctttcctcctgctacacacatccacattgctgaatataactctccacccttcttcaggacccttatactgttccttttctcctttctctttagtatcttcagtctgtccgttggtactagatcctcccatcaaaacttaatcacactcaggtctttcctatcatcaaaacaaaaactgtcctctagttggcatactcctgtagctcttgctgtgtttctctcttgccatcccattctttaacacgtgttaatttagctttgtcccctagaccactaaatcgttttttttttttaaggtcctcagtgacttgcatcactgtaaatgcagtttaactctcattttcctgtctttcaacagtattcccttggcttccattataccatactctggcatttcttctcacaactctgaccataccttcctggtttccattggcaatttacatgattccattcagactctagatgctggagttcatttcaactgctttctcttttaattctgtgttttattctaagcaatctcattttctgcttacaaaactttagttaataattgcatattagtgagacttcctctcttgtcctcagcaccattcttaagctgtcaccattctacatcttaaatattctgtgtatttaataagagtgcagtggaaaatactaagtcttttttaaaggactacacaaggtaattataaagttcttatgggaggaagaaacaccatgcaagaataaacattctatgaaagtagtgtaatgaggagttagccctaccaggtgccaggatataaaactacaataactaaaactgtctgaagaacttgtaggtaaatggacagaaagaccaagggacattacagaattgatacatagatctatatctatttggacattatgatgaaaaggatattattctaagcagagtcactgataataacaatttcttatgtcagagataccagtgattgctgcatcactaaatccagttgacatttctcaccctttgtcttacctgttgacaacatttgctctagctgatcactccagtctcatgactttaaatactgatccgtatgctgacaactctgaaatctgttcctccaggattatatttttaagagcctaccagaatttccatttggactttaatgggtatctcaaacttaacaggttttgatttctaccaagcttctcctgcattgctctcctgcagccttcgccattttaaatggcaggtctagtcttccagtggctcaggtaaaagctttgacactgccttgactcgtcttttgctatcacatcccaaatttagtcagaaggtcctgttggctttactttagaatataatccacaatataatcaaattgcttcttagcacgactacttacttcttactaacaaaactgctaccactttgattcaagcacatcatttcccacctgattattacagaatcctcctgactggtctccctgcttctgaacctgggagctgaaggttgcagtgagcgctttgggaggctgaggcgggtggatcacttgaggctagtagtttgagaccagcatggccaacatgatgaaaccctgtctctactaaaaatacaaaaattagccaagcgtggtggtacgtgcttgtaataccagctactcgggaggctgaggcaggagaatcgcttcaacctgagaggcggaggttgcagtgaaccaagatcgcgccactgcactccagcctgggtggcagagcaagactctgtctcggaaaaaaaaaaaaaaataataaaaataacccaggtcaggaaatagctcttcaagagccctgtcatcatgatcctttctaaggatcattgtagcctccatcctgcttagaatttgttattaataataattctttattgtctcagcttttatggtagtgtttttatttgctttgcttcatagttgaaaataaaaattgcctccctaaacaatgtggattagcgtttcctgttttgacctttacgttaagtgaaaccatataatatgctttcttgtgtgcatggcttctggctcattatgttgttaagatttatctatgttgttctttgaaaatgtagttcattcactttaatagctgtgtagtaagtgtgtgtgtgtgttttttcttttgtgtgtgtttggtgttttttgttttttttttgagacagagttttgctctgtcacccaggctggagtgcagtgacatggatctcacctcactggaacctttgcctcctcggtttaagtgattctcacacctcagcctcccatgtagctgggactacaggcgtgtgccaccacacacccggctaattttttgtatttttggtagagatggattttgctgtgttggccagggtggtctccaaactcttggcctcaagtaatctgccggcctcagcctcctaaagtgctgggagtataggcatgagccactgcgcccagttatagtaaatatttcttaacatattcattcattccactgcagatggacatttgaattatttcaagatttttgccattgcaaatgatgctgatgtaaacatttttctatatgtgtcttggtgcgcacattttattttctggtgctgatgtaaacatttcacattagaggcaatcttaggtcataggatatatatgtcttcagcttctctaggtaatgcccgtctgtttactaaacaggttgcagccagcaatttgagaatttcacttgtttcacatccttgccagcacttacattaacatagtttaattgtgccagtttgatgcttgtggtatagtctcttattgtgttgtcaatttgcattgactcaatttgcattagtccatgactgataaagctgagtgcctttttgtatgattcctgttcttctaaattaaggtatgtttatgactcagaatgtagtctatcttggtgaatgttccatgggagcttgagaagaaagcgtattttgttgttagatgaagtatgtccatcatatcctgtttattgatactgtttttcttttaattttaaaaatgatttctatttattttacttcttaaaatgttttttattatttttttttattttttgagacggagtctccccctctcacccaggctggagtgcagtggtgtgatctcagctcactgcaaccttcggctcccaggttcaagtgatcctcctgcctcagcctcctgtgtagctgggactacaggcacacactgccatgcctgcctaattttttttttttattttggtagagaactggtctcactgtgttgcttagactggtcttgaactcctgggctcaagcaatcgtcctccctcccaaagtgctgggattacgggtataagccacagcacctggtctataaaaatgtttagagacagggtctcactctgttgcccaggctggagtgcagtggtatgatcatagcttaccacagcctcgacctgctgggctcaagtgatcctcctgtgtagctgggattacaggcacatgccaacacacctggctaattttttatttattttatttatttttttgagacaaggtcttgctgtgtcgcccatgctgaagagcagtggtgcgatctcggctcactgcatccttgacctcctggggtcaagcaatcctctcaccttagcctcctgagtagctgggactataggtgtgtgccaccatgcctggccaatttttttatttttgtagagacagggtttcaccatgttggccaggctaatttttatttattttaatttttgtagagatggggtcttgccatattgtcataggctggtcttaacccctggcctcaagtaatcctctcacctagggcccttgagttgctgggattataggcatgagacactgtgcccagctgattggtgttactgagttcatctatgtctttactgtttctgcctgctggatctgtccacttttgatagaggagtgttaagatcttcaactgtaatcatggattcatctatttctccttccagtgctatcagtatttgcctcatgttattttgatgctctgttgttaggtgcatacacatgaaggactgtttgtctccttggagaattgacccctttatcattatgcagaattcctctgtataataactttccttggtctgaagccttttctttctgaaattaatatagctactcctgatttcttttgattagtcttagcatgtaattaatatctttctgcattcatttacttttaatctttatgtctatttcaagtgggttttttgtagacatcccttatagttgtgtcttgtttcttgatctagtctgacaatccgtcttttaattgatacatttagaccattgacattcagagagattgttggtatagttggattagtatctaccatatttgttactgttttctttttgttgtatttgttcttatttttgtcttccacttttctgccttttgtgattttaattgagcattctatatgattccatttttctcctttattaacatgttatactttttttttaccttcttcagtggttgccttagaggttgcaatataatttacagctattttaagttaatttcagataacacttttctgcttcccaggttgtatgagtaccttataatagcaaaatcattctaattccttcctcctatccctcatatgatatatataaaatatgtgtacataattgcacttggtcttagccaaaaggctgagaagcgatgtgcacataattcaattgtacataattgaatgtgtacataattgaatttttgctactattaatttgaatcaaaagttttcattttaccttcatttattccttcttgaatgctctttctttctttatgtagatataagtttctgatctttatcatttaccttttctgtaaagaattttgcttaacattttttgcaaggcaggtctactggcaggagattacctcaagttttgtttgtttgagaaggtctgtatttttccttcacttttgaagaataattttgcagagcacagaattctaggttggtaggatctttcccctcaacactttaaatatttcattccactctcttcgttcttgcatggtttctaagaaaaatttggatataattattatttttggtcctctataggcaaaatgtttttttcttgtggctgcctttaggatattttctttataattgattttctgtagtttggaaataatgtcctaagtgtagttttttgtttttgtttgtttgtttgtcttttgtttttttagagatgggggtctccctgtgtttcccaggctggttcaaactcctgggctcacatggtcttcctgcctcagcctcatgagtggctgggacaacaggtgtgcaccactacacctagctttctctgtgtagtttttttttttttttttgtcattcatcttgcttgatggtctctgagtttattggatctgtggtttggtgtctgacaatttggggaacttttctgtcattattgcttcctatattctgttcttttttctctttctgctccttctggaattctcattatgtatatgttacatcgtttgtaatttgtgccacagtttttagatactccagttttgttttgttttttttgatccatttttttctcttcgcttttcaatttgagtggtttctcttgagatatcctcaagctcagagattctttcctcaagcatgcccagtctaccaaaaaacatcaaatgcattctttatttctgttgcagtgtttccaatccctggtatattttagttatttttttagaatttccatttctctgcttacattgctcatctgcttgctgtctactctatccatgagagcccttaaaccattttgtttgtttttgttttttgagatggagtcttgctgtcttggccaggctagtgttgaacgcctgggctcaagtgatcctcccacctcagcctcctgagtacccaagactacagacacatgccattacacctggcaaacatcttaattgtagttgtttcaaatttctggtctgataattccaacatttctgctacatctgattccagttctgatgcttattctctcttcaaactttgttttttgtcttttagtgtgtcttatgacttattcctgatagctggacatgatacactaggtaaaaggaactattgtaaataggcccttagtaatgataaggagctggggaagaggaagtgttctgtagtcttatgagtaggtgtcagtcttttagtgagcctgtgcctctgaactatgaatgtcatgtgtctcagtctctcgtacttttttggtgggacggtggctagagcgggttggggctggccatttcccctcttccacatggaaagcaagagctggcttgagtttggtatttttcttccctcgcgtcagcagtttctgataaaacttcagcaggttaggctcttatcatatagttttgcctgagagaagaccctgttaagaatgatgctctcgtgcgtttcagaagggtctttttttcccccatgcatgtcagaagcatgagggagttttctctgattatcactgtgagaaccttgttgagttcctagaggtaaaactcacaaaagtgtgggagcccccaatgattggccggccctggagtcttgatctctccgacttgtccatgctgggcctccagcaatttgtcagctatagttccggttttcctacatcagccctggctctggaggagatttgtgcttgtgggtttctgccctgcaaggctcaattttctgcatttgccagttggtctccagttttggggtgctttgttctgcaaagacctcacctctttgatggacctaagaaaaactgttggtttttcccctgcaactttttcagctttttatttgttaagaaggagtatcaacttttagcttcttatgtgctggactagaaacctgaaattttgtgtctctagttttttttttttttaacagtttcaaataaggctgctataaacatttgtttagaagtctgtgtgaagtggggaagacctttgtagctagacctttctagcaagatttcaaaccaagaagccataagataaaagactgatataatgcatatgatagactaaggactaatttccttagtacataaaaaagccaatgatgtattagaaatgggcaaagaacatgaatagtgagttcagagagcactgtagtaatatttattgcagaattgcttattatactaaagttttggaaacaaccttcatgaccatcaattggtgaaagttatgatacaaatcctactatactgatatggaatagaatgatcttcaagctagaaaaacaaatttgagaacagtgtgtattgaactctatgtgtattgaacacagtgtgtattgaacactatgtgtattgaaagaatgtgttgggaagaaaatgtttgcattagaaagtgtttgtgttagataatgtttgtgttagaagataagagggcaaagagggcaaatatatatataaatgcacatggatgcatgggtgtctctgtagagagaagaaactgacagggtatgccttaggggaggcgaattggaggcctggaagtaagggctgggctgtagactttccactgtatctcctgttcctctgtttaaattttatgcagtatacttatattatctatatattagaaactaaaaattaaaagcctatcactctttaatagcaaagcattgatttattagtttttttgtttttgtttttgagacaggtttttactctgtcacccaggctggagtgcagtggtgcaagcaatcatagctcactgcaactcaagtgattgtcccgcctcactctcctgaatagctaggactacaggcacatgccaccaggcctacctaattgaaacaaatttttatggagactgggtctcgctatgttggccaggctggtcttgaactcctggcctgaagtgatcctcctgccttggctttccaaagtgttgggattacagatgtgagccactgtaacccactgatttatcaatatttttaagtagcttcatttaaagtgactggttgcatacagtctccatatctcagtttcctcatatgtaaatgagggtgataatagtacttaggctttagtgacacagttttgtgaagtgcttaaaaaacttcttggtgcacagcaagctctgagtaagagccacctgttactgtgttctacagatgaatgaccttgagatgttagccacattgcaagttaacttctgaggtagaactgtgcaacagaaattttttaaaaaagacaataaggcagggaaaacttgggtctttagtttggagtcgtatctttaagctacatcctatcctcattcagccacgtcactatcttctctgcatttgtcatcttggctgaatcaactctaaggctgtgaccagctctggtgctctgaggttgactgttctggaaatcttttatttcaggacacctcctacctgttcatcactggccctgatgttgtgaagtctgtcaccaatgaggatgttacccaggaggagctcggtggtgccaagacccacaccaccatgtcaggtgagaggccttgaagatgaccttgttgttttcaaacattgagaagagggcattgccaaagagcctggtggcagtttttaagaaatattacttaattggcagaccttatttgggaagactgtggtacagtctattgtactacactacagtgtattgtttacagatatagtgataaaggtagatttagtatataaaatttattaaataacacgctattagtaatgcttggttattctttaaaacaatttagagctagttgctggaatggtgattataagtaggtatgatttatgtatgtacagttgaacctttgaaaaaaaattttatcttattgtgacattttttattctaaggttggtatatatcttagagtacataagtgttttccaatcattggccaggtgcatgatggtcatatatcatgtgttgatgaatttggtcatagttgttaacttctttttttttgagacaggatccagctctgtggcccaggctggagtgcagtgacacaatcttagcttattgcaacctccgcctcccaggctcaagcaatcctcccaccacagactcttgggtagctaggactacaggcatgcaccaccacacccagcaaatttttttttttttgtagagatggggttttaccatgttgccaggctggtgtcagactcttggcctcaagcaatctgcccaccttggcttcccaaagtgctgggattacaggcatgagccaccatacctggcttttgttttgttttgtttttgagatagggtctcatgctattgcccaggctggagtgcaggacacagtgatagctcactgtagcctcagtcttccgggctcaagtaattcttctgcctcagcctctctagtagctgggattacaggtatgtcacatcatacccaggtaatttttatttttaatatttttttgtagagatgtggtctcactgtgttgtccaggttggtctcgaactcctgggcttgagcaatcctcccacttcgacctcccaaagtgctgggattacaggcgtgagccaccatgtccggctagttgttcacaactttaagattacgtaccaagtttaaaatgtataaagattattctgtgcctcagcactgaaacaaaaagttcttgtttaaacagaaaggcatggaattggaagtagggcatgattctgatattagtgaagacatgttagctgttggagtaattattgcaattccatgttttcctgtaaaagaaaccacccagctgtgaatggattacctaccacacagcaatgtaactaaagacaggagaaattgcttctctgagagattttacagcagtgagaggctggcatgcctgatttatgcacctcattgtactgtggttaaggcattgggtcagcatttaattgtcagcatttcttcccagtgtccctaaagtagagatgtgtcttatcagtgaagtcttagattagatgaaatgtagttttaaaaaagttagggctcttgatcccccacccacaaaaattgtttctccccatgtcaggttggcatcgatcttgactcattcctttcccttacctatcagcatcatttagccccatctttaagacatgtctagaatcagaacacttcttagcatcaactccagcacggcctgatgccatgctattgtctcagggctttattggcagcagcctgtttttcttgctggtatataatataaagctgggtcttgatggtgtcttagatttgatgaaatatgctgtttatttttccccattttaatagcattatatgtttgtagtacaaaacttagaaaacatacaaagcataaaaactgctagatattccatcatccacagataatcactagtgattttttggttatacccttgcagtcttttcacgcacatgagcgtgaatacacaaacacttactcaaacataggtatggacatactcttatgtaacctgagttttttttttttttttacttgacagcttaaagtaatgaatgtctgcccatgacattaaagtttcttctgtagcacaatctcaagtacgttttgtttgttttttgattgtagggcagtatgtggttttctttctgggcctgaggctctttgatggactgtgtctgatgcacttggccctgtatccccagggcaaggcacaaaaaggtgctccgtacatatatttttctctcttttcttttttcttttgtggtaacagctttattgagatgtaattcatataccgtatattttaaacacctatttatagtgtacaattcagtggtttttaaaatacattcagagttggataattattaccacaatcaatttcaggacattgtcatcaccccaagaagaaaccctgtgcccattagcagtcactctgcatttcaaccacagatacttctgctctaggcaattaccaggctactttctgtctctgtggattttttcattctggacatttcctagaaatggaatcatataatatgtgatcttttgtaactggttgcttttacttagcataatgttgttaaaggctcatccatgttgtatcatgaatcagtactttattcatttttatggccgaataatattccagtgtgtggatataccacatctagtttattcattgaccagttaatagacactgggtcatttccacttttcggctatcataaatatgcctgtattaatatttatatgcaagtttttgggtagacatatgttttcatttctctttgatttctgagttaaatgataactcgatgtttaacttttaaggaactgacagactctcttccaaagtggctgtacccatttataaatattttttgaatgaaagaattctgtcatgctgaaaatgctttttattcaacaaatactcatttagaatatgtggaaaaaggcaaatagcaaaggaattaaaaatttaaaatagaataataaaaatgtaaaaaaagaaacaaaacaaaacaaatattcatcgagtacctatgtgtgaagcattgttttaggtgctaggaatacatctgtggacagaacaaaagaaagacacctgcccatatggggcttatattctagtagaggagatagacaataaacattgtaaataagtacactatgcagtatgttagaaggcaatacgtgctatggaaaaagtataacagggtaaaggggactgggattgttgtagtttcaaatagggtggtaacagtaggcctcactgaggttaggagctgagcagattttaaggagttaactgcattgatatgtaagtggggagcattgcaggcagaggggaacagcttatgcaaaggctctcggtaggagagtgactggcccgatcagtgaacaaggaggatcattggagtagagacatgacacgatctgacttaaaaagctctgtctgtcagctttgtggacaagagaccgtaggggcaatggtgaaagaaaggagtctggtgggatgaacctggggagagagttcttggctccgctttctccatcatacctatggccttgtttggctgctctgtgatttcagagtgctcttcaagaattatggcttgattctcactaggggcaggtggctcccctcctttccttccactgttgctgtgcacctgtttgccaggtacattattcttaatgttggccaggcctgatcttaccctgttggagctgatattccaggagagatgtccggcagtaaacagggaaataggtgatgcagagaaaagtacgggaggagaactcccgcatggtatagggatggatagtgaaggatctgggagtgggtatggaggtgacattagagcaaggacctgaataaagaaaggtgtgacccctgtagaggtgtggttgcagaacagagggaacatgtgctgcatgagttgaaggatcacccggaaggtatgtattatgtggcattacatcctcagtggagggtgcagagaacagagctatcagcacggtctgctactgacatgccctagaagggcgcagtcaggcatgaagcagcaactttgggctggctggtaccctgactcaatcatatatgctccctgttctcttaggtgtggcccacagagcttttgaaaatgatgttgatgccttgtgtaatctccgggatttcttcaactacctgcccctgagcagtcaggacccggctcccgtccgtgagtgccacgatcccaggtgggttgtaggccggtgcaccttctctcattttgcagtgtagcttgcctttctctgccctgacaggacccccagggtctgccttgttgggcaagttgcagcagagtgtggtagagtggctcccaggtgtggggatgatgtcatgtttggctataggagcaaagaaagatgattttattttcctttttcctctctgtaatatctaatgtatatcttggtggtgaagagtggcccaaaacagttttaaagaaaaattttttgatttctaagaaactctcaagttatctagaattagagattcaagttttttttggtctggcctagtccccatgaagaagtctcccatttcctttccttcccctcacccacaaaaggaagagccatgattcttcttatgctgactatacctggcttttttctgtctaaagtgactggttcctgggctctacctagttgtccttttgaaataaataaatgtaaaatgatgcaaacagcatgccctttaggaaacatgtttatgcatactgcttatagccagaggctgggacagtcctggggaagggtgtgttgctggccatctggtgaagacctttccttttgctgttggagtctaccacctgttgtggaggcaccatagagtaaagtggaggccctgcccaggaactgctccacacctctagccgttccattttatttcctctccaaattataagcactcacttggcctggactttcttctgcagaagggatttgaaattgtattgtttgggaagaggtcattttcagatgctatcctgtagcttaaacctggactccttcctgtggggcctggtctgggccagggatgctctgaagagttgtgttgccagggcctcactctgtctgcctctgcccactccacaagggacatacccagtggcccactgtgtgtagtcatggaggggagagtggtcacaaggtccagagctgtgggtatagcctttctgagtatacagtttggagttcctgaagggtttaggacatcacttgaaggtattatggcccaggagcccagaaatgtctgcatagcccgctttggcccagctatacctcttctgcatatgattccaagggagatatatatccatatatatgtatacatatatatatgcatgtgtatatgcgtatatatgtatacgtgtatgtgtatatacatatgttcatgtgtgcatatgtacgtatatgcatatatatgtatacatacatgtatacatatttgtgcatacacacatacacatgcatacatatgcatgcataggtatatatgcatatgtatgtatatgtatgcttatgtatatgcatatgtatgtatatgtatgcttatgtatatatgcatatgtatgcatgtgtatgtataggtatgcatgtgtatgtatgtatatgcatgtgtatgtataggtatgcatgtgtatgtatgtatatgcatgtgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtgtgtatgtataggtatgcatgtgtatgtatgtatatgcatgtgtatgtataggtatgcatgtgtatgtatgtatatgcatgtgtatgtatatgcatgcatatgtatgtatatgcatgcatgtgtatgtacgtatatgcgtacatatgtatgcatgtatatgtatgcatatgtatatgtatacgcatatgcatacatatatacatgtatgcatgtatacacacatgcatgtgtatatatgcatacccacacatatgcatgtgtacacgcccacacatgcatatatgcatgcccacacacatgcatatcaacacatatatgcatatacgcatatctacacatatacatacatgcatatctacacgtgtatatatgtatatctacacatgtgttcacatacatatatacacatatgtatatgtgtatatatgtatgacaagtaaaaagggaggactttattagcagatggggctacccttagttttctttccagcgtagagctttttgcgaagttgggcttgatggacacatggcctgacccaaggccaaacctcagcccaggagtacgtctcagggtcactgtagcccctggctgcccacactgggaaggagggaatgaaagcctattggagagaagaggttggagaggggcaagttgctgggtcctcctgtagagtgggagtgggctctggcttagtttttctgctgagacacttggatgcaggaggaaggagagagtccatgagcctgcatgtgacaggttctgtggtgattttgcccagagggcctgcagttttgctttttgaaggagctttagcagattaacctaacagggaatgtgaacccacagtggtttatgcagagctctgcctttgcatttccaagtccttgttcttttaatgttccaggaagttgggctgggctctcccagggctgtgtcttgttcactataatgtccttcagtgccctacacggtacctagaatgtaggaggtattcagagaagataaatgaaagaataacgtttagaggaataaactcattttttcctctaaaagagaaccagaagatcttttggattgatacttgtcccaggttcagttaatatggtggttaaaaaggaatgactctttggtgactgctttgtaagcccagcagggacagaactggcccagtccctatgacgtgtcaccccatttcctttcccaccccattcccacaaaaggtaactggctcttcctatgttgactatacctgccttttttctgcctaaagtgaccgtctggttcctgagcttgacacaattgtccctttggaatcaaccaaagcctacaacatggtggacatcatacactctgtaagtgccacatctgtttgtcttgcctgtcctagtcagccacattcatgggcattgtgcttcggcttagtgaggaagcactggaccacttggcctccatgtcagacagcacaggtcgggaatagggtgggcacaggaccagtggccactgagtagtgtgttctggaaagacctagtggctatagataccctagtggcacagatggacttgagggctggagataggagtagtaagggccagcagagctcaggagtctttagaaggccctctgaggatcataaattaggggccatgtccacagagtctagagtgaggccagagtgatcattgttaagtatcattggggccctctgctcagagggggttttgtctttatagagaagagagtacacagggcatcctagaaggttggactgtgtgtgtggaggtccgtgggagacaggagccatttgtacctttttttggtacagcagattcctgggtcattaagtaaaggggacagtgttgggcaaactgaaggcatctgtagatggccaatgccttccttaagggtacactgtgctctcggtagtccttgtgcaacacatcgtgatggctctctggtaactctagaagtcagattctccctcttccctagggtttgctgttttctgttattgtttttgtcttttttattcttgtagtctcttcctgcaccaaggattagcctgagatgtaaccttaaggtcttccttaggtcttttctgagcctttgcaggggcacgtgcaatcactttctaattttccctgcatatgcagttgtttttgagtgtcctagttgttaacgtctggctcccaaaagtagaaaaagagaaaaaaaatgaagatggtaaaaagatgtcagccctttaaattccttggaagtcagttcagcccaaagcaggagagcctcgcaacagtgtggggagttgtagcaacagtgaccacccatctctttgcacctctgtgatcagaagcagcagtcagcaagcacagattctcaatatttggaggacagggtccttttatgcccaccccggctcctgcaagctgtgtgcaaactgctgcaggaacacttgcggaaatatctgtcatggagctggggtgggggatgggtagctgctactatgctaagagctgaaattaactccaattttcagtccaatccttcccctggaagttgcagtctttcaacagacgccagagtcaaaatagttccatcagacagattctgccaggcaattgttgcctgggtggggagacagattcctggtgcttcctactctgccatcttctaactttttcttaaggtacatatgataactcttgattctcattataaagttttatatcctgctacctattaaatactcttgtttgtaatttttttctgtcatttatttagggttttattttatttatttatttttattttattttattattattatactttaagttttagggtacatgtgcacaatgtgcaggttagttacatatgtatacatgtgccatgctggtgtgctgcacctgttaactcgtcatttagcattaggtatatctcctaatgctatccctcccccctcccccaaccccacaacagtccccagagtgtggtatttagggttttaaaaatgtggttgtatactgtctatgtataaataagagttctgtcgggtgcaggggctcatgcctataatcccaatgctttgggaggctaaggcaggaggatcctttcatgccaggagctcaaaaccagcctggacaacataatgagtcaccatctctataaaaagtaaaaaaatttgctgggtgaggtggctgtcgcctgtagtcccatttacttgggaggctgagatgggaggattgcttgaacccaggtgtttgaggctgttctgagttatgatcattgccactgcactccatcctggtgtgcaagactccatcgccaaaaataagtaaatgaataaaattttatctttccagttattttacatgtcatttctttccttgtcttgcattggctacaactccctatatgtcaaatgtaatggtgaatcatagttgtgattctgggcatctttgtattgtttgtaagtttagcaagactgctgtcagtgtttcctaatttatatcttttttcatgttgaagctactactggcttctgttttaaatatttttgttgttgtttattttgttcttaaagttaggaatgagtgttgaatattgttgaatgcactttcagtgtttttggagatgatcatgtgattttcttccttagatctatttataaatctatcctagtagatttctgaatactaaacttccttcattcctgaagttgtatattctgtttgctaatgttttgagtttctgcattgatattatgtgatactagtgcgtatattttaaggtattttaaaatcaggttttggtatcgatgttgtatttgctttacttatttatttatttaaaaaaaatttttttttgagacagagttttgctcttgtcacccaagctggaatgcggtggcacaatctctactcactgcaacccctgcctcctgggttcaaccaattctcctgcatcagactcccaagtagctgggattacaggcgagccctaccatgtccggctaatttttgtacttttagtagagacacggtttcgccatgttggccaggctggtcttgaacttctgacctcaggtgatccacctgccttggccccacaaagtgctgggattacaggtgtgagccaccgtgcctggcctgtatttgctttatgtattagtgttctagtgctgccataagaaaataccataaactgcatagcttaaacaacagaaatttattttctgtcagttctggaggctagaagtccaagatcatggtgttggcagggttggcttcattctgaggtctgtgtctctttggcttctggactacactcttgctgtgtcctcacgaggtctttgctctcagtgcatgcagaaagagatctctggtatctcttcgtcttttttttttttttttccctcagagacagggtcttgctttgtcacccaggctggagtgcagcggtgtgactttgactcactgcaggcttgacctcctgtgctcaagtgatcttcccacttcagcctcctgagtagctgggactatagctgcatgccaccacatctggctaattttaaaattttttgtagagatggcaactcactatgttgcccaggctggcttttccaattatttatttatttttttttgagttggagtctggctctgtcgcccgggctggagtgcagtggcgtgatctcggctcactgcaagctctgcctcccgggtacacgccattctcctgcctcagccacccaagtagcagggactacaggcacccaccaccatgcctggctaattttgtttttgtatttttagtagagacggggtttcaccgtgttagccaggatagtctcgatctcccgacctcgtgatctgcccgccttggcctcccaaagtgttgggattacagatgtgagccactgtgcccggctggctttccaattcttttcttttttttgagatggagtctcactctgtcgccaggctggagtgcagtggcacaatctcagcttagtgcaacctctgcctcccgggttcaagtgattctcctgcctcaacctcctgaatagctgtgatttcaggcacccgccaccacgcttggctaatttttgtatttttagtagagacggggtttcaccatgtttgccaggatggtcttgatctcctgacctcatgatccgcctgcctcggcctcccaaagtgctgggattacaggcatgagccacgggcgccaacccagcttttccaatttttaaaagaattccagtcctaacagattagggtccccctcttatggccccgtttaactttaattacctctggaacatccctctctccaaattcacttttttttttctttgagacagagtctaactctgttgcccaggccagtgtgcagtggcgagatcacggctcattgcaacttccaccttccaggttcaggagatgcttctgcctcagcctctcaagtagctgggattacaggtgtgtgccaccatgcctggctaatttttgtatttttagagatggggtttcgccatgttggccaggctggtctcaaactcctggcttcaagtgatccacttgcctcggcctcccaaactactggcattagaggtgtaagccactgcacctagaccatatatttacttttaactcaaaaagtattgtattattacacttttttattttgctttttaaaaaaacttcttctggccgggcgtggtggctcatgcctgtaattccagcactttgggaggctgaggcgggtggatcacttgaggtcaggagttcgagaccagcttgaccaacacggtgaaaacctgtctctattgaaaatacaaaaattagccgggtgtggtggtgtgtccctgtaatcccagctactggagagactgaggcaggagaatcacttaaactggggaggcacaggttgcaatgagctgagattgcaccattgcatttcagcctgggcgatgagtgaaactgtctctaaaaaaaaaaaaaaagaaagaaaaaaagtgaatatgctagaaaagagtcaaagcagtgactttagaagctacttaagagtgcacacacaaatcaatacggtagtcaggggaaggcattacttctggggaagaagagtacaaaggaaagagagaggtacctttggaaattgtgaagggaaaatgaagcaagggggttacatttatgtacctgcaagacatacaaaatcgaatacactgaaggacactacatctttccccatcaccctccctaaaattagtcacccatgaactaaactgcactttgctatactgacagaagagggtgctcttgaactaggatttttgttcatttgttcatctgccagctttggagaatgcagatacaaatagttttcatttatataaagctacaataagaaaacaaaaagtgagaatgaaacatgtcagttgatggaactcccttcactgtaaaagtcaatcatgaagcagctgactatgcttcaatctgagtgcagtagcccctgataagcatttgaggttgtaaaaatagaaaattcagaaactaatgacaagatggagagataatagtaagaagttaaagctgattgaattaagaaaatgggcaggggagacaaaattgcatcagaaatgatatcaaaattgcaaggtgctcaaaggagaatgtatttcaatgaaaatttaataaggaacattaaagaaaagtagataaatagcctaaaaaatgaatgaaataatataaaaaagtaaaagtagattttacattctcaccacaaaaaagtatgtgaggtggtggatatgttaactagctttagtcatcctacactgtatacatatatgaaaacatgtacgttgtacatatatgcaattataaaattttaaaatagtacagatacctttaatacaattattggttatattgtcacatctgggattaattttttaaaattcttagttaaatgtatgagaaaaaagtgactacaatgaaaggcaaagaagaatgaacatacatataattggagtgtctgaagaaaaaccagtagaacagacttaatatttaaaactgtaatccaagaaaatagtccagaaataaaataagattcagatttatataatgaaagagcacactgagcacgtgggaaaattgacccagaattgtcaaactagagaaaatattaactgttcgatttttaaaataaggagaaatactcaggacctttgggcagaaatcaaatgacttacaagggcaagagaataaaatggcatccaacttctccaaagcaacgtagaaaagcaaggaaacaacagaaaagcactttcaggaggctgaaggaaagaatctgtgactaaggattttatgtttagcaaagctcaccttcatgtattaagactgcagaaaaccagttttaaaccaagaaccgagggaagtttgtgttaatgaggctttcttgaggaatctactagagaatgagctttatccaatcaagaggtagctggagaaatttcaacaaaaggattggtagtgattatctaatatacttaattataattctaagactaaaacagaagtggggatgagggtagagaacaatgtataagtactatatgtttagtttcagaaaaaaatgcaactgaaaaatgggaggagaagagaggggaagaatattgcagaatcagctcactgattattgttagctaacagatatcattaaaaacaaactagttaataaaagattaaggaaatgaactaaaggcatcaaaaggcataattacaaaggtaaccactagactaaaaaatacaaacattctttaatactactcacataaacagtatatatcattgtgggtaatgataaaggggaaaaataaaaaaaaaggtaaaagacaataaatatagaatacatagtaattataaaaaataatatgacaggccaggcgtggtggctcatgcctgtaattccagtactttgggaggctgaggcgagcagatcacctgaggttggaagtttgagaccagcctgaccaacatggagaaaccctatctctactgaaaatacaaaattagccaggtgtggtggcacatgcctgtaatcccagctacccgggaggctgaggcaggagaatcgcttgaacccaggaggcagaggttgtggtgagccgagattgcaccattgcactcaagcctgggcaacaagagtgaaactccatctcaaaataataataataataataataatatgatagtaaaaaagtgtcataccaataaatatggatgggtttgattcacttgttaaaaatatgtctaatttgttatggaccaattatattcagtatataaatgtgattcagaaaggctaaaaataaggaatgggcagaaatatactgggagaatggaaacaataacagcagtatttgtgacactaatattgaacagagtaaagttcaggtattaaccataataaggaaggactttttttttttttttttgatatggagtctcactctgtaacccaggctggagtgctgtggcacaatctcagcccaccgcaacttccacctcccaggttcaagtgattctcctgcctcagcttcccaggaaggacattttcaactgctaaaagccatagttcacaatgataatgtaaagcatatcgaatatctgtgccagaaataaccaccatctttataaagctgaaactataggagattcaacagacttaggtagaaagactgaataggagatgtatacacagcattgttattacaaagcaggtcaaatggacaaaagtaataatttaggagacctaaataacgtaataggtagatcttacacatttcttttggactttacaccctggtaatgaacaataaatcttattctgaagtgcacatggaatattcacaaaagttgatcatatgtattagatcagaaagaaaacatcattaaatcccatagagcaaaaaatactgtgaaacaacattgcttaaaattagaaacttttgtagcaactaaaacaaaagtagcctccagccgggaaataaatcttctagtaaacaattcttggatgaaaggggaaaatagaaaccaaatgacagaattctaaaagaaaaaaagacaaaacactatgtgtcaaaacctatagaatatgtttaaaacgatgaacagatgaaaatctgtttcctgaaacagtaaaaatcagagaaggaaaataaacaggccaggtgcggtggctcacacatgtaatcccagcactttgggaggccgaggcaggtggattgcttgagctcaggagtttgagaccagcctgggcaacacggtgaaaccccgtctctactaaaatacaaaaaattagctaggcatggcggcatgtgcctgtaatcccaggtactcaggaggctgagacaggagaatcgcttgaacctgggaggcagaggttgcagtgagcccagatcgtgccactgcactccagcctgggtgacagagcaagactccatctcaaaaaaaaaaaaaaaaaagaaaagaaaaacagattcccaactggaaaagccaggggaaaaaaccctgtaaaatatttcagaataaatccaagaaataatttaataaggataaatgcagaaatttatgatggaaatagaagaatagctgcaattagtaaacactggctaacttcaaaaaagagacagtaaaagcagaagtatgaagtgagaaagggaataaccattgaaaaagaagaaacttaagaatcgttaagaggccaggtgtggtggctcatgcctataatcccagcactttgggaggctgaggtgggaggatcgcttgaagccaggagttgaagaccaacctgggcaacatagtgagtccctgtctctacaaaaatttttaaagttaactgggtgtggtggcatgcacctatagtcccagctacttgagaggcctcagtgtaggagaattgctagaacacaggagttcaaggctgtagtgagctgtgattgcaccatcatactccagcctgggcaacatagtgagaccctgtctcaaaaaaaaaaaaaattctaagagacaagatacattggaaaatttgtttggaaaacacagtttaacagaaattgatcccatcagagataggaagcttaaatgaaccaccaaattccacggaaggaattacttcaccaaaaagcacaaggagctggattcagtggctcatgcctataatcccaacattttgggatgctaaaacgggaggattgtttgagcccaggaatttgagaccagcctgggcaacatgacgaaactctgtctctacaaaaaataaattagggccaggcaaggtggctcacacctgtaatcccgcactttgggaggccgaggtgggcggatcacctgaggtcgggagttcgagaccagcctgactaacatggagaaacctcgtctttactaaaaatacagaattagccaggtgtggtggtacatgcctgtaatccccgctactcgggaggctgaggcaggagaattgcttgaacccaggaggcggaggttgcgatgagccaagatcgtgccattgcactccagcctgggcaacaagagcgaaactccatctaaaaaaaaaaaaaagccaggcatggtggtatgcacctgtagtcccagctactggggaggccaaggtgggagttcacttgagcccaggaagttgagggagcagttaaccatgtttgtgccacggcactctaccctgggtgacagagcaagactctgtctcaaacaaacaaacaccaggcccaaatagtttcatgtggaatttctgagacctttaagggccaaatagtcctagtgccacataaattcttccagagcatagaaagtaaacaaaacacacaagaaccttccaaaattttttaaaagaagtatgatatcagtacctgaacctgataaaggtagtacttaagatttcagtttcatattgcttatttctttaaaattatatctgtggcctactgggatgtattctaggaatgcaagattggttctaggaaactcaataatatactgtattaacacatataggggagaaaaatcacaattatttatatagacgctgaagaaaacctttaagaaacatcaatacctattcctgatagacttcataaaataggaattaatactttcttaatgtaataaaatttggtatagaccttttcaaaagcctgcatctcacctaataaagactagcttctactaggattaggaacaagtataggatgcccattattcccattattatttaacattgttctggaaatattaaccaatacagttatccaagaagaggaccaattagagacaaaagccttgggagagatgtcaagctgtaacgtaggtgatatagtattgtagtattcaagaaaactctagagaatgcattattatactaaaacaatacttgaggaacaggatacaaaattaacatatagaaatcttcatatacgcaagcagtaaccaattatggtagagtaaaagcctctcttacatagcaacaggaagataaaatatttagtaataattttaacaggaatgtacagaagctgttttagggcaaatttatttttttagacagggtttcactctgtcacccaggatggagtgcagtgacccagtcacaactcactgcagcttcaacttcctggtcaagcaatcctcccacattgccaggactacaggcatgcatcaccacacacacctgatttaatatttttttttttgtaggaagaattcctgctatgttgcccaggctggtctcgaactcttgggctcaagcgatccttctgccttggccttccaaagtgctgggattttaggtgtgagcccccaagcccagcccagggtgatcttaaaaacacttttgaaaatcaaaagtaggccaggcatggtggctcacacctgtaatcccagcactttaggaagctgaggagggaagatcctttgagcccaggagtttgagaccatcctgggcaacatagtgagaccttgtctgtacaaaacaaaacattaaaatagacttgaacaaatggaaagacattccttgttcctggggttaatgttattaacaaactggtgattcttaagttgttctataaatttaaggcaatcccaataaacagtttttaaaaactagaactagataagtttatacaaaagtgcacatggaaaaataaaagtgcaagaatacctaagaatatactgcaaaagaaaagctgtaagtggggactagccatgctttatattacagcatcctatagttaaaactgtggtacaggcacataaatagaccagtggaatagaataaaagagccagaaatagactcaagtacatacagaattttagtacagtcacgcgttgcgtaacaacagggatgtgttctgagaaatgcatcattaggcagtttctttgtgcgaccatcatagagtgtacttccacaaacctagatggtataacctattacacacctaggatctgtggtatagtctgttgctcttaggctgcaaacctgtatagcacgttactgtaccaaacactgtatgcagttgtaacacaatggtaagtatgtatctaaacataaaaagggtacagtaaaaatagggtattacaataggaccaccttcctataggcagtttgtcattgaccagaacctctttgtgtagtgcccaactgtatatgataatgatattttatcaaatctcaggggcaaaaattagcttttaataaatgatgctggggcaactgactagccatttaggaaaatataaaattagattcatactttacaccatgtacaaaaataaactacaaatgggtcagaaaactaaatataatctgtgaatccatacaagcactaaaagaaaacacagatgaattcctctgaaaccttaggggaaggtttagaaatgcttttgaactgtaactcaactagtttcagtgaaagatagacaaagctgactgtgaaaattttaaaatcccactcttcatagcaaaaaactataaataaaatcaaaaggcaaccaatatgctagaagaaactcttggcagcatgtatcccagagtatgaatattcttaataaagagctcttatgctgagggattaacaaccaaaattgatagaaaagtgggcaaaaaaccacggatagatagctcacaaaaaagatataaaatggaccttaaacatgtcaaaagattttcaacttcatacataatgctagaaatacaaattcaaattacactgagtattttctcatatgttagattggctaaaaataaaaaccccgaaaacactttccattggaaagtcagtggagaagcaggcactcctgtgcattgctggtaggggactctggtattatccaggactaaattagcatttgccctttaactcagcaatcccattcctagcaatttaccctgaagatacacttcccaccatacaaaattatagatgtacgaggttacgaccattacgttgtcatttgtaattgcgagatactctaaataacctaaatgtaaattttaaaataatgtaagccacgtgtagattggttgaataaactttggtacatcacacagtacagtactatgcagaagtgaaaaagaatgatgatctctatgaactgataggaagtgattcccaggacatattaagtgaaaaaattcaaagtgcaagagtgtctgtactgttactttccatgtaagaagggtaaattaaaagatacaaatgcaaacacacacataatacatcagaaaataatgagattaataacagggtaggtgggactagggtggaagggatggggaaggaacactattaaactgtattagtattttacatattaaaaaataaaatcaagactggggaaaacctttaaaatgaaatacaaacatgaacctgttttaaatgagtgtcttttgaacctatattttgactatatacctttaatctaaagaccaaaatagctgtaaaaaaattctagctagtaggtctgttttttgtagctaagttagcagttctgaaaccattttctctgtatttgaggatcgaataaataagtacattttgagggtagtagcagccagattctgctatcggagaagggagttgtgaatatggcaagagaaaaaaatctagaatgaaccctatagttgcactggagtaggattagaattatcagcatgaactcatggtttttcatatagctggactttggacgttttagaaggagtcacacacacacacacatccctaaaaggaacccaggccttttggagaaatggctgattgtagggctggggcaggaaagaaaccaagatgaaccagaaagtaagatacttccaaaatataaggtagtgctcaaagaatgatggggacactttagaaggacacaggaaccagcatgaaggaactttggtaaatataggacaatttaaacataaaatgatggtgaaagattataatccatagaataaaacaatctataagttcatattgatacctataagtaaatgggaaaggcaaagatctttcttgtggtagatgtcagctaataaatggagaagaaaagtggaattggaaaactcaccctttgggctgggtgtggtggttcacacttgtaaggagggcggattgctcgagcttcggagtttgagcccagcccggccaatacggtgaaaccctgtctctactaaaaatacaaaaattaaccaggtatggtggcatgaacctgtggtcccagctgcttgggaggctaaggtgggaagatcgcttgagcctgggaggtggaggttgcatcgagctgaggttgctccactgcactcccacctaggtggcagagtaagaccctgtctcaagaaaaacaaaaacaaaaacaaaaaaacaaaacaaaaaaactcaccatttggcagctatcatgacagtaatgagtcaggcaagaatcatggctgcttggtggctgctaggatgctaaacctagtggatgaagaactagattaatgattaaagtttgaagaacaggattttatgtagtctcaacgtatttcctcacaaaattcttattaaattggagaaatagtaactttacaaggaaacctgcagatatcaccatcattaatggacaaatcaacacattgtgccacttgatgagaatgctccttctgtggtactcctgtggaaaggcttagctcaaaattaaacatgaagaaataccaaaggaacccaaatagaagtcatgctttacaaattaactggtctgttgtcttcaaagatgtcatgattatgaaagacaaagatggagggggaaagttaaaggagcctaaagagatataaccactaaaagcaccaggtgatcctggctcaggttctggaccagaattttgttgcttgtgctgctataaaggatactattggaacaattggcaaacttgaataatgtcatataataagaaatagtggccgggcgcggtggctcacgcctgtaatcccagcactttgggaggccgaggtgggcggatcacgaggtcgagatcgagactattctgaccaacatggtgaaaccatctctaaaaatacaaaaaaattagctgggcatggtggtgcgtgcctgtagtcccagctactcgggaggcttaggagaattgcttgaacccagggggcggagattgcagtgagccgagatcgtgccactgcactccatcctgggcagctaagcgagactccgtctcaaacaaacaaaagaaaattgtgaattgggcacagtggctcatgcctgtaatctcagcactttgggaggctgaggcaggtggattgcgtgaggccaagagtttgagaccagcctgcgcaacatagcaagaccctgtctctacaaaaaatataattttttttttttggtggcatatacctgtagtcctagctacttgggaggctgaggtgagagaattgcttgagccctggaggttaaggctgcagtgagctgtgatcatgcttctgcactccagcctgggtcacagagcaagacctgtctcaaaaaaaaaatagtattgtggtaatgtttatttcctgattttgataatatcactgtagttataaaaaagaatgttcttatgtgtttatatatatataaaagagagagtgatggtcgggcacagtggctcacgcctgtaatcacagcatgttggaggccaaggtgggaggattgctcaaggccaggaattggagaccagtctgggcaacatagcgagatctcatctctactaaaaattaaaaaattaactgagcatggtggtgcacagctgtggtcctagttgcttgggaggcagaggtggggaagatcacttgagcccaggagatcgaggctgcagtgagccataattgcaccactgcattccagcctgggtgacagagggagaccctgtctcaaaaaaagaaaaaaaaaaaaagcagaatagtttgtagtaaaataataatgaagaatcggggtgaagggtatatgtactgttcttgaattttttatttttatttatttattttttgagataggatctccctccgttgcccaggctagagtgcagtggcataatcttggcttgctgcaacctctgccttccagtttaagcgattctcctgcctcagtctcctgagtagctgggattacaggtgcctgccaccacaccaggccaattttttgcatttttagtagagatggggtttcgctacattggccaggctggtcttgaactcctggcctcaggtgatccacctgcctcgacctcccaaagtgctaagattacaggagtgagccactgggcccggcctgacatttttatttaggttggaaataatttcaaagtgaaaaggtaaagttgtcacaaaaattccacactcaaataggacttttaaaacaaacttcattggtgtgtccatcttagcagcagttgaggttttccacaccatttctccccagcagggaggaggtgctgcctctgcctgttgtcctgcttccttggagaacctgtgatagagctggagctgtctacctctacctctgtaattctgtaatagaaatgtcattctgtagtgtcattacatcttatacttgtctttaccattttgagctcagaagtaaatttattcctgcaggttgttgatgagcgtgaattttttgagatcatgcccaattatgccaagaacatcattgttggttttgcaagaatgaatgggaggactgttggaattgttggcaaccaacctaaggtggcctcaggtaggatggagctcttataagccttggttttggggttggaggccagggaagcctgggtccatggtatcctttctgtcttttgcctgttcttcagacatggccttccatgaccagaggaaaaaatctaaatggttgttataaaagctaattttttttttttttttttttttttttttttagacagggtcttactggtgtctaggctggagtgcagtggtgtgatctcagcacactggaccctctgcctcccagggtcaagcagtccttccacctcggcctcccgagtagctgggactacaggcacataccaccatacctgactaattttctttttttgtatttttggtagagatggggttttgccatgttgcctgtgctggttttgaactcctgagctcaagtgatccgcccacctcagcctccgaaagcgctgggattacagacatgagacaccacaactggcctataaaagctacttttaatatctcaaaatgcttctttcatactccttttcaaaggtttataggaaacttacattcttagtgtataaggttttcaattttttaggggtcagttttctgttcccccctacccccagctaaatatatgactcacccactaatcatgagctccatgagggcaggggtggtgatgtcgtattcacagtagtatctccagtgccttcaacagtgccaggcacatagatggtacgtgacaagttaatggcatcttaccatgtctgtgccccacagctttctggtgatatggccagacctgattcgcagccaagtgagggagactcttccatggctgtgctctgggagggattgggagtgctggggtggggactgtgaataccacttctctcctcaatatttttcctcttagatttgttttgtatccttgtttaggaagaatctgtctttcttcatgacctaacctcatcttatttctgccatggaaattttttattgtctttagaaaactgttttggctgggtgtggtgcctcacgcctgtaatcccagcactttgggaggccaaggcgggtggatcacgaggtctggagttagagaccatcttagccaacatggtgaaaccctgtctctactaaaaatacaaaatacaaaaaatgagctgggcgtggtggcacgtgcctgtagtccagctacttgggaggctgaggcaggagaattgcttgagccggggaggaggaggttgttgtagtgagccggggattgtgtcactgcccgggaggcagaagttacagtgagccgagatcacgccactgcatgacagagtgacactgtccccacctccccaaaaaaaaaattttgtcatggtaaaatatatataacaaaatatgtctgtttggcccatttaaagtagtgcaaccgcagtgattacatacaaagtgtatgcaaccatcaccactgtttccaaacattttcatctcctcagagactgtgaacctgttaaacaataactcactatttatctcagcctccagcctttgctattctaaatctactttctctctctatgaatttgcctattttagatatttcatataaatggaatcatacagtgtttgtccttttatatcaatcttatttcacttagcataatcaggcttatttcatttagcaagattcatccatattgtagcatatgttagaacttcatttatttttatggctgaataatattatgttgcatgtatataccacattttgattgattgtccatttgtcagtggacacctgggttatttccacctttgggttactgtgaataatgctggaataaacattgatatataagtatctgtttgaacctcagttttcactttttctgggtgtgtacccagaagcaaaataactgggttatgtggtaattctaggtttaactttttggggaaacaccatactgttttctacagtgtctgcactattttacattcccaccagcaatgtgcaagggttccagtttttccacatccttgccaacacttattattaatttttaaaaatagtaatcctagtggatgtgaagtgaatggaattgtgtttttgatttgcatttctcatcaacattagtcttggtgagcatcctttcatgtgcttattggccatttgtatatcttctttggaaaaatgtctattcaagtccttttccattttttaattttgtgtgttttttgttgttgagttggagttccttgtatattctgtatattaaactcttacatttgacttacaagtattttcttctgttctataggttgtccttgcactcttttgatcatgtcttttgatacacaattttttttttttttttgagatggagtctcgcgctctcttgctgtctccagcccgggctggagtgcaatggtacgatctcggcttattgcaatctctgtgccccgagtttcaagccattctctcacctcagcatcccaaatagctgggattacaggcatgtgccaccatgctgggctaatttttgtatttttagtagagacggggtttcgccatgttggccaggctggtctcgaactcctgacttccagtgatctgcccaccttggcctcccaaagtgctgggattacaggtgtgaaccactgcacctggctgaaaagtttttagttttgattaaatctgatttctgtattttttcttctgttgcatgtgcttttgttgtcgtatataagaatttaaattcaaggttgtgaaggtatgttcctgttgtttttttcctgagagtattacggttttagcccttacatttagcttttaatttcgagttaattttatatgtattggataggagtgcaacttcattcttttgcatgtggaaatccagttattccagcaccgtttgttgaagagattattctttcctcattgaacaggtgtggcgtgcttgtgggaaatcaacaggctgtgggtgtatgaatttgtttctgtattcttaacactattctgttggtctgtatgtctgtccatattccagtgtcacactgttttgattactgtagctttgtatatgttttgaaattgggaagtgtgtcttccaactttattgttgttcttaggattgttttaggcatttggggcccttttaaattccatatgaattttggtagtgactttcccatttctccaaaaaaggctgttggaattttgatagggatggtgttgaatcagtagattactctgagtagtattgacaccttgacaatattgtctttcaatccatgaacacagaatgtctttccatttttcttctttttttatttctttcagctgtgttttgtagttttcagagtccaagcctatcacctctttggttaaatttattcctaaatgttttattcttctagatgtcatgtacatggaattgctttctcaatttctttttcggattgttcattgctgctgtatagaagcacaactacaaaactgatttttgttgatcttgtaacttgcaactttgctgggtttattaactttgttagcttttgtttcaaaatttatattgctacattttgtttgattgttgatctgtggacatggggtattttcaccttttagttgtgaataatgctggtgaatattgtgaatattatgaaagttgatgaatttgttcattagccctcttgtggatttgctgggattttctatatatagggtcatattttctgcaaatagagatagttttacttcttcctttccaatttggatgctttttatttttcttgtctaattgctctggcaagaatttcttgtacattgttgaattgcagtggtgaaagtgggcatggttgtcttgttcctcatgttaagggaggaaaacctaatctttcattattgtataatgttagctgtgggtttttcatgaatgccctttataatatggaggaagtttccatctgttcatgattttctttgttttatcatgaaagggtgttggattttgtcaaatgccttttttgtgtcaattgagatgatcatgtggtttttgtccttccttttgttaacatggtgtattatgttgattttcttatgttgaactgcctttgcattcctggaataaatcccactggatcacagtgtataacctctttaaaaaaatagacttacagaacagttacaggtttgcagcaaaattgaatggaaagtacatagaattcctgtacaccttctgctcccacatgcacacatgcacagcctccatatgtccaaaatcctgcataagagcagtatatttgaggttaatggttgtattaatctgttttcacactgctataaagacaccacccaagcctgggtattctataaaggaaagaggtttaattgactcacagttccatatggctgggaaggcgtcaggaaacttacaatcatggtggaaggcaaagtggaagcagacgttcttcacatggcagcaggagagagaagtgcaggcaggggaaatgccagatgtttataaaaccatcagatctcatgagaactcacacactatcacgagaacagcgtgaggaaaaccacccccatgatccagtcacctccctcccttgacacatggtccctccctcaacacatggggattacagcttcctctctcaacacatgggtattacaatttgagatgagatttgggcgggcacacagagctatcccataccaatagtattttgttttaaatttcagattctactggtttattgccaatatataggaaagtaattgatttttgtatattagccttttatcctgcaaccttgctatattattagttccagcagttattttttggtcacttctttcagattttctgtatggacaattttgtcatctgtgaacaaagacagtttgatttcttccttctcaatgtgtatacgttttattttcttgtcttcctgcattagccaggacttccaatacaatattgaaagatagtggtgaggggacatttggtcttagcaggaaaacttctagtttcttacaagtaagtgtgatgttagttgtaggtttttcatagatgttctttataaagttgaagaaattcccctctatacctagtttattgagagtttttgtcatgaatgtattttggattttgttacatgctttttttgtattcatatgatcatgtgatttttcttctttagactgttgatatgatagattacgttaattgatttttgactgttgaactaaactcacatacctgagataaatcccacctggttttgatgtgtaattctttttctgcattgttggatttgatctgctaatattttgttgaggattttttcatatatgtttatgagcaatattgagatatagttttcttgcaatgtctttgtctggttttggtatcagagtgatgctggactcatagaatgagttagaaagtattctttctgcttctgtcttctggaaaagattgtagagaactggtattaatatcttccttaaatgtatggtagaattcactagttgaaacctgggctttatttgctttttaaattatgtaggaaataaaaagtgaagttagaaaccaaaatactcaaatcctggtttttatatttgcccatgtagtcatctttacttgagatatttatttcctaatgtagctttgtgataccgtctagtgttcttttcttttaacctgaagggcttcctttagcatttttctgtggagtaggctggttggtactgagggcctcagcttttgtttatctgaaaatgtcttaattcttaaattttctctcatttttgaaggacagtttgccagatatagaattcttggttgacacttttattcttttagcattttaaatatgttatcctgctgtctctggctttcagagtttctgctgagaaatcactggataatcttaatgaggatttcttgtaaatgatgagttttttttttttttttttgctgcttttaagattctcttttgtctttcagtaatttgactataatatgtctcagtgtgggtttctgaatgtattcttcttagagttagttgagtttcttatatttctagtttcacatcttgcatcaaacttgggaagttttcggacattatttcatcagattatctccttgccactttctcttagtcttctcctggtgctcttatcctgtgtatgttggttcacatgtgggtgtcccacaggtcccttaggttctgctcatttaatttttttattttctcctcagagtaatttcaattgttttatcttcatattctctgatctttcttctgcctgctcaaatctcctattgaatccttgtagtgaatttttcatttcatttattgtacttttcagctccagaatttttcattattttcctgatttcctttagttctttgtccatgttttcctttacctctttgaatatatttaagactagtttaggctgggcatggtggctcctgcctgtaatcccagcactttgagaggccaaggtgggcagatcacctgaggtcaagagttcgagaccaacctagccaatgtggtgaaaccctgtccctactaaaaatacaaaaaatgagccggacgtggcagagggtgcctgtagtcccagctacttacgaggccgaggcaggagaatcacatgaacctgggaggcagagcttgcagtgagctgagatggcgccattgcactccagcctgggtgacaagaagcagaactccatctcagaaacaaaacaaaacatctcaaaaaaaaaaaaaaaacccactagtagtgttttatagtctttttctagtaagttcagtgtctatgcttacttagggatagtttcttcattttataccttgtgatttttttaattgaaaatggggtatttatacattataatgtggtaacgctggcagtcaaattttcctcttttcccaagctttgttttttttttttttgatatttaatgtcatatatgtttgcctagtgtctttttgcaatgacttttccagagactatattttttgtcatttgtggtcactgaagtccctgtttcttcttattgtttctttctttcttttgagacagggtcttgctctgttgcctgggctggtcttgaactcctgtccttaagagattctcccaaagtagcctcccacagtgttaggattacaggtgtgagccaccatgcccagcctgtttcttaacttgtatatttgacagaaattttcttgaacaccaggaactaaaaccaagaaacaacaaacaagaaaactcctggtcttgaaattgtctctgtgttggggctctcctttgatgcttagccaaacttgaactaaggtttgagatcagctcaaggttaaagtttaaggttttctctggtcttttattttgtaatagtgttttcattttcattcaacttcttttcttatttcccctctcagatcttttctgatcgtgtatctcatcctaggcatacatgtgtctttctgaattctccctattcacgggtgcttttgaatgcactaatttcctaaagacactctctgttttttttttctcccatatcttaggtggtttcaacagtaatcttttgcccagacatctgcaggttgttcctctaccttaccatgatttaaagaaatgcctgctacatttccagcctggataagttctgagttaggtgaaacagagatgtgttccttgtgtcagtccttcaggcagcccacagacaggttagagcagacatatgcggaaatttgtgaatgaggtctgctctgcttcctccagaaccagggaggaaatgggacaagtgtaattaaaaaggcacagagctttcataccattttcttttatttttttgagacagagtctcactctgtcacctagtctggagtgcagtggcatgatcttggctcactgcaacctccttctcccaggttcaagcaattctcctgcctcagcctctgaggtagatgggattacaggtgtgcaccacgctcggctaatttttgtatttttagtagagacagggttttgccattttggccaggctggtcttgaactcctgacctcaggtgatccgcccaccttggcctcccaaaatgatgggattacaggtgtgagccaccacatctggccatttttttttgttcttttagagacagagtgtcactatgttgcccaggcaggtctcaaactcctgggcttaagcagtcctccactttggcctcctgagtagctgggactacattgtctttttattgttgatttctagggcctggcttgtgacttgcctatttatttcctttcctttccttttttttttatttgagatggagtctcactctgttgcctagagtggtggtgcaatcttggctcactgcaacctctgcctcctgggttcaagtgattctccttcctcaagccttctgagtagctgggagtacaggtgcctgcaaccacgcctggctaatttttgtattttttagtagagatgaggtttcaccatgttggccaggctggtcttgaactcctgacctcaagtggtctgcctgcccgacctcccaaagtgctgggattacaggtgtgagccactgtgccgggccatgtttttattcatgaatggatattaaattttttcaggtattttctctacatctattgagatgttcatatagtttttttcctttatttaataatttcattagttttcacatgctgaaatcaaccttgaattcttgggataaaccccacttggacatgatgtattactgtttttttgagatggagtgttgctctgtcacccgggctggagtgcagtggcatgatttcagctcactgcaagctccgcctcccgggttcacaccattctcctgcctcagcctcccaagtagctgggactacaggtacccgccaccacacccggctaatttttgtatttttagtagagacagggtttcaccttgtcagccaggatggtctcgatctcttgacctcgtgatctgcccgcctcggcctcccaaagtgctgggattacggtcatgagccaccgcgcctggcctactgtttttgtatatattgctggacttgataatgtgccttacttaaaaagtaaaaatttttcatttatgtttttggtctgtattcttttctgatgatggtccttgtcttgctttggtattggggtaatactggtctcatagaattaagttggaaactcttctaggaggggagatttactagtaattgagctcctactctgtgctgctttatagattccatttcctttactccttggaactatgctaggaggcagtatcgtccctactttgcaggtaaggaaccttaggtcaaaaggcaaagtaatttctcaagggcacgttgccatcatcagtggagccagaatctgattggaagctctgaggactctctaagaccagcccttgaatgctgcctcccactgatggctccctgcggcaaggccggctgtgtctcagctggcggcagccctttggtctgtagtgagtctgtagtagtctagttctgggcctctttggccagtgacagacaggtggattcttcatcttccctgtttcctggagtttgaggggtccttgttaccattctgcaacaaagaagtgttggtgcctccacagaaaccagctttggatggctgctgaggacaaatccccattgtggatagaactgggaattgcctggatactcagtatggataatctctctctttctaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggtgaggacctcatgttggaggccatgaccctgctcactttcctacagcatagccgtggtgggaggtctggcagagttttaccagggctggaaggagtacaccttgctcatccttaaaaagatctcttgaggatgttgttcccagccccgcagaaatgtctgtgcttttttaacacaggggaactgaaggcagtagtgggaaaaagccagaaaagataatgagcattaactttgaaaggtcttacagaccgtgggccttcaggagcccagtagggctattcttgttctttgtcccaattttacctggtttcctggggtctttcagggacatgatctggctgtctcaggctctaacactcagcatttggatctgttttaggcctatggaggtgcctatgatgtcatgagctctaagcacctttgtggtgataccaactatgcctggcccaccgcagagattgcagtcatgggagcaaaggtgagggcctcttgcttttccctttctgggtccaaggactcgactctaccagcgagagctcaaggcatagctgggaaatgttggagagaggccagggcccctaggttgagccaggactgaggtgaatgggacctagaccttggtaagtctccctcttggggctccagagatagctctgcctcctgtcctataccctttcttcaggcccacgctggtgtcttcatgccaaggtgggtgcggcaggtgaaaggaaagtgagaggggtccagagtggttttgagattgtaagtaaagggggcaaagggttgagtcaactgaagtcaccttcagaagtattggacattctcccagctccacctcagcttccagggagggccccagagctactcttttaagctcataagaagctaaactgtaggtccgaccctagtgacgttggacaaggtacttcctattgcttgacctattcctcactcctccctgctttgaagtagctattgtggtcgaatcagataacttccaggtcccctagagttgacttataggtgctctgacttgaaggccaatccttctaatttccagttcagtctggtcgcctctggccaccgaattgtatactcaggtcttagggtaccgaaaaagggaaatagcacatttaattccccttgatacaagaccatggatttaataatggaaaacagggctaacatctttggctcaaagaaatatgatgagtgcaaatggagatggtagaatgggctctggggagagaagctactggcttttgcctgactgccccttattggggccacagggaagcatcacatcccatcatgcagccccttgtgtcatgatggtcagccccaggcagttcctccctctatgctatggcctttagagatggcacttcccctcagtacactgatttaccaagaaatttgcacccacacacagtgataatgagttgaaggagatctgtccaggttgggacgaccaaagatgttcatgaactcctctaatcacagggcgctgtggagatcatcttcaaagggcatgagaatgtggaagctgctcaggcagagtacatcgagaagtttgccaaccctttccctgcagcagtgcgaggtaggggactgtggtgaagagggcagctttgtttgtttggtcaacttgctcattctttctctacagaaattgtcacataactgcctttttgcctttgcagtctaatctgttgactagtgagggttgggactgtccctgggcagtcatcacttggactaaggactgtgggacaggctgctttggtaaccacaattaaaacaacattgccaaagtgtattaaatttctaggtgttgttccagttgtctagtgctgtgcagaaattcaccctataactcaacagcttaaactaaccaccgtttcccccactgcttatggttctgtggggtccacaatttggtctgggcccagctgagtggttcttgtgctggtcttgcctgggatcacccacacaggtatagtcattctgtggcttgaccggggcttgacagtccaaaatggcgtcacttacttggtagttgctgttagctagactcactccccacgtggcctctcacccttgaggaggctagtccaggcttccttacatggtgtcccgagagtagcaagggggcaaagggaaactgaggcctagatttggaagttgcacagtgtcatttttgccacattttataggccaagaaaactcaacaaggttaagcgaaggaatacaaatccacctcttgaagagagaagtggtaaagtcacattgcaggacttgtgtacaaggatgaattgttatagccatttttgaaaacctagatgtattttctttatttcctattgaattcattgtggcaggatggaggcattggagcaagcagggtatagggagggtgtccgattttccttttcttgccaagtgctcctaggccagaagttggggagctgtcagaacaggccagctcctgggatacaagggggaattcacagggcctaccatctctgtatcaggttgggcactgcttatactgctggccccagggatggtgcccaggctgagcagaaggttgaggggtggcatcatctcgggatgcagatgatccactcccttttctgtgcttcaccagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctcttttgtgccttactgtaaaattatttacttttttaaacattttaagttgtattttttgagcataaattcgatttttttaggtggaaatctgaaaaatcaatacaactagaaagaaaaatagtacacagtgttatcatctagagctgatttttatttcacacctctgggtattgttctttttcctctcgagttagtttttttatccataggtgagatatatagtaagtttttaaggcaaagtatttcttaggcttaagtttccttattttaaaaatagggtaatatgccctatctatctcctaattcctccatgaattgaggattaaatgtgatgtttgcaattgtggtatatgtgtttagcagtacagatgctcaataaggcatagcaccctatgttgactcaggttatttccagaaatgtgttcttaaaattaaaaaaaaactttttaattgcgaaaattttcaagccgatagaaatgttgcaagaagtgtattgtatccacttcacctagattctccagttggtaacattttctccatttgctttatttcttccatacgtagatatatctaataatatataatatgcatataagatatatctaattatattattaatataattaatgtataattatatctaacatgattatatatatttatatatttatattatgtatttatacattatataattatataattgtataacatatacaatataattatttaattgacccctttgaaagtcagttgcagattcgtgaccctgtgttcctagaaacttgtatctcctaggaacaaggtcctttgtcttacatagtctgtcgttcatgacgttgacatttttgaggagagcttacttgctggttatttggtagagtgtccttcagtttgggatgtctgtttcctgaggtttagattcagataagactaacacatattcctttcagtgcgtcacattagtaagcacattatgtcagtttttcctcctgttggtaactgattctgatcacatggttaaggtcgtggctgcaaaggtttttccatggtagttaccattttctctttgtaactgataactaatttgtggggtattatttaatcttgtctgtcaataaactttcacctgggccaggcgcagtggctcatgcctgtaatcccagcactttgggaggccaaagtgggcagatcaccttaggtcaggagtttgagaccatcctggccaacatggtgaaaccccatctctactaaaaatacaaaaattagccggatgtggaggcacatgcccagctactcaggaggctgaggcaggagaatcgcttgaacctgggaggcggaggttgcagtgagccgagatcacaccactgtgctccagcctgggtgacaaagctagattctgtctcagaaaattaaataaataaactttcacccaataattttagtattcattgatgatttttgcctcaatcaatgattctgcattgattataaaatgttgagtttctaactctctcatatttattagttggaactctaggtaaggaagggagctttcttttctcctgtttttgttttcttagtatcattttggacttgatttattttattttatttatttattttttgagaaggagtctcgctctgtcgccaggctggagtgcggtggcgcaatctcgactcactgcaacctctgcctcccaggttcaagcaattctcctgcctcagcctcccgagtagctgggactacaggtgtgtgccaccatgcccagctaatttttgtatttttagtagagacggggtttcaccatattggccaggatggtctcgatctcttgatttcgtgatctgcccgcctcagcctcccaaagtgcttttaatatatcccactgatttttttagtatttcgttattttctgacaagataatgctctaggcttatcttgtattttccttgcccagcccaggaatcagcagtttctccaaggagtttctttaataggtatgtagtagtagtatatagtagtttcttagtttcttttagtaggtatgtcatttagaagctaaaattggcactaggtattcacactgatactggatatcattgctttgaggcatttcagcagacagaactaggaaaatttatgcaaataagtgtgtgtatatatatgtgggacacatgtatatatgaatacatatttatcatacttttaaatcatgagttcatactgaaacttttaatccaacaccatgggtgcttctttgccttcccccattctgtattgtctctcttaccacagcagtaataaccctggctcccattattctcaatatatttcactcatttgctcagtgctaccataaatacaagtttcagaatcactacagctctatcaacaataaaccttctaaagttcacgacttctttgtagttcattttgtctttaaactgaagatacatggttaagctacctcaattagtaactgagtggttatcaatatgaattagtcctttttgtttgtaaaccactttaaagcctttcctcctacactgttgacttgattttactaagttaaaacattaatagttttaccgaactggagattaagtttgagcagaagtaccaaccatggagtgctgatccaagatgcccccccacctcaggcatcctctctggtgaaaccccagggccctcccactactgatggctttcccttggctccagagatctgtaagcactgcttggacagtgaatcattatttcaaggtcaacttaatgtgtgactgtttattctccacttttcccatttcaaaaatattttcccctaccccccattcccagtagcccttaagagtcattctttttttttttttttttttttttttcttaaagcatctttccactctccttcagtcaccaatcctagttgggctctgaggacttttgcagcagtctcttcactgatctctgtggcctcccactgagctggaagtcctgttctcagctaccatactaactccagatccagattttgttgcattcctctgctccagcgccacttccagagctccctgttctccagagtccttagcccacgtaggtggtcctggacagtctgtccctcccttgcttgcctagtgagttttctgagcccacagttcttgttttcgtgatctctgctatggtccataaaagagtacatacaagctcttttttttctttttggaggtaagagtccaagaagtgtttcaccaggttgtgcagtctggacaccgagatggtagaggggctgtaagatggtagaggaaccagctcaggagagcagctgggctagcagctttacggaagccttggatggtggggaaactcccgtacagaaactcagctggtcaaagaaactcaaagccacaagaccttggaagctttgtcaagtggaccagcctccatggaccacggaataccttgagagtaatgacagttgagtgttctcttgtgtgggaatgccttccccagctggtgccctcaccttaaagggaaaaagaaaatacactgaattttgtaaatgggaaatacttgggtccactgagctgatagctgacaagtgtctgtctttaaactgagagcagataatatggtgagctgtggtgtaggaagcactgctagggtcttgctggtcctgccccgccttgtgttaatccagttcctcctgagctacacagctgacaagtggtgaagctgggatttgaactcagatgggtttgaccccagccaagcctgtgttctgatcatttcaaagtactaccactcagctgatgaggaaggtgagatggacttctaagggttggcctaagagtaggggtgagggaggttggtggtctgttcccctgggcttgtcttaacccagaaagctactacatttagacagctttcctatctcccgcatgattctcttgcaaagcagtaccaacagatggccagtcatctttttgagttgctagagtaatggggagcacatccacaatacacccttctaatgcttgttagaaagtgcttttgttgcaaagttcttctagcttctttttttgaccctgtcttggtctccccagcccaactttctgcctctggttgcactgatactttgtcctggtgctggtgcttaagatgtggtctgctcagccaaagaagtctgtgaaggatactcacccacatgtggagttgatgaatcagccctcttcacctattcaacagatgtgactgttttgtctttctggttccaaaggatttctggagagctatgactttacccttttagaagtattggtcctcatactctgtgcacctctgatgtcagcatgggatttctacaattccaagcaggagttgcagccacttgataggcagtgcctcagtctggggcctctgtggaatccagctggcatattccagccaatgtggcagcctcaatagttagttaagttttgaccatgtccctactgtcctgggtggtgaaaatactccctttatgtgtccttgggagcagaaagatgctcttcaaaaagtggtgcctgatggagatctccacagaacaagacactcagaagggcagggatagaatcttacctgagcttggtctagtatgaaaagcctaaggctgggtgcgatggcccatgccctgtaatcccagcactttgggaggccaaggcaggtggattgcttgagctcagttcatgaccggcctgggcaacatggtgaaagcctgtctctactaaaaatacaaaacttagctgggcgtggtggtgggtgcctgtaattccagctacttgagagcctgaggcaggagaatctcttgaaccccagaggcggaggttgctgtgagctgagatcacaccattgtactccagcctgggtgacagaccgagaccctgtcttcacttaccgccccccccccccccccgaaaaaaaaaaggcaagcctgagtggcatcaaacctttgtttcccatgaatatactagtccctgcttgatggactgttacctgggaacaggggcaaacagggagttacagtcaagccacaaatgggagatttgcaagcctgacccaagcctgaaagtgctcatctagtctcatactcttgtaaccatctagatgagctgttacagaccatccttaaatgaccttccttccttggctgtctggaaagcttgcttgctgatttgtctcccacacctttgccttttttgcataggcatattaggccatttaaggaactcaccccctattgccagacccatgaagtgtgtagggtatgacttcttaaagaaagagtgaggaggtctaatgccaagagaaactttttaagacagtctggctctgttacctagattggagtgcagtagtggtgcaatcttggctcactgcaacaacctccaccttgtgggctcaagccatcctcctaccttagcctcacgagtagctggtgtgcgccatcatacgcagctaatttttgtattttttgtagaggagttttaccatgctacccaggctggtctcgaactcttgagctcaagtgatccactcaccttggccttccaaagtgctgggattacaggcgtgagccaccatgcctggctgaaaacttcatttctgtagctgcattgactctatgtggtcttcaaaagggcactgccagggtgcaattatgcatgtaagcccagagtctcaagccgtgaggacccatgctacaggccagtggatgggtgttccctgaatgcctcatgcaaaactcagtttgcaagagactccctcttaaaccacagatgacttggcctacacacactccagagaaatctaaggaatgaaagaaagtgagctattcctaaattctgctttcttaaaaaaaattaaaaagccaaaacaacaaaaccaccaactcactaataaggttaacttgctgccatttaacagattatcagaaattgcaaactctctcaagagccacaggacagaaaatcatctctttaaagccatacctggtagaaacaataggatgactaccacaagcctgattttgaatagtttattaaaggaaaggtgaagcatcagtttcaaattgtacaaaaggaaaaaaaacctcatattgcaaatgtacaatttacagaattactagcaaaaccaatcaaggagacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctcatggcttgctccctggccaaaaccacaggcaggcagggctggggtggacagtccagtcattcctgcaccttcacttccagtgaagcccacaattctgggagaaagtgaggccccagctcccctaactggagcccaagaattgctgaattagcagagaagatatttttggtgaccaggtttttttcagaactgtacaaatgttgagaaaaatgttttgtgtctttactaaaaggatgaataaaatcatccatcatcatcttgctttcccgcacaaaagatgatcactgggtgtgcagaattttaaaaaatgtttttcgtatttgataaaaagggaaagcctcatgattctgttgcagctactttaaaaaccagcccagaaacagctgtggatgaattggtttggaaattctgaggcttactttagaaatcagaaaggaagagagagactaagtggggtttttaaaacaatagcagcaagtcataaaagtctaggcagaatgtaactctaaaccattgtagactgtcctgaagattcataatttctttccccaaaagaattattcttaatatgcacatttaacactgaaatgtagctgtaattcaaggtaagcttaggaacttcaccctctaagcacagacttctatgcagcacatacttctataatcagtaaacttaattcacaaaattagcgcataagggtattaagtgcatgggaagtaaacacagttatgttacacttaaaattacttttgaatgattgataaaggatttcttcatgattgattatcttaagaaaatggaagtctgtgtaacttgaatttggcagggcatgaaataagtggtaaaaacagcaaactgataacttgagaatcattttcgttttactgagaatactttatttgctggtagaagttgctaaaaatgcacagaacaaataccaatagaaaatgcactgtatttgaatctccctagtctatataaaatgaacggtgtacagcatctgttggaaaaatggctgcatggacatttcttattttatgcccacttataaataaaaataaaccttttattcaagagtatataaaatctgggaattcatatccatatccacagagggtgtgtggtttttggcagagatgtactatgtcagaatttcatcttagcttgtcaatgttctgctccttcattatttgtgttccacaaaggtcaaccaaatccagtgaactccaaaacactcttcgcaattaggatgagctgcttactcataggtttaataaaaatggttagcttttaaaacataaaaaggcaaaatgttaaaacggtttttaaattgtacaacaggaaaataaagttaaaaatatgttttttttta

SEQ ID NO: 19 - DNA, 150228 bp, Homo sapiens
  source 1..150228: mol_type = genomic DNA
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaaggtgagtgggggctgcgcgacccccacccccgcacttccatccctcctccacgcgtccgggggacgcgctggccccacccgcagcggcgcggtagtggagcggctgccgggctagtggcgaggctgagggcttcacgcaggtcccgggacaggcagcgagcggaagggagcaagcggggatgccccggaacaggtggaatgcgcggggctgggggaagaggcgaggagggggcttgtccagtgcctaggagtcagggatggcggggacaggcctccagaggtcagtaaattaaaaaatagacacatagataatcgccagggatgatacgtgagaacaccggatgtggagatgcacggtgtcacgctggtgaatcaaatcaagcagcttggcccagcgcacagagggctggcaggagacacctgcagggagtcccagccgccacttcctagctgggacgtcacactaaaccctgacctctctggggctcagtttcttccttgcaaaacttgccctccagttttcctttgctattgttgggaaaagcaaatgctatcactgaaaaattaagagcaccttagaaatcgaactcaggttagaatcatttaagcaatctgacactttgatttgatttttgacttggaatttgagtgaaactggatttatttaaatccatcccatatttcttattctttgccattaaatagaaattgattgtcctcaaaacgattgtgcctcctagagttgactcacttgattttaccttgtgaaagtaaactttaacttttcagatacttgttatttttacactttaaaaagttgatttgggtgataacgtggcataggaaatttcatttccaaggatgagcagatgtttttacaaatgttatcattgagattatgattggaaattaacggtcacataaatatttatatatgttacatgaaaagaattttagaacctatggtcacatataggttctatatgtttttcctatttaaattaaatgaagacattgcagacattataggtgaaactaaagccctctctgacaccccccatacctctccccatttccttgtcttccaagaggtgtccactttcaccactttcatatttcatgtagttttccaaacattgtccatgaatttacacacacacatatgaacccacaaacatatatgtatgtttttgttggccttttaacataaatgatactgtgctgtattcctttgcaacctgtagaccagtccatgtcagtatttaagatcctcctgtttttctttttgctttgttgcacagtatttcacaatatgccaaagttaattgaaccatttccctatcagtttacatttagattattcactgtttcacattctaaaggacatttgtaatctatgtaatctgtttgtgtagctggttctaacaaaaatgcactttgcatacattaggaattcccagaccaggtatttaaatgctactaggcatgatagataaaactcagtggggattatctaccagctttaaccaggacaaataaatccaaaaaagcaaaatcctaaaggaaatgtgtgttgtggggaagcctggagaagagatccagagcagggtttgcacatgtttctgaatttagaagaacaggaatgagattgggaaggggtggaagaattgtacttatgtgaggatcagcctgaaaaagtaatgcttggggaccatgcaaactctagttataccattttcaattctgttgttacattcctttgttatttttacatgtaaacttttctgttttgagtttggccaaatcttggtgacttcttgctgaaattaatccatttgtattgtttttctcatcacttgaagtaagtctttcattaacaagttttcaggattatcatttccagtgtacctgctgggttagagagaaaatatgccagtaaaataatgaaatgtgccttcatcttgtagaaaaaggaatcacaacgttcactgataatcgggcaatgtgcaccaacatggctcccttcacagagaaactctgctgttgggcaaggctgttgaccactctgagcctcagttttctcatgtgtaaaatgagagttgaaaccccagtggggccagcaggtgaagtaaggagtaaggcaatggggtaagagagactcttcagaacctagttgttagcatgctagaattcaagcccaattgtgccagcatcacttcaagagagaagttgggaatccagtttttattagaaacttctcaaattctaaatattagcaactaagccaaaactttacaaaaacatagtgtgggccaaacaatgtataagtgagagctaaatgtaactttggagccattatattttattatttttgttctactccagttaaggatgtgtttcgctccaatttattcagttttactttagcatttctcaaaacagggaaatagcagcggtgttgactctacatgctaagtttgtttagacggggtggaactgtccacccacacaatttggactgatgtgccgagaattaaatacctctgctactttgcacaggcatccagttccaggctggctgcccagcgcatccccaggttttatagctgtcagggcccagctcacccacttgaaatagggcggcaccttgttgttgtctcaggcaatagacctgggagtggaggtatagaaagccccttctttgatttctggataaggtgatgttcacacattaagatatcatggtttatccttcttcttgccttagcattccagacagggcagcaatatgagaagcaaatgtcaaaacgtgaaaaacacctacatttggggaggatgccttctcaccgggcttcattttcaaatttaagcactttcagttaaattagaaaacaaaaagtaatggaacagacaccaacttatctatccctgagattaagcaagtattaatatactttgacttgtttgttctcagatttctacctttaggaaaaaaaaaatctgaatacagaaagtcatacacacattctttactccctcttccatcccaaaaagtttatgtatgtaatttccctgcacagttttgtgtgtgtgtgtctgttctccgtaaaaaataagtattattgttttgtggtctttcatatgtgataaatagtttcacattacacgtatctattggagcttgctttttatcactccatattatgtttttggattttatccatgttggtacatatagatatgatgtatttgtagtaatagctgctgcatagtatctagttatataaagtatgattcatttttccatctccctaaacaaagtaagcttgtctttatattttcattttataaagttgcaatgcatattttggtatatgcaccactgtgacaactagaatttgaattcctaagtggttcgtagagaaaacaaatttaaatatattaggaattgacaagttcatctgcaaaagggttgtaccaacaatgtaccagagtgcctgtttccctatgtctttggcaaagcttggtgtgcttagatgttaatggtgtgaaatgagatcttgttttgaccagtgagtttgtaaacttttttcttttttaattggccctttatatttccttcagtgtgaactgcatagtgcaactttctgtctgtttatctattgtgaactttgcctttttgttgctaattaattagaagttatttatatatttggatacaaaacttttgtcattaaagtgtatagcaaatattttattccaatctttggtttatctttgagttattggtgccttaatgtataatactgttttcactataatctcaaactgattttgttttgacattttgtcttttgtaccttgtcaaaatttttttttcctttcctgggattataggaatgttctcctacatttaaaaaaagtttcatagtttagctcttttacagttagatctcttaatcctgtaattattttctgaattatgagatctacttttatctttttccatgtagatgacaaatcgtcccaacattttcaatcaaatagtatattctttccttcttttttttcttttttttattttattattattatactttaagttttagggtacatgtgcacaatgtgcaggttagttacatatgtatacatgtgccatgctggtgtgctgcacccattaactcgtcatttagcattaggtatatctcctaaagctatccctcccgcctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccagtttcatccatgtccctacaaaggacatgaactcgtcattttttatggctgcatagtattccatggtgtatatgtgccacattttcttaatccagtctatcgttgttggatatttgggttggttccaagtctttgctattgtgaatagtgccgcaataaacatacgtgtgcatgtgtctttatagcagcatgattcataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgagagatggtatctcattgtggttttgattcgcatttctatgatagccagtgatggtgagcattttttcatgtgttttttggctgcaaaaatgtcttcttttgagaagtgtctgttcatgtcctttgcccactttttgatggggttgtttgtttttttcttataaatttgtttgagttcattgtagattctaatgttttgcagtgttatagctgcaaacgtgtataccattcatatgtggatctatttgtaaactctctattccattggtccaatatttttttgtccctccaccaataccacactgttttgatcactatgtttatattaaatctatgtctggtaggacaagtagaagatagaacagttatccctattattattattctttaaatttatgacaggtattctttcctctttgctcttctggttgaattttagcatctgcatgtcaaaggtccatcaaagatttctgtgggatgttaattggtattgcactgaacatataggtaggttaactgcttgttgttgaagtataaacacatggatggtacacagaaatgctactgatttttaatttttgatgttgggtcaagcaatattattgaattttcttatttaacagtttgtagatactcttagatttttttatgtaactagtcacattgtcagtgaatagtttttcttcctttctaatctttatgccttttttcccttgtattactgtgctgaccagctgtattaatctgttttcctgctactgataatgacatacccaagactcgataatttatgaagaaaaagaggtttaatggactcacagttctacgtggctggggaggcctcacaatcatggcaaaagagcaagggacatcttacatggtggcaggcaagagggaaagagacccaaatgaaaggggaaaccccttataaaacatcagatctcatgagccttattcagtaccacaagaaaccacccccatgattcaactatctcccaccgagtccctcccacaacacataggaattatgggagctacaattcaagatgagatttgggtggggacacagccaaaccatatcaccagcacttcagggcaatgctaaataaaagcagtaatagtatgtatttttgtctcattactgaagttaaaggaaatattttaacattttattaagtatgattttttctgtagagttttaataattgtcctcatcagtttagggagtttcactccctaatattactgtcattgttctacttaatgactggatgttaatgttatcatttatttagtctgtatctattttaagaaaatcatacattctttagtcagtcacggtagcaaattaatttatttttaaactatttaaccatccttgtattgctgtgggataaagtctagttaaaatggctcttcttaaaacatatactattattaaatgtggcactaatatggaaaagtgaattaacaaatgtagcatttaatggcttattagctgaatacccacataaagaccattcgggtcaaggaacagcacactgctagcacccagaagtcacccttgcatctgtctcagccacaatcccctttcttttccctgaaagaaactagaatctgacttctaataatcatttccttgctttttaaaatggatttatcatctaaatacttattccaagtgctgtattttggttctgcctgttctgaactttatgtatgtagattcacacgctttgagatagtgtatgtaaattcctagtgccatgctcagggtataaatgtagctaacacaggagtgggcacctgtgagagtccacctaagacatatacactgtggccatatgtttgctgacacctctaaacaggaaagttgaggtgttaaataactgacgtgtatgatggaacaaaatccacatgtgcgttgttttctggaatgaagctgttggcgtctgtcttagtctgcttgggctgccatcacaaaataccatagactgagtggcttaaacaggcacttacttctcacagttctggaggctggaaagtccaagatcagggtgccaaattgttcctggtggtgaatccgtgtgggtctgcagaaacctcagttcttgcctcctctgaagaaagaattcaactgaggggcagaaggctgaaggagagaccaaggcaagttttagagcaggagtgaaattttatgagaaagctttagagcaggaatgaaaggaaggaaagtacacttggaagagggccaagcgggcaacttgaaaggcaagtgcctcgtttcacctttaacttagggtttttatacgttggcatacttctggggtctagggtcccttctctcctgattcttcccttggggtgggctgtccgcatgcgcagtggcctgccggcgcttgagaggggagcatgcgcagtgtgttcactggagttgtatacgtgttcacttgagacattcttcctttacacttggaatgtccctggaaggtcatataccagttaaactccgccattttgcctcttaatgtgcatgcttgagcccactctcccaactcctgagatcttatcgggaagatgctgctcaccaccttcaggtgttttcatttcttgggagactgcctttccctggcactggctgcaaccaattattactttacaaagactgttcaataaccgcctgaccatcatatgatagtggcctgacattcctgatgaggcgggggccctctcctgccctgctcatgcctgactagctacctacagtaacaaaatgtctgggtgctggtaagggccctctttctggcttgcagactgctgacctctcattatatcctcacaaggtagttcggcgggggtggttggggagaaagacagagagagagctactgctctggtttcttcttctccttctccttcttcttcgtctttgtcatcttctttctcttcctcttcttcttcatcatcttcttctttcttcgtcttcttcttttttttttttttttttttttttagatggagtcttgctctgttgcccaggctaaagtgcagtggcactatcttggttcactgcaacctctgcctcctggattcaagcaattctcctgcctcaccctttccagtagctgggacttcaggcataggccaccacacccggctaatttttgtatttttagtagagatggggtttcaccatgttggccaggctgatctcagactcctgacctcaagtgatccacctgcctctgcctcccaaagggctgggattacaggcgtgaggcacagtgcctggcccggtttcttctgataagggcacagatcccatcatgaagaccccaccctcgtgacctcatctaaacctaattaccttcagaggccccacttccaaagaccattaccctatgcttacagcttcaacctaggaatttagagggacagaaactttcagtccgtaacattctgcccctggtctcaagatgtattacaaacataaagaaggccttaaaactctttaactgaaaaaatgagttagagcaaagctactaaatgaagcaaaggaagctcggtgggtaaacttaacctgtgacaatcacagtttaaaatgttagttttaatatcatttctataataaaaattctcagtgttagacatcagtgggaattaggaactattaataaaaaccttttgatacaacagaaaactctttgctcttcctagcataaaggattagacagaagcttcactttatggtgacgaaataagtacaaatctggtaagaaagcaccttactccaggttccacgttgatctcccaaaatgtaagtccctggctctgcttttctcaaagtagccatgtcagcctttccattcttccaggtgttcctcatgtaaatgctaattagggcctccgatttcaggtccatttcctaaccgagactaaattaaattctattactgcgatagttttcaacatcacacacctacaaaacttcgggtaaacatctgtttccatgctatacaatagaaatataatgtgagccatgactacaagcctcatatgtcattttaaatttaatatcttctagtagccacattaaaaaatagagatggatgaaactaattttaatatgttttatttataccaatacatctgtaatattatcattttaatatgtaatcactattgaaaacattaatgagatattttacagactttttttcctattaagtcttcaaggtctggtgtgtattttgtacttgcttccagaacatctcaattcaaatgagccacattttcaagcatctatagccatatgtagccactgtcctggacagcatatgtctatgtaagtggcatccagaggagagtaggtgatacaatccatcatgtcattctgtggagagaatagattttgtctggttatttaccataagaaataaatacttgtctaaatgaaacactttaattgaaggcaaaaaatcaggctgagttgtgcataaatatctgtgcatctttacctccagaaaattaagatagttggccttggctgcaatgtttaaatctatacaaattagcattgtaatttgacaagcattgtaattttctaagttatgtacaggaaaaattgaaaacacatcacaaaacggaaaataattggaaaaaggaatggggcaagggaaatatattgaaaaccaacacaccacaccttgcctttcattttaaactagaaatcaaattatcactagcatccagacaggtaagaggtttagtattacattggccaagtaaattccaaaaaggtctctctttttcttgtctgaaaatggtgacaacatatttatagcagacagaagtgctccatatagtgcctggtacagaatgcatatccagcgtttttagtctagtgattattattattattattattattttgagatggagtcttgctctgtcacccaggttggagtgcagtggcgcaatctcggctcactgcaagctccacctcccaggttcaagtgatcctcctgcctcagcctcccgagtagctgggattacaggcacctgccactatgcccgcctaatttttgtatttttagaagagacggggtctcaccatgttggtcaggctggtcttgaactcctgacccgaagtgatccgctcaccttggcctcccaaagtgttgggattataggcgtgagcccctgcacccggcctagcgactattattttattatcattactattcaaggccagacgctaagatagaagacataggcgctgggctaggtgctgggactcattggtaaacaaaatagtctgaatccccagccatgatggagttagaaggcagcagcccagtgaagagacaaatgtgtaacatcagattgtggtgctgcaggagaggatggggtgtggtgatggagaaggagactttttaacatttggtagaggtggtcagggaagcagactgaggctggacatggtgacaaccttgtgaagcactgagggatgtggtccaggacagggcctctcagaagtggagagaggccacacactaccaattttaccacttctgggttgtcaaagaataaaaccaggccaggcacagtggctcagccctgtaatcccagcactttgggaggccaaggtgggcagatcacctgaggtcaggagttcgaaactagcctggccaaaatggtgacaccccatctctactaaaaatacaaaattagccgggcatggcagcaggcacctgtaaccctagctactcagaaggccagggcaggagaatcgcttgaacctgggaggcaaaagttgcagtgagctgagatcacgccattgcattctagcctaggtgacagagcaagactccatctcaaaaaatgaaataaaaaaaaccaagacaaacagagcttttgaaataaagaaataacatgaaattttaaaagctgagtttatatgctgatcacaaagggaattcctggccctgaaggaatatgctgagtattttgctacaggtgaggtgggggatgggacacagggagtcagggtaccacagaggaggtgggtctgtcgtggttatgctaattgaggattgagcattgctggataaatagggtgcaataagtccacaggcctctacatggctgtctatggtataattttaatgttcatgtttaacaaatcaaaattttagcaaaagagatataatgcagtgtttttatgctattcccaagacatttgcattagtaatgaaatgacagtgtggtttgggaatcagcccacatataaaatggtgtgatggaaacattcttctttcattcctgttgacatatctctgcccgtctttcttcagtctcattgggataggtgtgaattagccaaatgtggctgtgaagcccacagcaagattgccaagctaggcccaagagcccttatcccacctgacacaggaccagcacagagaaagatgaaacccagttaaggatctggaagaagtgaggagctcctcagatgaagaggaggggaagagaaccagtctagatcaacatggcaattgctcagtctgtcccgtttaattgatttggtgccattattttgataattatttatgtacatatggaaggttaaaaatccaccccacttctagtgcttagtacatacaatatcagactatcaaaaatgtttcttgaatcttcctagggtataaaaataaatatttccacataccagcgtcggtattgtatatgtatgatatgagtgtgtacatataaatttgcacacacgtatatttaaataatattttatattctcagcattttggtattaattattgcggtgagatcatgactttaaaactcgtaaccttcagagccatttgaaacacagccatataaaaatcttttaattttctagcggtagttttagggtaagttaggagttttccagtttaatctttaagatccatgtttgttaattagattgtctctccaaactggtttcttagagaagtgatcccagtgtttaaaaatgagttcaagtgtatttagaaactttgagagatttgtcgttatgtagacaaaacagtcaggtcattggatttttttcccaccgggatattttggttgttacatgaacttctcaaggaaaaaagttccacaagtgggaagttggcaaatctgcaatattctttctctgtatcaaatgacgaagtttgtctggagagacccaaggcaacaaggccagatatttattttctttgttgaaccagaatgataggataattttatgctgtttgcttatgctgatattgggaaagctaaagaacttgcatgctggctttaaaaaaaagttatatgtgctgtacaaaatttggaaaaagtctacaagtatgaaaagaaacataaaaattaaaactatttataatcatattacccaaagaggattactggtaacatgttagtctatttccttccagatttttttttctccactctgctttttcctcctaacaacagactggtgaaaatttttgtgtcatttatttttctttcctttttttttttttttttctccagatggagtcttgctctgtaacccaggctggagtgcagtggcgccatctaggcccactgcaagctccgcctcccaggttcacaccattctcctgcctcagcctcctgagtagctgggactacaggcgcctgccaccactcccggctaatttttttttttcgtatttttaatagagacagggtttgactgtgttagccaggatggtctcaatctcctgacctcatgatccgcccgcctcggcctcccaaagtgctgggattacaggcttaagccacctcacctggcctatttttctaaatataatttttaaatgtctatagagaactttattgtagattggtaccataagttatttaagtaatgccctcttattgaacattttgatcatttccaattatgtatttagaaatacggtagtcctcccttatctgctattttgctatttgaggttttagttacctgtggtcaatgggttccaaaatattcagtagaaaatttcagaaataaacgattcataagttttaaattgtgcaccgttctgagtagcatgatgaaatctcgcaccgtcctgctgtgtcccactggggcgtgaatcatccccttttccagcagatgcacactgtctatgctccctgcccacaagtcactgagtgccctctgggttatcagagtgactgtcacagtatcgcaatgcttgtgttcaaatagctcttactttacttagcaatggttccaaacacaagacttgtaatgttggccattgggaaatgccaaggaaaagccataaagtgcatcctttaagtgaaaaagtggaagctctcaacttaataaggaaaggaaaaaattgtatgctgagattgctgagatctacggtaagaacaaatcttctattcatgaaattgtgaagaaggaaaaagaaaatcgggccgggcatgctgactcacacctggaatctcagcactttgggaggccagggcaaaaagttcactgtattacccaggcctaggagttcaagatcagcctgggtaatacaatgtgacctctctctaccaaaaatttaaaaattagccgggcatggtggcatgtgcctgcagtctcagctactcaggaggctgaggtgggaggatcgcttgagccctgcagagtggaggctacagcgagctgacagcacaccacttcactccagcctgggcaacagagtgagatccatatcaaaaaaagaaaaagaaaagaaaaaagaaatgtgtgtatactatatatagagttccatactctccgacgtttattaaagtcattttttaaatgattatgtatgcagatgctttcttaacaaatgtctgatttagatgatgaggtaatgtcattattttattttattttttttgagacagagtcactccattgcccaggctggagtgtagtggtatcatattggctcactgcaacttctgcctcccaggttcaagcaattctcatgccttagcctcctgagtagctgggattacaggcacacatcaccacatccagctaatttttgtttttgttttttttttgtatttttagtagagacagggtttcaccatgttggccaggctagtgttgaactcccaacctcaggtgacacacccacctcagcctcccaaagtgctgggtgtcattcttgatttataggtgagagactgatccaatgatgttcatcaaattagtagagaaagtgggcttataattgggatttccggttataaggatatttggtagagccttttcctttaaaaaaataaatcatcattattattattttgagacagggcctcactctgaggcccaggctagagtacagtggtgcaatcttggctcactgcagcctcaacctcccaggctcaagcaatcctccctcctcaaccttccaagtagctgggactacagatgcatgccaccacacctggctaatttttgtattttttgtagactggggtttctctattttgcccaggctagtcttgaactcatgggctcaagtgataggccggcctcagcctcccaaagtgctgggtttacaggcatgagacatcgtgcctggccacagccctttccaaccaaaaacttcccagataattaaaaatgagtgtcagatgccactgtatttaccatttaagtaattaagtaatatatgagataaatttgagttttaaaatgatgaatgcttcatgagacttaaaaaaagcatcaattaattacttttatttactgaaatattacttgactctgcaatctaaaaatagtttaacctacttccatgttgcttcccttactcaactccttgaagaagttttcacgtctcatccatctttgtggttcgagctcttaatgtcacagttggtattttattagatatccaaactaaaaagtcaataaagaattagtagttctttaatcctttgacagaagaataaaacgttattttgggacaaaacattgaatgtttcattcattcattccacaaggcagcaaatacttttccatatcttactatgtgaggggtacagtgctacacgctgggaacaaagggagataaaactcatgtggtcccttctgtcctcatggagtatgcaatcaagtgatgggcttagatacgtgtgcagagaataatagtaaaattatgcatgttataacgaggtaaatatggaaaagcaaactttgagtggagttgagaggaggaataagattgataaatgtactgaacagtgaacttgcaggcattatattaagcaaatgcgtaagtgcaacggagccagaaagtattatagtaagatttcagtggcttgaaaacattgtttatctgcaaagtaaagtgcttaaaactgttggtaatgaactcagaaagcaacaagtagagttactgggcggtgcggtgcttttactgtcttctactttatgccccagatcaagcccttgtcagcgattagtagcagtgcttcaaggtttacagacacggactagattcttattttgccatcttacgcaaaagcagatcagcaatcctttccaaaaagcaataaaaactgagaacagggcagcctctgaaatcttatgagatgaggttccaactgattggaagcaagactgcatgtcccacgcaggtgccagtgctctctaattgctgcagaaaggcagaagaatgagatgtggatttattgagtactgtctgtgcctgggactgtgcccacgaaaccgttcagagcttctactcgctgtgacctgctcaggcctttcagagacggaacattcagagcccatgtgacctgaatgagcagcatccccacaccctacaagggcagtcatgcaggcaaggacatctgaggcaccctgggatctaaaagaggcagtgcccggcagcagtaagaacccttcatcatggtccagaagaaaggcactgttgtgacagttttgggcaagtcactaaaattccaaggccactcagattcaaattcagtttctgtttcctgaatcacaagatgtggcacataaaatcttcccctcctatctcctgaaacaatacaatcgcacattttacacacagtcaagcattccacaaatgccaagtattactgagacaggaatgagattcaatatcagaaaagcaatagtccaaatgttttttatactcatttaattctccttttatttcgtgacctagtatcaacttcctggaatgcattaaggagtttcttgtttttgaaaatattattcagtgcattctttgctgctggtattttctaataacattatttgaaacatcagcagaaatggcatcctcccttaggactatcccgattaaaaaatgagcagagtatttaccttacagcatcctgtgtaaatactgacgctaaaactcagccagtgatttcatcacttttgtgatgactttatcaggtacctcaatgaaaatacctgttaatagagaaaaaatacctggtatagagatatttctgggtaacatttaatattaataatttctgcctttcttgtctttaaaatagagaactctttgacatgtatctaaaagagaaggcatggaaccagctttggtacacagcctccctcaaattccattaatgcgtagttggctgcatcagggtcggcagtataaattcattttgtgcacatttaccgagcacttatgtgtgatgcactcttttacagaaactcttgaaatatccttcagaggatgaatccttgtgaagtttcaaaatgaagccactgcaactaattattagattgaacataactattctttatacacagatcttttttccctaactatacatgtaatgcatgtcatttgtgaatatttgagatatatagataaaagtaaaaacaaaactataaaacaaaaataactcctcatattagaacctggggataaccagtgagaatattttggtatatttgcataaaagtgagatcatatggcatatggtattacgtatccggcttttttgacattatattgtattttctcacatcagtaaatatcccttaaaaatgaatgcataatatttgatgatgtttatataccataatttaacttaaagtttttatgtttttaacaaggctatgatgatttttgcctacatatctgattttttaatgacggacatatagtagaattattaattagagtaatgggtataatttttttatactgcaagttctcctttccaaataatagacacagttttaatactaatgagcaaaaacataaataaaatcaccctaaattctatcttgtaaatataactagaattaacattttgatgtatatctatcttttcttatttaatctaaaatatgatttcccataaattgaagatctaatttttaaaaaatttcccccaaatagccaattttctcagcattacttctagaataacctactgctgattccctattgatttgtctcagctcttaccaaaaatgaaccataggaatatcttggccacaaataaatatggaatttacagttattttccttgtttattggccaggagtcagccaaatgtttgatagatttaaagcctccagccacaatcagctctccacttctgtgcccctccacccactcacgacagctatgaatctggaatgaggtgggttcagagacctcccattcatgaacaccataaaacatgcacattggctcaagatcattcactcattggaagagaattttgagtcagtgcatcaaagagcaatgtcctgtttttctagaccactctactcatcccatcccctcctgattctctcattcatttttaatgacctcccagcaggggatatttgtgaataaaatctattagatttttttctaggtttcttaaaggctgatctggcttaaaccatgcatcaaaattaaaactaaattgacttccttatatcaagttgagcagtagcttgataaacattatagtgcattataatctcagaaatagattatataatagctatattattatctcagaagcaaatataatggggaaaaaacagatttgtaataaaggccttaacacccacaattattggggaaaaatgttaacaattttaatcagcctctattgaaacagaatatcaatcaaacccctcttgagctatcacacatatatccaattcaagaattatttagttacacaaatcaacatttgcaatgtgtttaatatgttctgatataaaaccagaagactaataccaactactctaacatttactaacatactgtaaatgatttacttaggagtctgttttaataaagttcaccttcacaaagcagcatttagagaagcttcccctaagtcagacttgtttttacatgtgaaactgctatgctttttcaattggataaatcactgaattgatctaaatagagtgggctgatctatgttgttataagctctttttggcctctaattttcctgtttattcaaagtaaagaaagacagtactttttgtttctaaaatcagaatggtagttcctcactctataagcaaattgaaaatgattacgttcttcatggccaccatagcaaaccatgtcccataagagatgacctcccacactctcattctggggcctccaggagaaggaggaacaagctatgagttagaataaaactaagggatgattaattcccattttgaaaaataaattagaaaaaagaaatggtgctcagggatatgtaaaagtcccaaggagcagtgcagaccagaaccagagaccagaacaaggtggtggatggaaacgaggaaaatacaaatcagagggctcattggaattgcatttgacttaagactttaggtcagaccaggcattagggggcatacaggtagaagattgactcaaacttggtggagttaccaaacttggccaaaaggactccaaaccaagatgagatagtatgtccaaggtcaacaggcaggcttatggaagccatggacaccagaaaacagagtgacatggatatctgctactttcccctgacaattattctttcctacttctggtggtagcacatcaatttcacttgagagaactactctctcctccttgcttgtcagtcccttagtcaaaagattgggcacaggacctaagccaagccagtcaagtgccctctcccaggaatttaaatcttcaactgagagtgcaaggaggttattcatcctgacagcagcgccttgcaaaaactctccatcagttcttgtaccttgattctcacaacagccctggggctgtttttttctgagttgtgtttatttaacttttcttcaatttctatgtgctgcccccatgtcattccaacaaattcctttttgatcattgcattagcctaaatcacttctgttgcttgccacctcaaaaccctggcaagacatcaggaatccagacaatagtctggccagcagaactggtggttcagcaaccttctgcctcagccaagaagcctcttatatgaacaagtgaggagagaagtaccctcaggatcaacaaatgcagaccagcaagtgcacatgggtgaaccctggctaggaaactcatctggcagttacccaagatggacaagggaatgcggagactgagttgctggttaattattgcttatcagcaaactgtgaggcacttcaacttttgcagacatatgagtgtcagccctggtaaaattaagattgactcaatcagtctctaaaagaaatgataactattgaaatatcagtccttcttgggtgaccttgagtgccagcttggtttcagcttctgccttgctcattgatgcccctcaaaaagtgataagtcttatattttgtaccaagaaagatctggtcaatatttttgctatgctactacattttggtattcacttccaagtctttctttattaatatatccttttactttttggggatcacgtttccttttccaccagcaataacttaaaatattactttactgtttcaaattactcaaaatataaaatagtgaggtatcaagttaataaaacataacaaaatttgattatgcttaaagttcatacccgaaccagataaaccaaatagagcattttaaatatatagaaagactcatctttttttcattatgcgcattttagaaaaattctctctaaacttgtgtatacattcttgacccctcctttgcatggctgcctcactggccttttttttttttttttttttttttttttgagatggagtctcactctgtcgcccaggctggagtgcagtggtgtgaacttggctcactgcaagctccgcctcccaggttcatgccattctcctgtctcagcctcccgaatagctgggactacaggcgcccgccacacgcccagctaattttttgtatttttagtggagacggggtttcaccgtgttagccaggatggtctcaatcttctgacctcgtgatctgccctcctcggcctcccaaagtgctgggattacaagcgtgagccacagcgcccggccctcactggacttttggcattaggttgcaattcttttcttaggagtggattcagtcagccaaattgtaaaaagcagaaagcttctggccaagtgcaaggtctgatcaaacaaaggatgggtggtttgaggtgctttgacacagggcttttcgcagttaccccaagtgtgagtgcacagtgctgctagacaacatgccaagatcagataaaatctctatatggaccagttaccttttagctgtatgagaagaagggcaattgtacacgttgttcttgctcttgaatataggtaagctagtcattactactaaaaaagcaatgacaactgtaggtttaagatagtgtgttcatcttcatatataaagagaatatctatttaatttgttatatagtccactgattttcccctactcccatcaccatgtagctatttggtgtaattataatccccacagaagagagaaaacattccttgtcaatagggaagaagtaaaaagagaactgaaattcagaaggaaagccttaggctactggttttcaaacttcagtgtgcatgagagggagtgtatttgaaaatgcagatttcctggcaaaatccccagggattctggctcaataagtctatggtgtggcctggaaacctgcagttgtagcatctcagttcattctgatgcaaatggtccttggaactctcatgtgaaaacattgcctcagactgaggaagaagagggaacgcctgcctctctctgggcatcaccctcttggacctggaattctagacctgtgggctactggaagtgtccagataatgaaggagtcagcatctcctacagggaaggagaactcaacagcatgggagtggacagtaatttgttaactagaatagctggttgtgtgttagtcacgccttctgtttctaaagatttgccccccacccttggggtggtgtttggagaacgggagattatttgatttggtttgatttttcgtatactttcaggcttctatcacgccctcgatcacagcactgttgaataagataacgcgcattacataatgagaagtcaaagaaaccaagaaaataaaaatcaaacagctgttgtgatggtgtgataatgatgagtgtccaataatgaggcttatgatgacaccattgtcttggatgtcccactgggaattaaggggagactctgctgtcacccttgctgcacaaggccagtgttgacagtggcatcatcatctctgctctcccgaggccaggctagtgtggggaacagctaatagtgagagcagcacaaaaggagtttgaatttggttgacctgaaattagagttacaaagttcagccagtgtcctcttcacaaggaagttcttcccttaggccaaccttggaggatgctaagtttggttttattaagggggtaagtaggctccaccatctgtagatgttaataggattgggatgccatgagggagagtgtagatcatctgtttttgagggggtattctatcacattaaatgttcttgtttcaggacaggtgaagaatagaaaaggtttttgtcttagtctgtttaggttgctctactaaaacatcataaattgggtggcttataaataacagacatttatttctcacaattctggaggctgggaattgcaatatcaaggcactggcagatttggtgtctggtgagggcctgtttcctggttcatagataatactttctcattgtgtcctcacgtggtggaaggagtgagcaaattcccttgggactctttaataagggcactgatctgcttcctggaacattcagttagaaaagagttagttgaaacagctcctcttgatggtgttctcctcactcattagagattttccagatatttttagtacacatgatgaacagtaattcatttcttctatctttgtgtgcaggaagacacactgtctttaaaagtttaaagcaccctactcaggatactagagtaatttttccatcttcttcaggaatctggattccagcaacctttcagatattgacttaccaagttgctggactgggtcttctgcaaacagaaaattggagggaggatgagggtgaggatggggagacgctgataatcacacagttgtgactaagaagagaatggttgctccagggatgcctttgaatagaaattgactttgatggtgtgatcatggcaggggagaagtacagcagcagggatgagctgtgtatgatccaaatggctctacaagctggtgtgcacatatataactagatggggtttcttgcaggggaggaagcttggggcaaagacccaagaaattgagttttctgtaagtatacacccttaataattggataaataggaagttagttcttgaggcaggtctcatagataatggaagttattttaggaatatgcaggcttattgacctcattagcccattgtcccttccacagtgggaattatagcaatgcagtagaaattctaccattcctgctccagacaaccaacgcatgtatgtcctagctcatggtttctgcctactcagcttccacatcatggtttctattcattcatgtcttctccttccagagtgtctgccttctaccttctctctgtttatctcagcttccattcccactaccaagcatctaatgccccatatctccagagggaataagattggtccagctgatcacttcatgtttgtctcgatagagctgttgagtcagggcatatcacagcacagtagacttgcctgctttggtccagtcagctgtacccaagaatacagtttataacaaacaaacagcagcccccactgttttgtttttatgagggctagaagaacaacatccccgaactactcctttaaaaaaattaaaataaatgttagtaactccagatattttctgattgttctactccagtagaaaagtatgttaaacccaaatctagcaactcttctttagaggaatcctggcttcttcactacattgttaaaggactttgtaaaaaaaaaaatcacttttagtatcaatatcagaattctttttaagtatctggagttagaaagtggtaacatttggacattgtatccttttttctaggagagttttagtctgatccgtttataagcagatatttaacactgaaaaaggaccccaaatagtctttttaaagctcagcgagccattgtgagtcattggcttaacacaaaatacttttacataacccaggccaccgagagggatatccggtcaggtcagctatttttaaagcacttctcccccactccatctcacgtaacagagttacagcagtttgcttagaaaactggctcaggttctgtggctcatggaatcaaaacccaaatgaaatgtttttaacttgtttaaaactggaaccattttcacttaaatgtgctacactaccaaatcaataactttctgaattagacacacatatatgcaagcggaatataactttttcactgacatgtatatggtattatgtgttgggcttgccatatcatttcctaattcattaactcattcaacaaatatttataaggcacttactgtgtgctaggtgctgtgttatggctgaagacatgagactgagcatgatggacctgtcctcatagcttccagtatagtaagagttatggaccaagaaatgggcaattgtaatgtcacatgataggacagggatgcaatgacagagaatgcctgccgaaggagcatatagaagggtgtcagaaaacccttcccagagaaaatgatgtccacactgagactgaaatctagccaggaaggatgggaggagagactcttccatatacagaaaacagcccatgttggcttgggattctgtttgagcaccagagagaaggtgagtgtctggagggagagaggccaggggaggaaggaaaagggagctggggagaaaggcagggctccatcctgtagtgtcataagaaggagtttgaccttgatccttagaggaatggagagcacagaaaaatcttgagcagatcagaaacatcatgagatttgtgctttggaaagagaccctggttgtggtgtgggaaatggattagaggtgagcaagagaggaggtgggtagaacacagagaagcagaggcaaggtgtggtggtgatccccgtgagacaaggaggtggccaaaaggaacacagtgaccaagagggtggaaagaagcaagcagatctgtgagttttttggtctaatcaacgtgatgtggtgatgactgatagatgactctgcaccctcccaaatttagcatcaaagaactgctcacccagagacttgtgctacattcgtgttacaagttagtatcggtaaaaagcctgtccatttcactatattagtatgcatttcttttatcaagtaagacctaaataacccagagttctaatttgcaggcttgaaattgtaagtaacctaaaactctccattcaaaatagagtaaaccattttacatatatttatttgcttccataatttaaaaatttagaagtcatggaggtttcaggtgaggctggacctagcatttcaaagatatcatcaaagaccaggtttccttcaccccttgtcttcacatgatgtctgcttcatcctaagattgctttccctcgtggtctcagccatatacttctctgtgttattctgctatgaagacaagccatttctaccagtaattcttccccccaaatcaggaagtttcctttcccagaaatcatcagagaaaaactttggagttgcatgctctaacgccataacagtggctaggtagatggatgtgcttctaccaagagaaaggaagaatgtcaggtggaaaaaaaaagaaaaaaaagcaaacatcccctgcattcagcacattccctgatgcatcttagctgcagtcactattcataaatgagttgaaaaattcatcaaacaagaatacattgagatcaattgtcatattttaaatgcaaggcacatgcaggtccctcaagagctggaggtaactcaagagagtgatgcttctcccttactgccatcttggcgtgcctgctccatgatactatatttcctctgctggctctgcaaacatgccttgaattccatttcttgcagatcctgactcccttttaaaatatggacatgcatgatgcttctcacaacagtctgtacccattcctgaggaactaaaatggaaacacttctacagtctgaagcaaacacataaatagatatgttttatatgtcatctaggaatatatacatatcagtttattatttcggatcaaaatatgtaacagaagagggactttgtgtattctttgaggttgaaatgtatcactaattaaaacaaagtgtattaattattttctattataaaagtaataggtagtctgggcatcgtggctctaatcccagcactttggggaggccaaggcaggcagattgcttgagctcaggagtttgagagcagcctggccaacatggcgaaacctcgtctctacaaaaaattaaaaaattagtcaggcctggtggcacacacctgtagtcccagctactcagaaggctgatgtgggaggatcgcttgacaccaagaggtgaaggtttcagtgagccaagaccatgccactgcactccagactgggtaacagtaatatgtcataactaatgaaaatgtgcaaaattctgaaaagttaaaaggaaaaaagcaaatcatagtttactacttaaggacaatatcattaatgtttttagcatcttcttctagcacttctattatgtatagaattttttaaaaaatagatgcaaaggttattatatatgaaattttatgtcttttttctcttaaaaatagactacataaataatacgtatatggccatggaaacaatttttgacatttaaattttctcaaccactttgctctttttggatacttggggaataacaaaatttttattattataagtaatactgctatgatcatgccaatgacactctgcttgatttggaagtacattcctcgtacacattcccagaaatggattttttttttgtaaaggacgcaaaagtttaagactgttggcatatacaaaagacctattttctgaattcagactttaggcaaaaacaaaaaatttaagtgggtgagggggcaggaagaacaataaagaaagctaagaagtgttttgaaaagcagttcacaaaatcactctttaccagccacatacaaatgttgaatggctccatccacggtgcatttgtggagctcccctgttggccattccccgcatcaaggattcaaagaacctgccaaggggctgcaatgggagattacagtgactcagcaaatcaggatgatcagatttcaaagtcggccaaataactcatcttggagacagatgtagctgaagttttacattatggcctgcaagaaactttattctaataaaagacaactgtgtttacaactactgggcatatctcaggttaccttaaatgaaaatcattttcttatttttgtaattatgaaggctaaaaataaagatttttttcataattagtttctggaacgctaataataagaagaacttagaatattacagattctcttacaaaacacaaagaccttggaataaatttggcaatttcttcaacagcagtgcccttatcaaaaacagacacttgagaattgtggaaagggaaaaaaattatcgaaggaaagtcatatttccttaaatttctctgtgaatgtgtacagtgaatttcttcatctctaaagcaaatctttaaaaaggaagaatttgctctaaattcaagcattcatttttatctctctgtgctcaagtattcatttttatctctctttgcttttgacacagagtataaacggtaattataccatccagttgcaaaacgtcattgaaaaacagatggtaaattaatcccaaacaattattactccaggttctgactatcaattttgtcttgaacagcttgtctaaacctagttatagaattgtgaagaaggctaagtttgtgtctggttgttgtctttctcccctaccattttattaaatatttaatttcttcatgtgcacataatgctttgaaatgttagatgtggtttagcacacactatcatatttgacttgctcatttcattttcctcagaccctgaccagggcaggatgaaaaccaaccttttcatctctaccctcttttcatctcagctaattgtggaatcaaatgatgctgtatacataaatgtgaacccctgtcccacccttggtattggggctttgaaagtcttcaaaccccaccacaatggtggttgtatggagatcacttgacggtctcatgtgccccaagtcctcaatctctgcaagtgtcccttgggactttgctcagtgtgtgtttgtggtagttgttgtagtgaagggtggggagaaggttaggggtgtcctggagggcagggagagaggtttcattgtcccctggggagtgagtgtgaatcatgaatgaacaatccttgacgaatcgagtcaacccaaataagagtttggaacagtgtttctcaaactttctatagtgaagaaaattttgttttgtttttacatttccattatattgtgagccaatactttcttaaaatataagaataaaaaattaaaagaaaatgaaattaaaagatataaaatataagcccaaatattttaatcagcataaaatcactctatcaaatcactctaagctttctaaatgcttactttcaatttctatatttaccttgtcataggtaagaaactgagacccatgctttgagatgcactagtttagagaaactgaataatgcaattaaaaagtttcacctgataggactaagtgcatctcctccctacaaggatacatcttcattcccagtgctcatagaatatttataaaaatggaccataatttgaccacaaagaaacaatgaaggaattctacaaattagataaacttatggaactggatgaagaatcaaaatctgtttacaatgcaataaaatttaaaacaacgacagcaaaaggcctacctatgcattttaaatctttttcctaaataactcttagtttaaggaaggactcaagatcacaatggcaggatgtttaaataaatattcatgatgcaaagattagaaataaaatcctggctgggcacggcggctcacgcctgtaatcctagcacttggggaggccgaggtgggcggatcacaaggtcaggagttggagaccatcctggccaacatgatgaaaccccatctctactaaaaatacaaaaattagccaggcgtggttgtgcatgcctgtaatcccagctacttgggaggttgaggcaggagaatctcttgaaccagggagactgaagttgcagtgagccgagattgcaccagtgcactccagcctggtgacagagtgaggcaaaagaagaaaaaagaaagaaagaaggaaggagggagggagggagggaaggaaggaaggaaggaaggaaggaaggaaggaaggaaggaaggaaggaaggggagggagggagggaaggaaaggaaggaaggaaggggagagaaggagaggagaaggagaagggaaataaggagagagggagggaggaaggaaggaaggaaggggagagaaggagaggagaaggagaagggaaataaggagagagggagggaggaaggaaggaaggaaggaaggggagagaaggagaaggagaggagaaagagaagggaaggaaggagagaagaaggaaggaaggggagagaaagagaaggagaggagaaggagaagggaagtaaggagagagggagggaggaaagaaggaaggaaggaaggaagagtcctatgggttatgttccaaagagtcttctgaagaaaatgcatacctgttatatcatcagcatcccaataagaaacccacgacacactcacaattggataatttgagaagtttatttatagagacactgtttacaaaggtgaggttcaggtaaaccgtctgagatagttcaacagacaagttatttccaccactgctccctttcctggatctaagaaagagagtggtattgagttggccacaatcaatgagggctgaggggtgaggggctgtgagggagggaccaggtgctcaaggtagccctgcagggagggagccaggaaagtagaggccctgacctcgctctgctccttccctctctctgatcttttgccagaagcctgaaagctcaggacccccttgtgggagcccctttctgtggtcctcatggtcagccccttaagacaaggagcaggcctggaaggaggagtgaaagttatctggcattgctgtgagcacattcttaataaaataaagaagataaatgcagtatgcaatcaactcaaaaaattttcttaaattcaaatataaaaaattaaagggggaaattaagcaaaaacgtaaaaagaagtgaatacaaaagaaagtagaaatgctgtaaattcataaatattgtggctaaatgtttggaaaatacttgaaaatagaaaaatactagctcttctaatcaaagaaaaatagaaacaccactgatacacaaaatgagaatatagaagagacacatacaggcaaaagtaaaaataatttgcacctgccatgctaatgaatttgaaaacatgaatgaacttaaatgatttcctgttagagtatatattaccaaaattaagagatagataatctaaataaaccaataatcttggggaaaaaagaaaattttctattaattaccctttgaggaaattcctaccctaaaattgttataagtgaatttttttcattatgtccagaaatgactgttaggctattcaacagttcggtgcatagagaaaaatgatggggtcctaacattttgtttccatttttgttattttacaaatctttataaatagattttgaacttgagcaacattaggcagaaaaataaaatcataatcccaaatcacgtaaaatcccataatcccaaatcctgaaaaaaaaatcttgaaagaaaattagcaaaataacataataaaataaaaactcagtataatcatgcattgaataacaatgatgtttcaaacaaagacacaccccacatgtacaatggtggcccataagattataatgaagctgaaaactcctatagactagtgatgtatagcagtcccaatgccacagtgcaatgcattactcctgtttatggtaatgctagtgtaaacaaagctactgcactgccagttgtataaaagtctagcacgtgcagttatgtacgatacataatacttgataatgacgataaatattttactagtttgtttaccataatatactttttattattattttagagtctatgccacatatatatatatatgtgtgtgtgtgtgtgtgtgtgtgtgtgtatgtgtgtgtgtatgctgtagaacagcctcaggcaggtccttcaggagatatccagaagaagacatttttatcataggagatgacagctccatgaattattgccctaaagaccttccaatgcaacaagaggtggagatggaagacagtagtattgatgatcccgaccgtgtataggcctaggctaatgtgtgtgtttgtgtctgtattcttaacaaaaaaagcttaaaaagttaaacaataaataaataaacaatttaaaaatagaaaaaagcttatagaataaggataaagagaaagaaaatatttctgtacagctagctgtaccatgtgtttgtggtttaggctgttattacagaggaatcaagacgttttaaaaattaaaatttataaagtaaaaaagttatagtgggctcaggttaatttattattgaagggagaaaattagtttttataaatgtagggtagcctaaatgtacagtgtatataaagtctacaggagtgtacgatagtgtcctgggccttcacattcactcaccactcactcactgactcacccatagcaacttccagtcctgcaagcttcattcatggaaaatgccctatataggtgtactatgtttttatcttttttttttttttagacagagtcttgctctgtcgcccaggctggagtgcagtggtatgatctcggctcactgcaagctccgcctcccaggttcaagtgattctcctgcctcagcctcccgagtagctgggactacaggcaccggccaccatgcctggctaattttttgtatttttagtagagacagggtttcaccgtgatagccaggatggtctcgatctcctgacctcgtgatccgcccgcctcagcctcccaaagtgctgggattacaggcgtaagccactgcgcctggccgtttttatcttttatattgcatttttaccgtatattttctatgtttagatatacaaacacgattgcgttataattgcctacaatatacaggtttatagcctaggaatcacatctgttatgtacttttgatctgaaccaataaacctacatatggttgtaggtaatatgtaaaacacagttatctatttatgtgtttgtttcagactgcaggtatactatatagcctaagcgtatagtagtaggtcatgtggtttggatgtgtccccacccaaatctcatcttgaattgtgtagctcctcccataattcccacacgttgtgagagggacccagtgggaggcgattgaatcatggggggtaggtatttatcatggtgttctcatggtagtgagtgagtctcatgagatctgatggttttagaaaggggagtttccctacacaagctttcttttgcctgctgccatgtaagatgtgcctttcgccttccgccatgattgtgaggcctccccagccacctggaactgttggtccattaaaattaaacctctttttctttataaattacccagttttgggtacggtttttttgttttgttttgttttgtttgtttgtttttttgagatggagtctcgctctgtcgcccaggttggagtgccgtggcacaatctcagctcgctgcaacctccacctccctgggtttaagcaattctcctgcctcagcatcctaaatagctgggattacaggtgtgtaccatcgagtatgtccttatcagcagcctgaaaacagactaatacagtaggctatacatctaggtttgtataagtacactctatgatgtttgcacaatgacaaaattgtctgatgacacatttctcagaacatatcctcattttaagtaacacataactgtatacttaaaaaaaaatcaccaagaccaagtagtattattccagaaatgcaaagttgtttaacacttgtatttatagaattgaccatgtttatgtcaaaagagaaagacataatcttatccctaaggttaccagaaagcatttgggaaaacttccagtcatttctcacaacacatacacacctatcttggaaaagtggaaatggaaacaagaggataagcagagtagtcaatactctctgagcccactgttctgtgccaggcatggtggtgagggttcccccacacctccatgaggtaggttacaacaattatctcatttcactgacaaggaaatggcagagaggagaagtaatgtgtaaggtgtgtctcaaggttggtgagtggtagaactgggaagtcagcctggcagtctctctctagaactctggggtgacccctccaatatattgcttctcctgccttctctgtaagttgtggaaatcgtgtttatgcagaggtgaagaacagtcaaaatgccaaatcccttggaagtggccactgtttgactcttccctcttagagaggccccgcttgccagcttgttgctctaaggactgttgcatttttctcttggttggaatagatttaattcagttctcagctatctatgtgggtcatcttctgtaagtgatagtggaggcagctaacttcctgattgtaaccactcgtgccattgaaaccaaagactggagccaagatatttgtttctgtatcaggatttaatcaagcttggatttgtgaatggccatcagagtctgattagaaccaggttcttaacctcaaatgccgattttccaaattgtagcaatacttatttaaaaattcaaatatagtatatcatttatgaagaacataaaccattctgtcagtaaagctgtgtgtcaaatgaacaaaattaagttgaatatattgttataaataccttatgttatcacttcaaatgaagcatggttagacacgtttttagacaatcacattaaataatttctttattcatccagtctttttttaaaaatgtattcatctaacaaacactccacaccatgtactactactggagaaatgaaaatgaatgggaaaaaaattccctgacctcaaggaattcccatcatggtggtaggttttaaaagtttcaaagccaattgtctatctgttacagtgaggtaagttttaacaagttgagagagaagagcctgtagaaaaggaaaagatattccatatttatgaaaaatcctcttttatttatttaaattttgaccattaaaaatcattttgattttgtattgaaggcaatggggaagcagtatagggtttttagcagggaatcaacagagatttgtacttaagaagatccttttagaggcaggatgaagtgaaggatggctggaaagggaggtgaatgaattagaaatggcagcaactgagatggccctgcggagtcacaggaattagggcaagggacgtgggacttattttccagtgcagagtaacagctgttctcactcctaaggacagattaggagcaaactgaattgaggaatgaaaaaattcaggttaggctcagaggaacatattaccagtaagtcaaggttggtaagcatggcaaggggcctttgagtgagatgtttatcacaagaaaaattccactttcttccggaggatttacctgtgtaattgcaacctcagtagttttatagcagagttagtcatgaatttccttgtctatttcacccccattcctcccccaggattgggtcatttctatctctgatactacttggcaatctttacctctgaaaattcttgcccctggcatactatcatcctagaaaataagtattttagagatttaaatataaccaggtaatcaatgccctgttgtagttcacttcggctcattcagtctgcaactaagactggatcaaacagacctaagggatttgtctctaatctgaagcattccaaagagattgatttgaaattttcctaaagtccctgaaagtcttcagcttgagaaatgacccaaggtcaggattaatcccttactttagtgtttctgcattgtcgtccataacccacaggcatcggaatcacctaagatcttaaatattgagattcttgggcccagcccagactaaacattcatatctgtggccccagccccaattcagtgaatcagaatgaagacaggttgttgggagaagggcaagttcagaagggtttgtgcttttaacatgcatagttcttgtgcatataaaaatgtaaaaacaaacaaacaaacaaaaaactagtccgaaggatggatcgtgcctcccaatgttaataggaaggctgcagcaagagcttatctttatatatgttaactcataaattatattgcatgtttactcacagtctagaaggtaccacattctgtagacatgtatggtttgacctaatcacagaaagctagaagtaggaaaaaacatagagatagctttgtccaatctaagaaaactgaagaccagaaagactgaagcttttcccaggtgcacagctgaatgctagcagagcctgactgtcaccccaccatcttatgatatttctttttgtgatctcgatgtagatggaaaagaacaggaacgaagtttgtatctttacatagtgtgtatgtgtagatacaattcgaagaagggacttttttcctttaatctacactgattttccattagaacattcttgaacatccactgtattcacaaagtttttcctgggtgccagcaacccaaagcaccacactcttccccatcatcccacgtcatgctggttctacacagagtttcaactcttgattgttcaattattggctctcatctcacttctgttctgcataaggccagcccacacaaattttccattgtcccaagtacagccatagcacatagtcgatgcctaaagaatgcatatagatgtaatagttgccctattttagaaaacaaggaaggcgctggtgcatgtttctagtgtgcattggaggcaggactcaaaaatctgctcagactcacaaagccattcatagctgactcttcagcagtacaagcagggctaaaatgttttgggtctcaattgcaaattctagaaacttatgcacagactccaaaagcaagcatcttagttctctgtgatttgtacttgtaaacttgtttctgtcataagtaacatgatgttaatttacattaaagtttatggcttcatttacatgttcaattgcatgtacaattacaattgaacaattacatgttcaattacaatgaaatgttcaattacaaatgtcagatctcctcaactctctgcttatgttttgtttggttttgctttgcatttattccaaaatgttattatgaaaatgtttaaacattcaagaacatgggaagaagtgttcttcttaaattaagtttagattagaaattatattattcacatttaattttaatgtaataatgacatgccttaagtatctttaaaaagttttgtgttaacaaatacatttattcttattaggttatgttaccttaatgactctctttttacagctaatcagctcaagaagaaagaatcaagatagtaaaagctggacagtatttacttagcatctgtgtaaaaagcaagaggagattttctgtgagaaaaacggtcttatttacaagttcatgaatagttttgaaacttttccactaaggaggaaaaaaaaattcctctgttgttaaaatgttaacagtagtttaataggagttgacatagttaggtggaatcaaaaagcaaaatgcaaaagcccaacacatgttgggtagaaaaggcaaatttgtcacatcccaggcttacattgtatttgccactgtcgtctcagtcaaaggtttttgttaaggtctgaagacgcagaaagaagaatagtagcactgtatccgtttccagttgacgttagaagaatagtagcaatgtatccgtttccagttgaccttatttcaatagactgtgaaatccaaggtgtggggtcgtgtgtttagagaaacaagtagttcattctaaaaactgagaaatacctgatgtcactatagacaccaatcagaaactaccaaatccttttcaactgtaaaacagaaaggattctgaatggaacgagagatttaaaaccatctatgggactcaagcattgcaactgtatgtgtttctcctattgaaattaattactcttgtctattggaaatggatagccagattaatttttttctaagcacctcctgatcccaaatgaagcactggtctagtttgccattacttgttttgatgtatttttcaaacaccatggaatgatgtattattaactaaagtattaaatggaaactatagcacactttaaataccaacctttaaccattaacctgaatgctggtaaaaggacttcaaatgattttccagtacactaagccctgtttagcagtttgatttcacgattggttagcaacacaaaaatccaggtgcagaattcccttccagaatatattcttgctattttatactattaagtacgggttcattagaacttgatgttttgaatgtgttgtaacattgtagggtgtcaatattagagcacaccagttctagcttgcctgtggtatgcaattcacctgtattcggagagctatgtaatttacacttgtctgtattttccttgtggctgtccccatgccttttttcatgtttcattgttcttcctaacaaatgttaccatttccaactataggtgtttcttgaagccctaaataatcatgcctgtcttattttagtatccaaagtttactaactggagtgaactgataatgctggtatgcgggtatttttttaaaatatattaatactagccgggcgcggtggctctctcctgtaatcccagcactttgggaggccgaggcgggcggatcactaggtcaggagatcgagaccatcttggctaacacggtgaaaccccgtctctacaaaaaattagccgggcgcggtggcgggcacctgtagtcccagctactcgggaggctgaggcaggagaatggtgtgaacccgggaggcagagcttgcagtgagccgagatagcgccactgcagtccggcctgggagaaagtgcgagaatccgtctctaaaaaaaaaaaatatatatatatatatatatatatatcacatatatatacacatgtgtatatatataatatgtgtatatatacatatatgtgtatctatgtgtatatatacatatgtgtatatatacatatatgtgtatatatacatatgtgtatatatgtgtatatatgtgtatatatacatatatgtgtatatatgtgtatatatgtgtatatatacatatatgtgtatatatgtgtatatatacatatgtgtatatatgtgtatatatacatatatgtgtatatatgtgtatatatacatatatgtgtatatatgtgtatatatacatatatgtgtatatatgtgtatatatgtgtatatatacatatatgtgtatatatgtgtatatatacatatatgtgtatatatgtgtatatatacatatatgtgtatatatgtgtatatgtgtgtatatatacatatatgtgtatatacacacatatatgtgtatatatgtgtatatatacatatatgtatatatacatatatgtgtatatatgtgtatatatacatatatgtgtatatatgtgtatatatacatatatgtgtatacatacatatatgtgtatatatgtgtatatatacatatatgtgtatacatacatatatgtgtatatatgtgtatacatacatatatgtgtatacatacatatatgtgtgtatatgtgtatacatacatatatgtgtgtatatatgtgtatacatatgtgtgtatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatatacactacagtagcaaagtcatttattatctcctagttttattttcagcaataatattccaaaaatatttgccacatatcaagcccattcccctaaaatataagcctcttaagcatgagaattttgtctaatgtcaattgctggattcccagctcccagaccagtaccagggcttaataaatattcattgactaacattcagcctagatagaacctgaggatgcagaagtggaaaaaatggtaagaacctttatagtatggtgctgacattaaatgaacagcactaatattaagtggcatcttaataattcgtagtagacctaaattacctggattcaactccaagaatccaagatccaccatttactagccgggtgactttaagaaaattacctagtctttctgtgcctcaattttctcatttgtaatatgcaataaggattaaataagttattagaaataatgtacttagaacaatgtctgtcacatgagcattcaataaatctaagctgctacttttagctgccacctggtactgcttctattgctcttttcttcatttccttctatttttttctctttctctatcttatgttctcactattttttcttctctttttaggcttcacacttatcctttactatagttctgccagtgactctcacaaacattgcttaaactttctgatgatgctcagggttagactccaccatatacgaagggacccgtgcaaatgatggctgaagcaggacagattgtctgggattctaaagacaggctaacagaattccttgttggcattttccttctgaatgcctctgtcttagcttaatcctattagccaacaattgcctagctggacacaagtaccaagtagccagggattttcaaattctatccccagatttgcctcagccacactttagctcttaagccgttcatgcgtagcttccatatttagtcagggaaacctaaaatattcctttactgtgtatctggatcctcagaacaaaacctgtaatgtcaagtgtgtttgtgaatatgtgtacacacataatcacaatcttccaaatgtttaatgtttccaatgtacatgactaatgactggtcatatgcgtgggcacatacataatacatgaagttgtgtgcaggtgcaacagcggtgatggaaaacaggattcgtatgtcttttccgttcatcttttacaatgggtaagtgaaaattatggcaacatttgattatattgcaaataaggagcagaagtttatttagagagaaatgtaaatgtggttactttacaaaaaaattagcatacttctatatgcaatcttgaaatcccaagagctgatatattcttttatttcatagtttaaaataatcttatctgtatattaaaaatagagactacaaaaaatgttatgaggttatgtgaggttatgcatatgttattcagctcattttggctaccctattatgtacacatatttcaaaatattaggttgtatatgaaatagtgtatatacgatattctatcaaataaaataaattaacttttgataaagatcaataataatatattgttccagattgccaatctctgcaaggtacaaacattgtgatatgtttataacataggagaatttgctttcaatgcattgagacatacaatgcttctatagtatctcatagttatagaatgaatattttatattagaaattatttttataattgtacatgatcccagacatgtaagcattttcttgataatatttatagctaaaattattattgattaaattaaaataacatggaaacaagtaaataacttcaaaaatatttatcaataatagtattacattccttcccacaatgcttaaaacccatatgactatacaacttaattcaacaaatatttttttttttgaaatcgactaagttcaaaatactctcttaaacatttcctgagctttaaatattattaagacagtctccactttcaaggaacttctggtttcttaggtataaaaagacaagggcccatgccactaaataaagcagcatgatgccaaatgtcgtaagagcagtgtcttggcaagttgatgcattgtatctggggagatcaagagcagcttagctgaggctttagggcaatggttctcaccctggactctacaaggaaaatcatctgggaaacttgcaaaaatactgatgactggggttttgattcaacacgtctggggtgtagcctgggcattagggtttttaagagttcccccaggtgattttttttttcgagatggagtctcactctgttgcccaggctgaagtgcagtggtgcgatctcagctcactgcagcctccaccaagcaggttcaagcaactctcctccctcagcctgccaagtagctgggattacaggcacccgccaccacacccggctaatttttgtattcttagtagagacagggtttcaccatgttggccaggctggtctcaactcctgacctcaagtgatccacctgccttggtctcccgtagtgctgggattacaggcctgagccactgtgccccgccccctcaggtgattctaatgtgcaaggaggttctcggaaaaattgaaaaatcatcttagactttggttctgaagatcgaatgagattttgataggctcaggtgggaactgaggagagggaaggaaggacagcaggaagagagccagctgagcagcaaaaagtgagttagtgtgggaacactgaagagtaggaggaaatggctggatccttccaaatgcggcccgtgacctcataccaagaggtatgtaacacctgagaacttgtcagaaatgcagactctcaagccctgccccagacctaatgagtccgaatctgtgtcttaaaaagactcacaggtgatttgtatgcacgtggaggttggagaagcttgggcttgatcacagggtagcaataacgacgaaaatcactgacacacactcgtatgcaggtttacatgtcttagctaagcctcataccaacccataaggaagtattctttatcatcaccccattttctagatgaagaaattgaaactcaggtttgtttgctcatctagaaagtaatggaacagagattcaaacccagacccctaactgctacaaagcacttgcactgcatacttgcactgtgtcaccacttttgtggttaagaggaagcccaggagacaccctggaatggaagaggagggctctgatatgtactccagaggaaatcctgagtcctgggctaggaagagcaggtctgtgaatgagggggccctgtcctaccctccaagccagagcccagaaaaggcaaccctatccctttccactcgtcatctcttgcctttcattccaggtttctaaactaagagaacttatctgtgccttagaaaaagagttctaggaaaacaaccaagaaagttagtaaccccacagaaatggaatacctagtcaccaaattaaaaataaaacacacactaaaaaaatgcattttagtataacataaaaataaatatatcttccaaatatttatttcttcttcacttcttgtttatttccctacattctccctcctctctctcgtagccgaaacacaggttcagtggcccactgcttgcagagtccagttaacaagagtgtggtttggtataattaaagtgactttttattctaaacctagcttacgggaaggagtacagtacaggcttcccaccttaaggatactgcttcacttttggagcagaaagcaggtgctttaaagggcaggggggtttgcaggggcagaagtgactagttaggggttcacatacgcactttggtgccttatctaccgggcattggagctggtgtcttcatgggcagaaataggttgtaaatgtggccaaaagctctccaggtgagacagagtttcacagcaggcatactttggattgtaaattgagtgttatctctcaaagcagtcccctggtgggggagagttctgctctggagcttctaagcccatagttggataaacttgccctgtagggagtgtctggtgaaggggaggtaaaaggttataattgaaggggctaagtaggaagtggggaatagggagaaatggagaaaagagaagaaaaataattaaaaaatagtaatgcattctcctcttagaaaaattggagtattggttactctctccccccgcccccccacacacacgaaaccacctttgcaaaattataactgaggaaattatgacagtgaaataaatctaacttaaccaactctattttgcttctaacccttaagctgtccttgttcattcctgggcataggccgaactgactttgggaaggaattcagttcatggtttgactctgaaacaaaattgataacagccctttcccaaaaagacccccttcttgcctggggaccagtttgcctttgcaggactaacaaattagctacaagatgagaaattacagtttcagggtcatgcggcttctggcttcaagagtccgaacctccccaaattgctcctgggggtaacatcattattgtaaaacctaagatcagtgcttgagacattttgtagaccctgcactcaatggatcagctaaccccacccagacctgtaatctggtccaacccagttgtaccaatgcactcaggaacagaagacattaagaaaacctaactccgacccatgaagattccatctccaacctgaccagtcagctctccccacttcccaagcccctacccgccaaactatctttaaaaactctgatccccaaatgttcggggagactgagttgagtaatgatgaatattccgtctcctgcacagccggctctgcgtgaattactctttctccattgcagttcccctgtcttgataaatcagttctgtctaggcagcaagaaaggtgaacccattaggcggttggttacacacacacacacacacacacacacacacacacacacacatatatacagaaggaggtaagtacaaagttctagaaagaggagcaaaaaacaaagaaagaggagggagagaaacaaaattatgctgtgtgcaaatatttcaaatatgttaaaattttcctaaagttttcatggaatttttatcttaaatggcaagagaaagaaggaagaaagaacaggaagagaatacaagttgaggaattcccaagggaaagcagaaggaaagggaagcattacaaacaaacttttggaacctcattttttgcctaagccagatgtttctgaacgacacaaaacatgacttgagaaaaagtggctctgccaaccatggtcatacatcaccagcacaatgttaattcctgttccaaacaggggtacttgaaaggtcatcccaggataatcttggggattccctaagagtatgtggcctatgttgcgtccagctggttctagatggtccaattcagatgcatctgcttttccagtggaccatctagaacatcccttcttgctcccttcactccagccagactggcccagtggccttaggtcctcagcaggcctgaaccttttacttctggactttgcttgtcatcctccctgcctggtatatcttccccaacggattccttgttttgaatcctgctatctctgttaacgcagtactagccccatctcttctgtgaagcctctgtgtccgaatcttctgggaactccacctcctctgtgttagaacattaaaagatgggacctaggctgggcacagtgactcacacctgtaatcccagcactttgggaggctgaggtgggtagatcacctgaaatcaggagttcgagaccagcctggccaatatggtgaaaccccatctctactaaaaatacaaaaaaattagctgggtgtggtggtaggtgcctgtaattccagctactctggaggttgatgcaggagaatcacttgaacctgggaggcggaggttgcagtgagctgagatcgtgccattgcgctccagcctgggcaataagagcaaaactccatctcaaaaacaaacaaacaaacaaacaaaaaagatgggacctttactctgtcctgttcagtttctttttatatggatatgttctgaccaactctcaaatgcctgatggaatgaactgggtaattgggatgttaggcaagttgcttagctttcttgtctgtaaattgggaataataatacaacacacttataagattgtaaagatctaatgagttcctgtaagtaaagttcttaatacagtgccaggcatgtagtaaaagctatctgtgttatttatgagtttacctttgggacattgttgaaccaaaccttaactgatgttaaatattgttgcagaaacaggacagaggctccaaagcatctttgtaggtgcctttaacaagcattgcaaagctatcctacattataaagtacaatcatccatgaaatgatgtacatattatatatgcacagtgtaaagaatacaaaataggctgggcatggtggctcatacctgtaatcccagcactttgggatgccaacgcaggcagatcacctgaggtcagaagttcaagaccagcctggccaacatggtgaaaccccatctctactaaaaataaaaaattagccaagtgtggtggcacgcacctgtagtcccagctactcaggaggctgagacaggagaattgtttgaacctgggaggcggaggttgcagagagccgagaccgaaccactgcacaccagcctgggtgacagagtgagactccatctcaaaaagaaaaaaagaatgcaaaataaacacccaagtacacatgtacacagcacgcatgcaagcatgcacgcaggtgcacacatatgcgttaagataaagaacataagcagtataactccagtgtaatctaccacaactgcattcccttctcacagccaccccaccaccaaatgcaattcagacttttatgttacctattttcttatttttctttgccgtgtctccccataaatacttattcccaaacaaacaaaaatatatatacatatattagtttcacctgtttggggggaactctatataaatggaatcatactgcatgcatttgttgtgacttactttttcagtgtacgtgtgttcgttttcatcttccatgttagttataaagctgtagtttttttgtttttgtttttgttttcatttttgtttgagacagagtctcactctgtcgcccaggctggagtgcagtggtgcaatctcggctcactgcaacctccgcctcccaggttcaagcgattctcctgcctcagcctcctgagtagctgggactacaggcacatgccaccacacacttctattttttgtatttttagtagagactgggtttcaccatgttggccaggatggtcttgatctcttgacctcgtgatccgcccacctcggcctcccaaagtacagggattacaagtgtgtgccactgcacgcggccccataaagctgtagtttattcattttcactgctgtataacatcccatcctatgaatgtaacaaaatttgtttttccattctaccattggggcatgcatggggtttctcagtttttactatcacaaagctactgtgaacacgtttgcacatttgtcctgatgcaagtatgtcagggtttctccagggaatacaccagggtggaattgctgtaggtttggggatgcatatacatttatctttattagcaagtgctacattcatgctggaaatcgatttacaatcttacctggaggacataggcattctggtttctccttgccttcactaacatttggtgctgtcagacttgattttatttatttatttatttatttattgagacagagtcttgctctgttgcccaggctggagtgcagtggtgcaatctcggctcactgcaacctccacctcccaggttcaagcaattctcctgcctcagcctcccaagtagctgggattacaggggtgcgccaccacgcccacctaatttttgtatttttagtagagacggggtttcaccatgttgaccaggctggtcttgaactcctgacctcactgacctcaggtgatctgcctgccttggcctcccaaagtgctaggattataggtgtgagccaccgtgcccggccagacttgatttttgcgagtctggaacccacttttagcttttgccaaaatgatgtgtgtgaaggcatacctgagtttgggataaatgtgcagtttttctgaatactcatgacattgagcatgtgtttatatgtttatggattatttgtgtatcctcttctgaaaaatgactgcacgtatcttttctgttttttttgtttttttttgtctttttcttattgattcttgggcactaattctttgttatagatattgcaaatacatcacagtttgtgacctatgacatcttctgagaaacaaattcttaaattttaatatagtagaatttatccatcttttcctttatagtttatgtttttgcatctttttaatgatatctttccctaccccaaggtcataaagataccctctgaaacttccccctaaaggttttaaaattttggcttttccatttgagtccttagttcatttggcattgaacttttatgagttagagaaactttgcattgttttctatatgaatgaccaatgcactcagcctctttatctgtcctttccccaggaatctgtagtgccaggtctgccatatatgaggtttctacatatggaggacccacttctgggttctctatgctgttccattggtacatttgtccatctgtacaccaacaccacagtatcttaattactataattttatactataagtgttggaatctagaagggcaagctccctcctgggtccctcccattgcacttccaaatacattttagaagggtgctttacattttttatgactcttggacatccccagtgcacgttattgctcttgtcttacagcaaaaagaatattcttagctctcactctgaggccacagtgtagggtgaacacccatgatttaatgaaagcagttgagaggtttcaaagtcaagacacaacattgtctttcttgactaattggagactataaacctgcttaaagccaaactaaagacccttgcactaaacatggctcttgactcaataatagccttggccgttcataaacaaacctgttttggtcaaactttggtttgacatttaaaaccttgtaaacataatagctacttcctttcatcctgacccaacttggcttcctccaaggcaaatcaaggtcacagtgctattttagggtacagtgaaaattaagtttcttaggatgccttaaatagctgaagcgtaggctgaaacataaactggaattaattaaaagagaccacatgtataagagtgtggagatccagagagggtacttaaccagcccaaggtcacacagtctgaaaaactcaagtctctttactctctgttccaattttttctattctatactaggtgttggatgactttttttggagagtaaaagagtaaatatcttaggttttgtgggctaagaggcaaggtcctcaattattctagcaattgttcccctagaaagaccaatattccttttatatctaaaaatgtaaagccattattagctcaagggtcctgcaaaaacagtggggtggactagatttccctgtaggctgtagttttcaacccaagctctacaccatatgtaagagatacgtattcttgtttccgctttttagatgattaaaaacatacatataaatggccaggcgcggtggcttacgcctgtagtcccagcactttgggaggccgaggtaggcggatcacaaggtcaggagatcaagaccagcctggtcaacatggtgaaaccccgtctctaccaaaaatacaaaaattagccaggtatggtgacaagtgcccgtaaacccagctactcgggaggctgaggcaggagaatggcgtgaacccagaagacagaacttgcagtgagccaagatcacaccactgcacacaagcccgggcgacagagcaaaactctgtctcaaaaaaaaaaaaaaaaaagaaaaagaaaaagaaaaaacaccgtacatataaagaaaattacagatcaaatattacaatgcatattaggaatcagcagaggtgaaattgtgttcccagaaacaaactaatgctatatggtatgcatttgaggattagttctgaagatagctgaagtaaattggagtccacttcattttatcctccgcatattgaaaagtctgttatgcctcaggaacttcttggtactaaatcacaaaattaagaatgatcattgatacaaaaattctcagtaatttgataatatacaatgtctgtgtggagtctaaatatgcattctgaggaaacaaggttatttatatatattataccttttctccatttaaagattaaaagtcattgttgagttattcttagatagccttcaaacccaagtatattataactgtgagtatatcagacatgctattaatttttcctgtgttatatatagagaagccttctttgatgtgaattttgtcatttgtatattctctgatttaaacgtgttgtttgtatcttaaacatcacaaatgaagttgcattttcataacagcttagcatcataaccttttctatatttcttgctttaattccaaatcactatagagtgtgcccacagttgtatctttttacatgtttttattccttaggccagagcctattaaaacacttcacaggtcctattgctatctctgggcatgttactggctttccattcttcaaatacctgtccattgtgaattataggcactagctgtgtcaaatgaaaacaatttcaaagatttgtgtgtggagaacttgagaatcgctacctagtcctttgaaatgtggtcagctggatattgttagcctccttgtcatttattttgtgtcccatattttgaagagccttctcataaactcctagggcttgacagtctgggtgtctggtttaagaactttcttatcacattattacctaagggctgcaaagggcactacttaccaactccacaaaaatgaaaagtgtctctgaaaatatttgtcttcagactgactcattcttgaatgtctgaaacgtatactggatactttttggtttgtttactcggcttagaatgtgggattaaaatgagaaattaacatcaactaaacctaaaacttagacttttctagcagtgcatttttatttttcattttgtggataggtcaagagcctaccagtctcatcatcatcattttttttttaatgaaaagtcattatcgtttttccctcattatgaaataatgtacaaccaaaaattttaaagcaattcaaaaaagtataaagtcaaataggaaaatcaccatgatccccagagtaaccatttttaatcattctatgtatttacttccagaatttctgtgcatatataggttcttacaaaaatatcatataaatctgtctgatgtttttatgagttgctgtaatattccactgtattgatatggcacaaggtatataaccacctccgtatgtgcttgttgtttttgttttttgtttgtttgttttgtttttgcacagagtctcgctctgtcgcccaggctggagtgtggtggcatgatcttggctcactgcaaactctgcctcctgggttcaagcaattctcttgcctcagcctcccgagtagctgggattacaggtgcccaccaccatgccaaactaatttttgcatttttagtagagatggggtttcaccatgttggccaggctggtctcaaactcctgacctcaggtgatccacccgcctcggcctcccaaagtgttgggattacaggggtgagccactgcaccgggcctatgtgcttgttttatgtgcagatttatcctccctcagttttccctagcatcataggtgcaggcagtgtatcatagccttagctttcactaatagatgtttgtactactcttttgatattaaaaattttccttaggataaaacaaataagagggtgtttacatgctacaacatagatgaaccttgagttccttatgctaagtgaaagaagcaagtcacaaaaagacaaatactgcacgattccatttgtatttagtacctacagtagtcaaattcatagagacagaatacagagtcgtgtttggcagggactggagggaggagagaatgagagattgctgcttaataggtacaaagtttcagttttacaagataaaaagaattctggagattaattgtgcaacaatgtgaatgtacttaacaccaatgacctgcacactaaaaaatggttaagaaggtaaatttggcaaggtgcatccttccacaattaaattttttaaaatcaaaggatgtttaaaatatgattgtatatattttattgtaaaatgtactgactgggtatataaacgccaccctttcctgtcaatttcagttatctggaagacaaacaaaaaccaggacaatactacaaagattctgcacttcatttgtagttgaggccctcagaccttaccgcatctctttattctgaatttataagtaattcaatcgagctttagttactgatttcttaattagtagcatagattaaacaattagaaatacagaagaggtatcagagagctataggtaaggaagcagcagtagaaagaaaggaaggtagaaagcctaataccacaaaaagaatcttcctccaaaaaaaaagcatacttaacaatcaaaaccatagaccatcctgcaattaaatgatataaatgcaaataaatatctctatgtatgcaacagcatcactcaacaaatatttcttaagtatcagttatgtaccaagaatcccttagggcccaaaagtgttcacagtgacagcaatattgttcaggaaaggaggattatgtcactttcagtctgtttacaaggcaggagagcctgtcatacaatcacagatggtcagagtttgggttttaatggtaaacttcagttatctagaaattgcacttctatagactctcatgtttcctcaaatcctgtgtccaaatggtatcctgtttaataattgtatatgatttagtgactgtattggtctattctcacactgctgataaagatatacccaagactgggtactttataaagaaaaagaagtttaatggactcacagctccacatggctggggaggcctcacagtcatggcagatggtgaaaggcatgtcttacatggtggcagacaagagagaatgaggaccaactgaaaggggtttccccttatgaaaccatcagctctcatgagacttatccactaccatgagaacagtatgggagaaccaccccatgattcaattatctcccactgactctctcccacaacatgtgggaattatgggagctacaattcaagatgagatttgggtggggacacagccaaaccatatcagcgaccttacctatctacatggacttgtaccaccttgctccttttgtaagcaagcaatttgtaagcacattattcaccaagcagcagtatgtgcttgttaacaaagacatattttagccacaatgttaacctgactgtagtcctgttttatttgactgtttgtaccaatagccacagtttataggtttgggctatagaaaaagctgatattgagcataacaaaataatgcatgatgtaccatcactataggatggtgggtttattaaaataaaatatctctccctttctccagggaagccgtaaattgcaaaattatcaatatgccatctagcagtttatttatcatgtgaaaatttggaagtaaaatgtgtggtttcagcaactgaattcagtagtaatgacaactgttcaagaaaaatgtgctcatacagaattcttggttaccatcacctgtgatggggcctaaatatttttctttggagaaaaagtaatgaaatttggaggccttacagttaaacattattctggacattactggttttgcttgttctgttttacaaaatgcttctgcaaacaagacagtgctggcacaagggcagaagacactctcagcattgctttaagagtcagattcatccattaaaatacacattcaaactccatataactatatatagtcacatatatagttataactatatttaactatatataaaataactatatatatagctatatatatatatatatatatagttattttaaatttgccttaatagctaaacccctttttaaggttttccaaatgcgactgctcatttgaaaaaatgtcgtgtgggccgggcgcagtggctcacgcctgtaatcgcagcactttgggaggccgagacgggtggatcacgaggtcaggagatcaagaccatcctggctaacacggtgaaaccccgtctctactaaagatacaaaaaattagccgggcgtggtggtgggcgcctgtagtcccagctattcgggtggctgaggcaggagaatggcgtgaacccgggaggaggagcttgcagtgagtggagattgtgccactgcactccagcctgggtgagggagcaagactccgtctcaaaagaagaaaagaaaaaatgtcgtgtgaaaatactgcattttttattaggatatgataatgattccatctctgtcttaggaaaactaatttaaatgcacttttgttgttgtttctgtactcttccttccaaaactaacagtgaagcaagctatcaaggtgtctgctctgttgatccaacttgaacaatcaaactctactttagcaacaagaaaaacatatttttaatattaaaagaaaagtaaagcacatattaggaaaggtggaaatagaatcatcttggagacttataaaagatatctgatgcttaacgtttagaaatcttgtgacctgaatttcaattgttttgctttctaaattattttatatttgtttatttgtattttggttgtaaaaaaagcagaattaataaaaattcttttttcatatcctttcgtatttctacaaaacagatgttgccattatgtggaatttgtcatcttccaatatacaataaaatagcctaacatgaagtctctatcctcagtcccattatttctttttttttttagacagagtctcgctctgtcccccaggctggagtgcaatggcacaatcatggctcactgcaacctccacctccaaggttcaagcgattctcctgcctcggcctcccaagtagctgggattacaggcatgcaccaccatgcccagctaattttgtattttttttttaagtagatacggaggtttctccatgttggtcaggctggtcttgaactcccaaactcaggtgatctgccatcctcggcctcccaaagtgctgggattacaggcgtgagccaccatgccaggccccttggtcccattatttctatcccatctttgccttttccatttgctctgccacctggctcctgcactcacccttctcttagagccttttccacttatgacactatacactgtgccagcggggtgggttgtttttgcagagccaatcccaaagacttttgttaattcccccttggctttcttgtctatctgcttctaagattttatttacttggtattagtcatctggatgagaagaaaaactcagtcaatcatcaaaatgtctaaaatatccaaacgtttgtattcccagagatgtagcttacattttcttatttatttttgtatgacgtctcactccagctgtcattgtatttacatgcttatctccccatagtctgtttttagtgctgtgaagcactcttgtatccttgacattttccaagtttaatttttaatcttcttttcttgtttttaccacagttatatattttatatagttaaataatttacacctatgacttatgttatctgtctagtactctgtgatttactttttcatatagtcagtatgtattgagcatcttctgtttgcatttgtaaccccagtgctgtctagaggtatcctgtcctttgaggtttaaaactacatgaaattccttgaataccatctcgacctgtaggaagtccaaattctgccccaagatttcttcaccttccctggggcctgcattttcttggtagcttttccttctgattttctgtacttgctgaagatttgaatcttacccacatctcaatttccacaatgattcttccattaatggaccagagcttcttgtttaataaggcggttttatgtgtgtgtgtgtgtgtgtgtgtgtgtgtttcagagacaaagccttttttttttttttttttttttgagacagagtctcactgtcacccaggctggagtgcagtggtgcaatctcagctcacttcagcctctgcctcccaggttcacgtgattatcctgcctcagcctcccaagtagctgggattacaggtgcccgccaccacgcccagctaatttttgtaattttattagagaccgggtttctccatgttggccagggtggtctcaaactactgacctcaagtgatccacccgcctcggcctcccaaagtgctgggattgcaggcgtgagccactgtgcccaaccagagacagagtcttgctccactgcacaggctggagtgcagtggtggagccaactgcagcctccaactcctgggcttcagcaatcctcccacctcagcctctggaatagctggaactacaggcactcaccaccatccatggctaatttattttattttattttttgtagagacagagtctcactatgttgcataggctggtctcaaattcctggcctcaagtgatccctacctcagcctcccaaagtgctgggattacaggcatgagccaccatgcctggccataaggcagttttatatgacaaagtgtattgaagatttagagataacacaggaaatttcaactacattgataatgtgctatttctgagctgggtggtagctgcaggagtatttattacattattcttgatacctttccatatatatggagaatagtttaaaatttttatgtgtcagtggagagtcctataactcagaatgaataatgattttatcttcatgttatcagaaaagaagtcagatgctctgaggagctggatgcttttgtccaatgagttgcagacagacgttattgctggaattttttattaagaacatttcaaagtcatcacccctctttgttttaccttgtccagcacaaaggaattatcaacacctgtacatgtcatgaaattaccattgcagtggtctcatcttcttcttgacctctgtcactggttcccctgtaagacagtactcttgatcttgacatcaccaatcacagttcctctccaagcaccctccagtctttccatctttgtccctaggactccaaatcccataatccttccatctcactggtacccacaattcctttatccattgctttgtcactgtctctgtgctcctggagtctcctgtcttccctcattgatgacctttatttcatggtcaaggagccatcaggaccacttttttttttttcgcattcatcctcagctctcttgcttgatcaaatccatctggaaaaaccacaaatctgcttaaatcccactgtgtctatgcagcccagtcactgcttcccctccttctttcaagtctttattccaaaaatcacctcctcaggtgagccctttcgtgaccacattatctaaatgtttacaacccacccctgacatttcacttctttctttcctgcattaatttttcttggcaattataattagttaacgtgtgtattatacatatatatttatcttatctattgttttcttccccctgttagaacataagctaccgtgtcccctgtatctagaatagtgcctggtgcatagtacataataaatgttttttgaatgaatgaataaatgataccacttctagatttgaatataaatttgaagttggacattaggaaaaaaaaagtgaaaataagtgactgagggaaaatggctttgagggtgagaaagcgtcccatcctatcactgagcacagtagatcatttaactcagcatccttgtgtttaaaatgctccttaagccaggtgcagtggtgcacctaagtagcttgtagtcccacctacttaagaggctgagatgggaggattgcttgagcccaggagtttgagaccagcctggacaacatacggagacactgtctctaataataataataataataataataataataataataataatgataatgataataaaaagctccttaagcacccttgacatacaatacccaatcttgctcctgcagtccttcagccccctgcccctgagcttgctatctttcaagcttccttgcacattttccttttctggcactgtttctgttctgcctgattcatgttcattttatacgtagtgaaagttatacatttcttggcctgttctcaggtcaacacccacctgcaggctttgtccagagagtgtcctattatcatcaaatgggcccctgaagtcatgggaggcagctaagaggacactttcctctccccaacactgtgaacttgtcccccctcctaggaatgtagagatgagtaagatgtggcttgctatgagaaacttcgtggggtggtggagaaggcatgtaaacaaataattacagtgcaattaggtacgtgttataagtcagttatgcacaaaacaaatgagggagcaactaaccaccttgcgggttgagggaggtagtctttcaagacaggtaactttgaactgctctggaatcagcaaaactcagccaagcaaggtcagaggcagtgagaagtgggcatgtcaggccaaaaaaccatgtggaaaagcacaggaatatgaaagcaagcagagggtctcagcgggcaggaatcgcacctgcagccccatgggggccaatggcctctctgctggggatataggggacacagaatacagagagcctcccacaccatgcccaggagttcagactcagcactgatggccaggtctaaatacttttaatcaaccaagtgacatcatctaattcggggaatttatttaggattgatcattaatctcaactatcctatatttttacaaataacttctgttttatttcataaatatcaaagagattggtataaaagttctggggatgaatcttagttcctttttaatacttgatatgctaaggaagttctcagagtgtggtctggggaacccctgaaactaagcccctgcaagctgcttgttttaagtaccgattctaggcctcagacctgctcactgaggatgggatctcgaggggaaaagtatggttactaaagacttcaaataattcatatacatgaaaagttgagaaccactgtcctaaggttctgttggaatatcatgaaactatacagagatagttttcttaatcacaatctgatgtgaactgatactatcaaggaagtgtgttactcataacaaatggggaaaaatatcccaaacatttacatcatatactttagaaggcaaattcaggccaggcacagtggctcatgcctataatcccagcacttcgggaggctgaggtgggcggatcacctgaggtcaggagttcaagaccagcctgaccaacatggtgagacgcccccccaactctactaaaaatacaaaagaaaaattagccgggcatgattgtaatcccagctacttgggaaattgtgatgggagaatctcttgaacctggaaggtggaggttccagtgagccgagatcatgccactgcacgccaacctgggtgacagaatgagactctgtctcaaataaataaataaacaaataaataagcaaattctggtatcagattttctccttatcctttacagagagttatagtcatgatttatctcacttatatccagccccaatcaaagtattaattagatagtgtctattgtcctccacttgtggggagaagatgttttgcatagcagtgagcaactaagccaggaatgaattcagctctaagaagttactcttctccatagtgagctcctccaagacaaagcctttaggtgtgggctctgatactccaagcaggccagactgctgggcagaaaagtcaacatgaagcagagcctctgtgctctgaagtttgcacgcaatcgctccgaacgcagtcagcttatcggtccaagggaaaattagaagttccagattccaaataagatctggactgaccttggagtaatgactatgagacagatgaactttaaggcgttttacgatcttaatattctattacttataacaatggagagtgtagctctcccaccatcagccagtggaagcgcaggtgacctctggggtttccctgtgtctgcagataactgtcagctctaagctttcttcatcagatatctcaaccattgtctttaaaattttcctatgtttattctgactttgtttttttctaccaggaagtaaaaactaagctagtagttttccaaactgaaaaaacaaacaaacaaacaaaaaattacttaaaatgaatgctgctgggcatgatagctcatgcccgtaatcccagtactttgggaggccaaggcgggtggatcacctgaggtcaggagttcaagaccagcctgtccaacatggtgaaaccctgtctctactaaaaatataaaaaattagccaggtgaggtggcggcaggcgcctgtaatcccagctagtcaggaggctgaagcaggagaatcgcttgaacccgggaggcagaggttgcagtgagccgagatcatgccattgcactccagcctgggcaacaaaagtgaaactccatctcaaagaaaaaaaaaaaatgaatgattatagtttgagaaaacaattaataaattataggactttaaatttctatttttgagatgaactgtctttttattgctctgaatgaattttcttttttgttattaatttttatgtttagaaaaagtaatctagttttgttttgttcttgtttttgacagggtttcactctgtcgcccaggctggagtgctgtggcgcgattacagctcactgtggcctcaacctcctgggctccagcgatcctcccgcctcagcatcctgagtagctggaactacaggcttgcgccaccatgcctggctaattttttttatagagacagggtcccactatgttgccccggctggtctccaacccctgggctcaagtaatcctcccaccttggcctcccaaaatgctaggataacaggtgtgagccacctggcctaaactttggttttgtaaataacattttcaaagattttttttcaaatggtcctatgaatagacaaaccaggcacatgacctaagaagtcccatccgccttaatatgcgtctccacctgccagcctgcagctcgaattttccatcacttgtggcactggtggcagctttctgtcttttttgtttgttttaagaggtaatgttttctgaaaaatgtgtcagttcccaggcggatttttaaaaattaacccattagcatcatgtctctcgataagattagtttactttcacctctcagacagaagaccctgcagcagcaggtgacaaagcaaagagtgaccaacaagagagagtggaggtgggtgtggctaatttagtggttcccagtgcagggttgcaccaggccaaagcaagtgagaaaaataagaacgaggtagagatttttttttttaatcaagtaaaatgggagctttttatcaagttcccatgttaagggaacagctttttctttcttttttttttttttttttgttgagacagatctcaccctgtctcccagactggagtgtagtgatgtaacctctgcttactgcaacctccacctcccaggttgaagcgattctcttgccttagccacccgagtacctgggactataattacactccaccatgcccggctaacttttgtatttttagtagagacagggtttcaccctgttggccaggctggtcttgaactcctgacttcaagtaatccacccgcctcggcttcccaaagtgctgggattacagtcgtgagccaccatgcccagccaggaacatattttattctgtgggcattttacttgctttatggtatcttaatttttctctggaatatgaggacagtagatgagaggtctgctgtggtttggggggtgggtgattgtgttggtttgtgtttggaggtggccattgctcttatattgaaaaatataactaagacagccctctgtttgtcttccttttaagacacatttattttattgccctgtgaagttcaaaacatgaagaacttttggactagaggatctgctgggttcttccagtccccaaattgtattccctgtgtcccccaagctctggacagaagcacagtgggagaaggggaggcacatgggggtaggcggacagaaagaagagacaggtcccagtctgccattccaaggtagaagaccatctctcactggaactcacagctgatctcttctttaagtttctattctaatgttaggtttgtttttttttttttagatggagtcttgctctgttgcccaggctggagtacagtggtgcaatctttgcttactgtaaccttcacctactaggttcaagcaattctcctgcctcagccacccaggtagctgggattataggcactcaacatcatgccaaactaatttttgtatttttagtagagacggggtttcccccagttggccaggctggccttgaactcctgacctcaggtgatctacctgcctcggcctcccaaagtgctgagattataggcatgagccaccgcacctggcctctatcttaatttttaatgcaatttttatattgccatagaaaaaatataatgaagataatttgtaccaggaatcaccaagcttttcccataaagagccacgtagtaaatattttaggctttgcaagccaagaggcaaaatgaaggctactatgcagatacctatataacaagagagaaaataaatatccacaacatttgtattgatgaaatgcaaacttatggacattgagatttaaagtttatataattttcacattacaaaatgttatttctctcttaattttgtttcaaccatgaaaaatataaaaaccagtcttagctcataggccggatggaaacaggcagagggctggatttgtcctgcaagctgctgtctgccaagtcctgcattatacagctaatttcatgagctactatgttatgtttttcactgggattttacgtcccatcatgaggggcacagtgatagggtgagagggggagaaacatacccctcctcccccagtgccttgtggccagcagagcccgtcaataatgaaatacaggccgggcacgctggctcacgcctgtaatcccagcactttgggaggccgaggtgggtggatcacttgagctcaggagtttgagaccagcctggccaacatggtgaaaccccatctctactggagaatcatttgaacctgggaggcagaggttgcagtcagccaatattgcatcactgcactccagtctgggtgacagagcaagactccatctcaaaaaaaaaaagaagaagaagaaatgcaacactgcacctgagaatatgactgaccctgggtcagactgtctcacctgaattcagatccccactccccatgttccttactatccttagcctctcaaaatcctaggtttctcatctattagatggagcttataacagtacctcccttacagaattgttgtaagatataatgagataatatgagacagccagcactgaaagtgctcaaaacatactgagatcattacagtgctgatggaagttcatttcctctaccaccatcctgatcaagggatcccgtggagcctatttttcttacatgaatagtgaagttttctcagtctttctgcattcaaaaccttttagggggtaaaaagaaaagaaaaaaaaaggaacctggagttaatgattataggtatacttaccattctctgcattgcataagacgggcaaaattttcttaccatattatttattctcaaatgtaccagagagccctcactgcaccgtctttgtcagagttagtaatctgtatgcttgctgtcatccagaaaatcaaaaacgggtggctggcttacatgtctagactagtgatgtgtctctggacgggagttgagggataggaagtggcagctgcagtgagatttctttgatgtccaagggtggtgacagcagcttcagggcggggcaggcgggggcatcccgcaaagcagtccatgggtgtcattcttcttcactggagggcatggtgccagggcacatggttggttgcttaaggcagacacgggcagaggcggccctgcagaggacagctcgtggcgtctgtctggcacggtttggctatacttggtcagctcttcttttcacacacaaaaactttcccctcaggctattggctgggcagagggactggcagggtcagtaatcataatgcaaaatcaacagacctgctcagtagggtgttaaccagctgtgaacggtgccaactccccctgctattaaaccaggctgggctgggctgggctgcgggagagagattggagaaaggcagggcaggccacgtctgtttcaccagcatgcacaggaacgagcatgctggctgttgacagtagagagagaaatagtcaagattatttggaaattatgttctggtctattaataaaaatgcatgtgcatatttcctgatccttttaacgaacaataaaaatggatgtgtttaatgagatccttcatgagttttaaggataaaaagataattgtttacagtgctagggggatataaggaattgtgagacaccgttcccacctgcagtttagggaaagtgataaaccctcaactcaggagcacctaatgatccatgtcaagtcaatgagttagtaacagcctacagtaacagccctcagtgtatcctatgaactcttctaagggcttacctgtgctaaccaatctgaccccatttcacagatgtggaaaccgagacacctgagactgcctagactcacagaggtgaggtggcagagctgggatttagacccaggaagtacgtctctggaactggtgcccttcaccctgtaccactttgcctcataagagaaagcgatgtgcaggtgagacatgggtggcacacgggcactgcgagaattgagatcaagagaagagtgtgagacccaattgatccgcactcctggaaggcttgctgcctttgtgtaatatatttgatctggcacctttcttggataagcatcaagtaccattggggtctctaaccaatattttgttaaataaaacattgtaatgtgtctgtgctcttaggcaaatgatatttggttaatcaaccaatatagtcagtgtactctaataatactattaacaaatatgagttaattcatttattgtttgttagagatagataacagcagtctctcacccttgctcttagattcaacaccagttctttggcactggacaagggacttcaagaggaaatgtcagggaggaaggtggctagtgcagactgatggaagaaaggatcaaacaatagttgtggatgtcctttggcttggaatcttgaaaaggagaaaggggagtcccccagtgactgagtccttattgagtgcagggtaccaggcaggctagtgacagcatctcaactccttacaaaaacactgcaaggtacatcctagtatctcccttgacagatgggggaacctggaaggattaagaaatttcccggccgggcgcggtggctcacgcctgtaatcccagcactgtgggaggccaaggtgagtggatcacgaggtcaggagatcgagaccatcctggctaacagggtgacaccctgtgtctactaaaaaaaatacaaaaaattagctgggcgtggtggtgggcgcctatagtcccagctactcgggagactgaggcaggagaatggcgtgaactcgggaggtggagcttgcagtgagccgagaccgtgccactgcactccagcctgggcaacagagcaagactccatctcaaaaaaaaaaaaaaaagaaatttcccaaagctccagtttgtagctacaatgctgggagtagactcaacatagatgggtccgtatatattcagtaggtccatacatacatggcctgtgatttctggaattccaaacctttttggattctctacaatgaaagtttattttgcattttaagtaaggccgtaaaacagaaatgcaactgtgaaaaagaatgatttccacaagtttaactacttaatattcaaaagtgctaaaacatcatgtaatctcgggtcatttcctgatggcaggagggggtttaaaagccataatattattattaagagctttctgttcatgacaaatgattttgtattccattaagatatgaggaaactatggggtaatttattgctggaaggagaaaaatcataaaaatgttgcttaagaaatatccattagttatgcttccttaatagttagcctttggccatcctggttttttatgtgatttaacagttgaatagtaatgaatgggttattactattaaagtaaccatagtgtttcaaaaaaatgggtccaacaatgtagatggattaaaatcaatgagaataaaaatatggactctgtatcttttaaattaaataattcatttgaatttttgaattactgaaacatttgcaaattgaaaatgtatttaagaaaagacagcattagtgagagaaattaatatcatgagtcttgagctactgtcatcaccatccaaaagtattcaagtgcccctgtgctggggtctctgcaatatcatacaggcagggcttatttctacagcagcagctgaacagcagccagagagcagccctgactataattttgagttcacacaatcaggtgcagcatctacatgtcagcaacattgtcatgtgctctgaagtcctagtcagcttaattatgtagctgcacaagcaagccacaccttgccaatttaactgagaattaaagctggaattattttggagcagttccactaacgcaggcatagaaacacagctctagacctggctctggagcctcatctgcagggcagaccacatgcaagtagatgatatggcagacatgtataactggtacatgtctgccatatcatctgagatatgtacagtcaacaagagagaacagtcaagcctttcacaatggctcttcatttatctgactgctggatggaccagaattctccatacctctgtgcaatagcagctcagagctggaggcgtccccctagtataccagcacatgtctgctataccaatcagttttcttttattttttatattatttaaacattttttgtggccacatagtaggtatatctatttatggggtacatgagatgttttgatacaggcatgcaatatgaaataagcacatcatggagaatggggcatccatcccctcaagcatttatcccttgagttacaaagtatccaattaccttttttttttctgaaacagggtctcattctgttgcccaggctggagtgcaatggcatgatcttggctcattgcaatctctgcctcctgggttcaagcaatcctcccatctcagccctctgagtagctgagactacaggtgtgcaccaccatgtccagctaaattttgtttttgttttcatttctttgtagagatggggtttctccatgttacccaggctggtctcgaactccggatctcaagtgatccacctgccttggcctcccaatgtgctgggattataggcgtgaaccctcgtgcctggctgcattctttattttaaaataattaagttattattgactataatcaccctactgtgctaccaaatagtcttattcattctaatttttttttgtacccattaatcattccacctcccatccaacccttcactacccctctaagcttctggtaaccattcttctactctttatgtccctgagttcagttgatttgatttttagatcccacacataagtgagaatatacaatgtttgtctttctgtacctggcttatttcatttaacatagtgatctccagttccatccatgtcgttgcaaatgacttgatctccttcttttttgtggctgcatagtactccattgtgtatatgtaccacatttcctttatccattcgtctgttgatggacacgtagattgcttccaaatcttagctatagtatactctggtttctcttcagattgcataaatctttcaccttttaccaaatcttagctattgtaaacagtgctacaacaaacatgggagtgcagatatctctttgatacactgatttcctttcttttgaatagatacccaatagtgggattgctggatcatatggtagtgcaatttttagttttttgaggaacctccacacagttctccatggtggttgtactaatttacattcccacaaacagtgtacaagggtccccttttctctacttcctttccagcatttgttattgactgtcatttggatataagccattttaactggggtgagatgatatctcggtgtagttttgatttgaatttctctgatgatcaatgattttgagcaccttttcatatgcctgtttgctatctgtatgtcttcttttgagaaatgtctattcaaatcttttgcccattttttgaccagatggttttaaattagccatttcactctaattcctgatggttgaaattactattttaacgaagtaatttaattaaatattaaataaataagtgattaaatatgaatgcataaaaagacatttgtttatgtaaaaataaggttgaaagatttgataaaatgaaattaagagaaaaactattcaattacatgtggctgagctagcacttaaagagttagagaaaaatatggattaatatccagaaggactctatagtcagattgttccacaagcatcttttatattttttattgtatttatttactttttatgtttttgagacagagtctagctctgtcacccaggctggagtgcagtggcacaatctcagctaactacaacctcagcctcctgggttcaagcaattctcatgcctcagcctcctgagtagctgaggttacaggcatgcaccaccaaaccctgctaatttttgtatttttagtagagacagggttcacgttgttggccaggctggtctcaaactcctgacctccagtgatccaccagccactgcctcccaaagtgctgggattacagaagtgagccaccatgcctggcccctacaagcaattggcctgttaaaaaaaaaaaattctaaaactggaatttgttgatggtgcactgtgggtgtgatttagcaggaatgatgccactgaactctaaacagcagacccattcccaaaggaacaacctggaccctgtctcactagattacagaatttgtgaacatctatatatttgaagttaactagtgttcatgtttctgtttgtttgtttttgactcttcaactttttcaattaactaataagctggtactcagctatcatatagaaattctaccttaatgtgcaaacaaaccaaatacaacaaaaactaaatattttaccactaaaagttcaagacccaaactaagggacaatatcaaaaagaaaaaatcaagaactgtgattttgatgacaataaaggaggcacctcatggcggcaggtggtgatgggaaagcagacaccaggcagggaggactcacgggaacagcacgctcacatcagagcctctcacccgactgctaagcacccaggcgggtcctatggattcttgcaactgtgatagccacttgttgacatcaggcctcaggtgttcttgggggtgaaagcactgacaaaatctctggcataaaatgatggatttgctaaaaatcaaacagtttttcattttctatggtcattgaggaccttgtataaggctgaagatctaatttaaaaactggtatcctgaagttactgtatcaacattgatttcttagttttggggataagggttgtaattggatgggggagaggcatacagaagtatctggggtacagtgtcatgttgcgtgcagtctacttttgaatgatttgggggaaagtggtgtatgtgtatgtggagagagagaaagagagaaggagagacagacagagagatggagtaggtgggacaacttaacagttggtgaacttagatgggaggagacaccagtgtttccggtactgtttgtcagctcttctgagggttgggtttaaactttttccaaaagaatttcttttaatccaagcaactaataaataattaggcttgtgttaattttaacgtgtgttaaaatagccaaagcctctggttccattttttgccattttgatcatagttgttcataattcatacatacagaaaatatctgcatcatggcaccccatcaaatagccatgcaattcataagccttcaaattggatgcaaataaaccagctgtccatccactgattcatccagtcaatccataaacacttgtttacgacatcttatatgccaaagataccagtgtgactatgactgcacaattccttctctcctgggacaaacagtcatcagaaaaaaataggcattgaatatctaactgcagaggctcaatgggagtgtataggcaaaggggaccagtctagtctggagaagatcaacaaacacttgcttaagctaagaccgaaagatttccagtagcatatggtgaatgtgactcttactccaagaaataaaattaagcctgtctcaaggcccccacaccttctcacaggttagagaattgccaatctgctcttcttccctctagccctagaggctcagaatccaggtgttgtgtggcatctgggaggcagaagaatcagaggtgatcattgcccatttgaaaacagtggccggcttcctccgtgcacacttgagcccaaggtccatgcccaggttaagcttccttacccagtatcttgtacccttgggtgaaggactcaggctttcctttcggaggccctgctgcctcttccagatgctgtgagggagtagcatgctcgggggtgggagggggcactgaggacttgcatttctgaggacttgcatttctgaggacttgcatttctgacaagtctccaggagatgctgccgtctgggaatccacactttgagttttagtagagtatacttaaaagatgtggttgaaaagagcattaaagtttaaaaacccagaaagacaagattaaaatcatttagtcaagacatgacttcatgatcccaaatatctgggaggaaaattgcaatgagttagtcttctagaaataagaaatatgcaactttgaggagactatagaatttccttctcagtcggttactttctcttcatttatttcaataggttattggggaacaggtggtgtttggttacatggataagttctttagtggtgatttctgagattttgatgcacccatcacccaaacagtgtacactgtacccagtgtgtggtctttaatccctcacccccttttacacttcccccaaagtccattgtatcattcttatgcctttgtgtacttatagcttagttcccactgctaagtgagaatatgcgacgtttagttttctattcctgagttacttcacttagaataatggtctccaattccatccaggttgctgctaatgccattatttcattccttttttttttttttttttttaatggagttttgctcttgtcacccaggcttgagtgcaatggcgcaatctcggctcactgcaatctccgcctcccaggttcaagcgattcacctgcctcagcttcccgagtagctgagattacagatgcccgccaccacatctgactaatttttgtatttttagtagagatggggttttgccatgttggccaggctagtctcgaactcctgacctcaggtgatccgcccccctgggcctcgcaaagtgctgggattgcaggcgtgagcccccgtgcccagcctatttcattcctttttatggctgagtagcattccatggtatatataccacattgtctttatccactcattgattgatgggcatctgggctggttccagatttttgcaattgcgaatagtcctgttataaatatgagtgtgcaagtgtatttttcgtataatgacttattttcctctgggtagatacccagtagttactttccattcctataaactgcagtgtatatgaacatgatgagtgtcaaatgatgaatgcctcaaaattactgtgtgctcccttcctggaatgacagcaaggcctactgcccaagactaaggaaagatattcagttaaagatactcttgtttgtgtgggtttttttgttttggttgcataagtagaattctccaccttaggaatatctagcatttctttttttattttccctactaaccatccagtatatctcctagatttgcctggcctctgccatcaacatattttctggagaaagcaaattaattttcagttaatattaacctgaagaaaaaataataaagcaaaggattaatatgtaaccatataatatgcagcatatatgtcaaaacacattttttctttttttgagacagagtctcactctgtcaccctggctggagtgcagtggcatgatctcagctcactgcaacctccacctcctgggttcaagccattctcctgcctcagcctctggagtagctggaattacaggagcccaccaccacacccagctgatttttatattttttagttgagatggggtttcatcaggttggccaggttggtctcaaactcctgacctcaagtgacctgcctgcctcggcctcccaaagtgctgggatgacaggcatgagccactgtgcccagccaaaacacattttaagtctattatttgaaactatttctttatttgttcctctgctggcagagaaaagttttaaaaatttgatgtccattggagctggaatgtgcataggtgtgagggctggggggtaagtgtgtcacagtgactagttaggtaggataaggtatgtctaactcacagctgaattttttgttttggttttggttttataagaaagaacattctgttgttcaaaatatttgagaataaaaaaagaaagaacattctgatactagcattaatgagttagtttgttctctttaaagatgtgtaatgggtattgatcctcttcccagtcttaaacattatttaagtcaaagaaaaccttaatatcacctatggaatatattgcatattaatctacacaaatatatataaggttggtgcaaaagttattgtggcttttgccattgaaagtaatggcaaaaaaattgtccaagtaatggcactaaccaaatacattgtgttctacataaaaggtacatatacatgtatacattatacatatatacacatacacatatatgaacattatgtagaacctaagaatttgccagtatttgaccactttttaactatgacagcagcaatttcttatgattcaattagatattatcctgaaaaaaaggatagctttgtcgtttccatatataaattattaggttggtacaaaggtaattaaaagtaatggcaaaaacggccattactttaacacttaaaattcccaagtacaatacaaatgatgtattcttatccgacatttctcccttatgcaacatgttctcagttttctactttattgctattcatatattgatatatttctattgatatattgctacaaggtcacctggctcctaacagatagtgtccaatactcgaagaacagagaaatgcatttgcttttaccctgccggttgggatttattcagctgtttctaaacaaaaccctttctctttccctcttcctagggttgtgtctgtaaagacaaaggccagtgcttctgtgacggggccaaaggggagaaggtaaaaacaaaccctaatactgcttgtttacactgtaaagctctagaaggtaaaactcaaccttcttctttcatcggtagcagaaagatccgcagtatgttgttccatttcccaaatccaatgttaaagtaattgtatataaacattaacctaaaaaaaaaaaaagaaaaaagtcatctaggaagcttcagataccttgtatatacaatggcaattaaattacaactctctcggtctgtaaagaataagtagcaaatgagaaaaagaaaaagaaagtttatgacaagtctccatatgtatacactatttacaatgttgctaaacacaagagaagaactgaaaacgatttgattcattcactttgacagaaaataaacattgaaattcacagatttttgtcctgcagcattggttcaagttcgccccctggtggagaaatcccacagcagcacactggttgaggcaaaacttagcagagggaagtagctccattgcagaattcaagaaaaaaaggaatgccgtgaaatctcattaattcgctccattaacttgcaatttgtgataattaagatagaggcagaactaaagtttttttctttgtttaccaaaccctttcctcagagacactaattaattgtttaacaacattgaaggatgactattttaaaatattttaagaacatatttaagctctttatctaaactaatttctatataatgtgtatgctaattataataattatacttattttaaattatttcataattcacatgtagttggatttaggttttttcttgaatctgtgaatgtattctaattcaggttcccattgagaagcactttctctgtgattctccttgcattcaagaagcatttattgagtttctattatttgcaagatgctactgtagggtgtataaaagtaactgagtagcgagaggggtctagcacattcttttatttctcttcttgttgagtgtgtgtgcacacacacaatgtaaaatagctgacttgttcttttttgttttaatttgccaattgtgtaactaaattgacccaattaaccaaatcagccggtggcctttactgttgaagagtacagtcggccctccttatccacggtttctgaatcctcagaatcaaccaatggcatactgaaaatacttcggggagggggggatataataaaaaataatacaacaattaaagataatacaaataaaaaaatgcagtataacaaccatttgcaaagcatttgcattgtattaggtattataagtcacctagagatttaaggtatatggaaggatgttctaggttatatgcaaatacgatgccattttgtataagggacttaagaatccacaggttttcgtgtggggggaaggtcctggaaccaatcccccaccgacactgagggacaaacgtaattccaagatacaaatccatggaaaaattatttgttggtagaactgtgtcaagccttgggcttaaagtactttcactcacttttactaggtactttcccctaatattatctgactccttctagaacattactgagctcacacctttttggttatgccacccttgctacctttcctgcatctcctacacaaataacagattaaattactaactcctgtgtattaaagaaagggctcagactcataacctgcctggtggcgttctttcaagctacatagtaattatgcacactccccaggcaccttcttgcacctgaccctcactgtctctccatcccacaacaaacactccactaaccttgatgcttctacctgggctttccctttcattttttattccgtctcccttaagctctgctctacatagccctaccatttgggagaaagtcaagtttctacaagaccaagagccaccactttcaagcctatagacaaatactaacaactggtagctttctggttgcctatgtagtcactcctgagtgctaattatgatttttttaatccaaggaaaaaacatgcaaagagtcaccatgaagtcataaacaagagaacataatggttattggtgtgtttattgtgggatagttgctgctctgtgtgtttctcacctcgttttggttttaacagggggagaagggctttcctggaccccccggttctcctggccagaaaggattcacaggtcctgaaggcttgcctggaccgcagggacccaaggtatgtcatcctgcaagcttggaaaatccccaacccacctaaccctcttcctgcctaccccctggctgctgcaaacctggagagaattccacatcttagccaactgctaggtgcatggtgaactcctggtttccggtattagtgggccacatagaaccgcaacctgctccaagactattgcaaatgatcatcattagcttcaagtctgtggctccagttcatctccctccctaacctacagtgtctacatctgcatctgttcctacctctattcctcctacagtgaaaactcagagctctttttgcttctattcaagacctgtccaaccacctgtgccccatctttgggattccttgttccacgaggtgcctcccctctctccggacattccaacttttcttttgttattggcttttctctttcagttcttaaacatgcaaatattttccatgataatacaaaacttcctctccatcttttaggtcttgtgaccaaaggattgctatcttctccctgactttcctttctctgtcaaacttcttaaaagaatagtcaaacatgctgcctgtagttcatctactattcagtccttagcaataatttgccttctaccacctctcctctgaaaacactccagcaaagatcaccaatgaccttcaagtggccaatgccaatacatacttttgtgtcttaatctgacctgaacccctctgcttagtttcaaattgtgtggatcgctctcctctccttgaaacacttgtctgtctttctttctgtatttctcctgtctctctatccttcccttcctttgtgggtttctcttttccttctggtcccttaaacatcccgagtctatgacccttcacactcatcacacattcttatcctaaagtctgtgatacagcaaagggctttgtttaaataaataccatagaggatttactaaataactgaataaccactggatttgctgagtactctttcctgctgtggacattagctagacttaagcctggcttctcacgcacccacacattcattcccctgactactgacctccagcaagctataaaccaactaataagctatgaaaaatgattataattgatctatacaggtcttttacaaatttcataatatattagaatatgtattagaggccagacacagtggctcatgcctgtaatcccattgctctgggaggctgaggcaggaggatcacttgagcccacgagtttgaggtcaacctgggcaacataaggagacccagtttctaccaaaaatacaaaaattagccaggtgtggtggcatatgcctgtggtctcagctactcaggaggctgaggtaggaggattgcttgagccctggaggcggaggctgcagtgagccatgatcatgctactgcactccagcctgggtaatagagcgagactccattaaaaaaatatatacgtgtgtgtatatatatatatgtattaaaataatgtatgaaatatgtaaatgataatcaaagccaaagccaacctactgcatatgtactctgtgccaggcattgggccatctatttctccctggatctcatttactcctcacatcaatcccacaaatcatgactgtggtgatttacaatgtagttcccatcattacctccactacatggatgagaaaacggacacagagcacttgagtaatttttcctgggtcacgcagctcacaggaagcaaaatcagagttcaaacctggtttgacactgtgtgtgggattttcctcaaaccaaacaattctccaactctctggatgccaactgggtacccctcaattcagttatgacattaaatacctggggttagtgcagaccccatagggtaagggctcagtcccacaagactgtccctgtttcaggactagtcataagtagtgggtcctcagttacccataatgccgtccaacttggctacaaataaatcaggggttcccatgacctcctcctctgctttgataatttgctaaagagtctcatagaactcatgggaacatttatcagtttattataagggatatgaatgagagatgaagagatacacaggagaaggtccagaagggtcccaagtgcaggagcttctgtcgccatggagttaaggtgcattaccgtcctggaacgtgaacgttcacccacccagaagctctctgaacaccatgcttcagggattcttatggaggtgtcatcatgtgggcaggatcaattataaactcaatctccagctccgctttcctcactgaagggtgcagctggagctcaaagtttcaagcttctaatcaagacttggtctttctgatgaccagcccccatctgggagcccaccaagagttgcctccttagaacaaaagacacttctatcacccaggatattccaagtgaggtcaaacaccaaatattagaacaaaagatggtctttactcccctatcactcagaatattagaagggttttaggagctctgtgtcaggaaccaaaggcacagaacaaatatgtgtttcttatgtcacatatatgatgccagaatcaaactcttgaaaccacacccacagcttacatgtaaaatgcaaaatcttgctgttttccagtaatcctgccatttccctgtctaccatatccatgtatgtgttctttttgtccatttctccttcttccgatcctaattttgaaaaagtcatccagattctgggcagaaactgaacactgacttcctctaaggcatggacccaggttttcttccatttctattggtagaacgagtttgccacttcaaccctggacttagatcagcctaatgccaattccgtttttaaaaaaattgttatctgtagcctactctgtttaattctcttcagcatttctttagagatgctgaaattcattaaaatagtcacaaacacatggcacttagtatgggttacatgagtgcaggcattccagaagattaatccagaaaacctgagtaccatgttgtcatagattgatattttaaagcatgtaaggcttacagatatgtatgaatagctacaaaagataatacaatcaaaggcagacaattagagaatattaaaacctgaccaaaaagatgttttagatttacaagattcctatcttaattttaaatgttttctgcatgaaaaaagtttacaatgagaaagtaaaacctgcaagtaaaaccttctgctttcggcatcacgtgaatagaattctgtgggaaggggaatggccttgaacacagccatgcaccccggaattccgccatagatgggagagactgactttggccttgacagtgcaatctcagaggattctgtaacaacccttttctcaaataataacaataaaattaaaaatcaaaacatactgaaactctctggaatgatgaaaatggcttttggacaatgaaactttcacaccacgtggcctagctgaaacagtcaccatttaagcttattctccaagaaataggacgtcgaaactgaatgcattacatgcccaaagcaagtttatctctggttcaggcagtccttacttggctatatatttccttgtgcatgtcaggcacattttgttaatagagtgtttcttgtgcacagaaatactggctggcattctcatccacaactgtagttgtgtcattcatttttatcagacctcagcagctgtgaggctaattaggacttttgcacagactttaatgtgcacaagaatcactaaagaatcatgttaaacatgcagattctcggtcaatagtctgggaggtgaggcagatctaagattctacatttctgataagcttccaggtaatgctaatgctgcaggccccaaaccccactttgagtagcaagggtttgaatgaatttttgtcttttctgataaacaattatcaagttccaatgaaataagcaagcaattgaatcttattaacaatgaaataatcagaagggcaaaacagcttggcatgtgactgagactgggtttgatgtatgggtttcttagtgccaaataattttcagagtgtttactttttcttttttcacttgaatctagggctttccaggacttccaggactcacgggttccaaaggtgtaagggttagtagtccaaccagtccaccctgatcgttaaaagatcagcttttcacagtaagagttatacaaatgtcagaaaggagtacactgtgtatggttccatagatgaagttcaagaacaggtaatactaatctgtaatggtagatgtcaaaggagtggttaccacattaggggcaagtgttaaactgaccaagaaaggccatgaaggaacctctggagtgataaagatgctctgtgtctgatgagatgatggtatataaaactgcacataggtcaacctttgttaagctgttcaattaagctgttctcaaaagattggagcacttcattgcatgcaaattgtaccttaggaatcgatccaaaaaagccaaaaataatcttaatgatatctttttaagagttacataaatgtgagatttacaaaagtttgttaaacctttagtatttgttttcccaatcgtttcgagctattcccagttatagtggaggaaaaagattatcgcaatggtaaataaatttatgtttatagattgaacatttttaaagttttttttttttgccaccccctcctttttcctatgtcttcagggaataagtggattgccaggattttctggttctcctggacttccagtaagtaatgggaaaaatccgtagctagaaaatttaaaagtaagctcattttaataaagatgttaaaacagtcgtgcaagaaaatgtgttctgatgcatttgttacatgaagaaaatagcaccttaggatggtatattatactagtgtgtggatttatatgacatatgagtcaaaatgtacttcctgaaatacaagcaggacaggataggatagggtaggataattagtaaattatatggtaagtcggccctccatatccagtgattccacatccatggattcaaccaaccaactgtagatcaaaaatatttaaaaaaaaacaataaaaattgtacaaacctaaaaaccattacactataacaactatttacatagaattcacattgtattaggtattataagtaatctagaaatgactttaagcatacaggaggatatgtataagtcatgtgcaaatacggtaccattctatataagagacttgagtatctatggattttggtattcataggggtcctggaactaacccccacaggtgctgaaggaaactatatgttacaagctgatagaataggataggatagggtagaatgaaatgattgtatttaatagcacagaataataaaatagtttcatctgtgcacactttcctcttctttttcccttcctttctccccagcttaaaacagcatgttaaaggactcttttattttatggataaaaggcgtttgctttatttgaaatatccacatctcatttgataagtcttcatatcagtcagcctgtttagtttgttgctactgaaattatatgtaaaaccacaatgtacatttactacttaaccatttaaacaatcatttatatttcaagagctatttaaatcagtgcatcttttcccttgggttcagtgctgtttcttgggatgaccctcctcattgagacttgttcttcttccagggcaccccaggcaataccgggccttacggacttgtcggtgtaccaggatgcagtggttctaaggtaagtacttttcacacagaagatgattaataaatgctttgctgaatgattaaatcaaggtgaaatggcaatgaaaggcagacaggcttcccttgaaaacattcctttaggccagaaccaacagcataatttggaggcaggaaacttcccattttctttcttcgcattccttgctttctaattgtcttttaaggaaagttctcccacagaaagaaaacttggagctcaactggttgttttcatctgaggctgtgtgtataaatcagaaaccaaagctttgagtgcagaattagttttggggaaggaatgactgagcttttcactgttcactcacctccttttgttttcgaactgagctctccttttctccagaatggtggccatgaatgaactaattactcaagtttgaaggaaacagcaattaaaaagttcttggcgcaattagactttgccatttatgcacaatttgagaaacagtattctaatcctgtttttaattaagataatggttttttggtcttcagcctcatgacccagtagccataaggaattcgggttactttgtctagatttaccattgcaaggttggaagcgagaaacaggaaaaatatctgaataggctcttctagaacaactaagaataataagaaactttgtatgtcttttagggtgagcaggggtttccaggactcccagggacactgggctacccagggatcccggtaggtttgcatgcctaattccccaacaaagacataaagtataaataacagtggtctactccatatggccatatacacaaatccgtcatgactttagggaagtctggggtagccatagtagacattcaactaatagttagggaatggatgaatacatgcattatgagtgtaggattagaggttgaggctttgttttacttttgagacatccaagtggagatgcatgagaggtacttggattcactcagagaagaggttccagctggtggtgactcaaggagtcagagtgaggagaaaaggggcttagaactgagacttagctccagcagtgatgttgagatcaaggagaatgatcctgtaaaggaggagcagccctggtgggagaaagaaaaccagcagaggtgtattatggaggcccaggaaacacctattgtagtagaagggagtggcagacagctgctggatgctgctgcaaagtccagtcagaggagtactgacatgttggcattggttttagcaacatcaatatcatgtctgaccttagcaagggacaattccacggcaggatggagcagggggcagatttggaactgaggaatgggtgggaaatgaacaaaatgggaagttcacaggtgagacgaaggagagacaggacaatatggtgggaagtaaaagattaagggaagactttgctttgtaaggccgtgggaggtgtacagtggggagaggatacacaatagcagagagggcagagcagaccgagtaggagtgtgtgcgtttgatattcctctagttgttcataggttgcttttttcctagggtgctgctggtttgaaaggacaaaaggtaagtcattggtggaatgctgtcactgaaaatctctaactgtacatatgaaaaggacgtctattaaataatgagacttaagtcattacaaataagatttcataatccagaccttaatcattcagaaacaataataatcgggacatgatatttattcctattaaatagctccttctggctcttgtcataaagagtcttaaggatacaggttttgtatcactgttgaaagaaatagggtcttggagaagaaaactgacctcatgctcagggccccacattctagggcagggattgtcactatttttggtatcttgggaaatgttttattacccctgcgtctttcttctttccactgtaaattttttatttttttgagatggagtcttgctctgttgcccaggctggagtacagtggcacgatctcagctcactgcaacctccacctcctgggctcaagcgtttcttctgtctcagtctcccaagtaactgggattacaagtgcatgccaccacgcccagctaattcttgtatttttagtagaaatggggttttgccatgttggccaggctggtcttgaactcctgacctcgggtgatctgcccgttttgatctcccaaagtgctgggattacaggcatgtgccactgtactgggcccactgtaaatttttgattttagaaaatatgaaaatgctttgaattcttcataatggaataattacaaaatcataaatcatttctctgagtacataacttgaaaagcatttttatctttgaagaaatataactttgaataagcacttgaaggggttttgaaaatataacattgatgatgtttgatgaacttcttcattttcaagggtgctcctgctaaagaagaagatatagaacttgatgcaaaaggcgaccccgggttgccaggggctccaggaccccaggtacagcacttcagagaaggtccctattattctcagtttttcactctctctctctcttttcgcctctctttacttcgtctctcttttcccccataagtccctctcactctcttaagaagattttaaatagaaattcctatttattctatttacatgtctggcctcatttcattctaaagctttcaccctattctggaaaactacatgatgctgatatgcaaagatgatttgagtatgtttttcgtcctcttcttcactctcagtcaccaagcttgcctgaatctaacaggaatagttatgtaccacttaatttgtatttgttgaaaataagggtagctttgtatcacacattgagtatcatttaaatctgtaattttaaataacagccctattttaaaatttgcataatgataaataaaaggtttttatttaaatgcaactctctccagttgaagttgagataataaagaaaagaaaggtttttgtttaaatgcaactctctccagttgaagtgtttgcttttctgatttatatgtacgtagcctgagtatgatccaaaagggatacaaagagacacaactgcctttggggctgtgtgtgctttcctttgtgattcaaaaagaccctttcatagacctaaaccacaagtgctaactttcaggttataattatatataaccaaaattagctagtatatatatatatatatatttttttttttttttttttttttgagaaggagtctggctctgtcgcccaggctggagtgcagtggtgcaatcttgggtcactgcaaccaccacctcccggattcaagcaattctcctgcctcagcctcctgagtagctgggactacacgcatgggccaccatgccctgctaatttttgtatttttagtagagatggggtttcaccatgttggccaggctggtctcgagctcccgacctcaggtgatccaccaacttcagcctcccaaagtgctgggattacaggcataagccaacacgcccagccaattaaccagaattattttaacttagttcagaattatatgtaaaaattcctgggtagagatgggatatttgcctaagtgagtttgaggtgaggctgttgaaatcctgtatggtgcgctatcctaactgaggatgtgaagttagattaggagctgcaaaaaatgcagaatgatgcaattaggagccattataggcttctgaaaagagatgcaagatatgatggctctcgcttttttgcttagaaaacatttaagagtccagatgctgaaggcaggggatccaggaagaagagataatagtaatctgagatattgatacattctttaaatgtgtattgattatcgtatatgtattagtcattgtgatgatgctgaagatataatgatggtacatttgattacacaagaaatattttttacctgccaattatgtgctaggggctatttctaggctctaggaatacagtagggcataaatcagccaaaatatagatttaaggctgggcacagtgctcacacctgtaatcccagcactttgggaggccaaggcaggaggatcacttgaggtcaggagtttgagaccagcctggccaacacgctgaaactccatctctactaaagacacaaaaattagccaggtgtggtggcgtgcgcctgtagttccagctacttgggaggctgaggcaggagaatcacttgaacccgggaggcagaggctgcagtgagcagagatcgtaccactgcactccagcctgaggacagaatgagactctgtctcaaaaaaataggtagatagataaaagatgatagatagatagatagatagatagatagatagatagatagatagatatttaaaaattgtatgaaccaggcatggtggcatgtgcctgtagtcccagctacttgggaaagctgagacaggaaggtctcttgagcctagttataggccagcctgggcaacacagcaagacccagtctcttaaaatatatatatatattgccttcatagagcttacattctcatgggggaaacaaaagcgtgtaaatgagtaactctatggtgtgtgagtaataaatgctaaaagtaaaaataatgcacgaaagcaggataggaagtgtctgggttggaaggtgggttacaactttggataagcaggaaggctttatggaaaggatgacaattgcataaagacaagaaaaggaaaagggagtgagttatactgatacctgggaaaaggggattctaggcagagggagagcaggtggcaggccctaacgtaggagcatgcttggccaaaatgagagagaaaggaaaagggagaagaaaagaggtgggaagaaagagaaaagcaaaattttgaaacgtctgaagtaaagcaactactttggtcattttagaaatgttatcgtccagttggtcctgccagcctgttacacatggcaacactttttgatgtttgttatcattagctgcagccactgaaaggggaggtgttatgctcttctgattttattaaaatattttaatgcatttaattaatggacattgttattaagtgagaagtaaatttaaacttactcttattcttctctcaatttcaagggtttgccaggccctccaggttttcctgggcctgttggcccacctggtcctccgggattctttgtgagtatcaagtcatccttgctacagactctgtcaactaatagattcattatttattattaaaaagttattaaaagaatttttctggttggatgcatttcctgctgtgattttcatttgtggatttttctagggctttccaggagccatgggacctagaggacctaaggtagactacagttcatatgatgtaacagctagcacaccctactcaatctcaaagccaaacctggtctgcttcttcatgtgggtcactgttaggcacctctctggaactcacaaggatccctagcagggaagagcatggctagctgctctcacctcttttctccttgcatttcagtaccttgatccctgatacaaagaatcttaattcaatttataagaagctacttatcacgaaaaaaggcaaggattcttaatccacaggttttccatttctgatcatctcacacagcacattatcctctgagtttttgtagtgtgctgcttcacaaagccaacctggtcttatgctagtaagtaaaagatgactatttgtgtgctcattacacagggtcttgcatgcatttctgttaagaccagcccaggcgcattggttcacacctgtaagcccagcactttgggaggccaaggtgggtggatcacttgaggtcaggagttcgaggccagcctggccaatgtgatgaaatcccatctctactaaaaatacaaaaattagccgggcatggtggtgcatgcctgtaatcccagctactcagggggctgaggcaggaaaatcgcttgaacctgggagttggagtttgcagtgagccaagatagcaccactgcactccagcctgggtgacagaaagaggcaccatctcaaaaaaaaaaaaaaaaaaaaaaacagaagtgcaattgttagtttaactataaaaatgttgagtgaggctgagccccaacaggaaattggtcctaaacacagtatctcctactatcaggtagccttttattttattctttctttctttttttttttttttttttgagatggagtctcactctgttgcccaggctggagtgtagtggtgcgatctcggctcactgcaacctccatctcccgggttcaagcaattctcctgcctcagcctcccgactaagtggaattacaggtgtgcatcaccactcccagctaatgcttttgtatttttggtagagacagggtcttaccatgttggccaggctggtctcaaactcccgacctcaggtgatccgcccgcctcagcctcccaaagtgctggaattacaggcatgagccactatgcccggcttgggtagccttttatatgaggtattttccaagatactttcatatttattatctcattgatacacacaaatgcacacacacacacacacacacacacacacacacactcatgcatgcacgcaccctgagagatggataggttctggttaagtgaattttccaatagacagtacatggcagagctgaggtttaaagtgttttgatctagctttggtctaacaaggggaagatctgcatactcagtggtgaaaaagcaagcagatatgagttgaaatgatggatcagccatcattagtgaagaaactattcgcattagactcatgtcactaaattactagtgaagtcggtagctggaattctattcttagattctctattaagtattgaatttcagaatcctgaaatgcagctacccattcttatttttaaaacaagaaaacaagagcatcaggaagttaagtagccggccagtgggattaaaactagctaatgcagagccagaaaaatatgctctgagctgggctcctttccctcccccacaccactgcatgtcagcatttgccatgttaggtaaatcccttaagctttctgcaccttaagagctcctcctttaaaagaaacatatcaatgctcttctctaagaaatagctaaaatatgtatcattctaaaatgaaagttaaaatataaatgctcccttacaaatattggaactttgatgggtttagactatttattcatatttatttttagaaaataatttggttttgtgttttcttacagggtcacatgggtgaaagagtgataggacataaaggagagcgggtaatttaaatactatgttttattagcaggcgagatattttatgtcccagagcatatcagcctataccgtttacttacgggccaagctgaaattgatgggccttcatttgttctatcttcccgtataagcactaaaggggaaaagtagacctttcaaacgtagtaacattgaaatgttgatgctgttgtttattttctcactcctgagtgtttttgtctttagggtgtgaaagggttaacaggacccccgggaccaccaggaacagttattgtgaccctaactggcccagataacagaacggtaactctgcgattttatgattagtgttgtgccttcccgtgtctaggatgaagtccttgtgaccctgcacctcttttacaagctcttgttatctaagtccagctcagcccagctccctcagccagccagaacctccaggattgattccttcccgtcctttactcataaatcctggaaatattacatggggaagatctgaggctccagcttgggcaacagagtgagacttcatttaaaaaaaaaaacaacaaaaaaaagatacttaaaaaaaagcttgcaggtagtttcagtgagttcgcaggtataaaatttgaaatgtgagaaatggaaggtgtattgggttgtgttaacacgaggcacattcatagtttgtaaacccagtttattgaacagatagaggatttgtcccactgttgaatcagtgaaatctcatttcatccatttgtaacaatgttgaactgtttctttggcaggacctcaagggggaaaagggagacaagggagcaatgggcgagcctggacctcctggaccctcagtaggttatttaaagttatattgtccccataacacataaagtagagccttagtatttactttgatgtgtgttttgtcttaagttgtttttttttttaaagaaagtaaaggaataaaagaatggctactccacaggcagagcagctattgcttttaagtcttaatattggctaaaatacaataacatttgaccgcagagatcatgaatacactagagttattttacggccactcctagctgaaatccttgcactgctgtacatgcacccaatgccacccatcctatgacttatcttcagcatcagcttttttagcatctgttttttaattactattcatcaataagatttctctcttagatggctcagcactgaaacatgtttttaaatggcagaataaccaaaagggacaaattaataaaaatcaatgtaagtaaaaaaatcagtaattcataaaatttgacatggctctaattaatacagggactgcctggagaatcatatggatctgaaaagggtgctcctggagaccctggcctgcaggtaaatttggaaattcggtgtcatgtgcagttttgattagtcaggacttgggactctttaggttacaggaacaagatgcccaactcaaactagctcaagctaaaaatttctgttctttaagatttgggaggcaggatttacttactcaagtatctaagacgttcaaggctaaaacagggttcaaggacttcagagcctgaaaacataagggcaggactccctctccatctcacttctgcttctctctgcatatcagcctcattctctcctctggcagatgatcttccatgtcaggggagatggggagaaagagctaccctgcagcagacaacttcaggctaatggcattagaggagaaagagagcatatttctccctgtgtccatttataaaatcccagggaattcatctcattggcccagcttggtcatatctggtctcactctggataaaaggcagtgaccaagagaaaagggtactataattggccaggccagtggggcagtgggctactgagactgacagtgccatcagaaccacccagagggagggaagagcagcccccacaaaggaaatagggcaatctgtgaccagaagtgggcagctggaaaaacggaagcagcaggggcccccactaccccacccagatccattttggaaagatttaaatccatatattgtgttaaatctctaaaagttatacatttggaaaagtaaaatctacaaaacttatacataagcaaagaatgtattttttggcctgagaaaaaatattcaatgaacatgatttttaaattttatcaggaagggcaaataccataaaagtcaatccaaactgccggttgagataccacactatatcttttatacatatatttaaatataggcagacctggggtccaaggaattaccaatatttcaaataaataaataaatggactgtaaacaccttcctttttctaggcttccttatttacttctctgcccagtgtgtgtgtgttttttttttcccttccaagtttagaatgaacagcatcagctctaatttaagtttggctgttaatgtccttccttccttctctgactttctccagtttcccattctgactggcttctgctttccctggaaagagagggccattgtgtattctgtggttaatagtttttccttctaacacctgggtgaagatctttactcaggcttttcatgcctgaggtcaagaggagatgatcatatcacttaagatttccgtatttgtaaagttagccatatttattacatttcatgtttttgatttgtttttgctgtagggaaaacccggaaaagatggtgttcctggcttccctggaagtgaggtatagagttgatttggcctatggaggtagtaaaaatgtcagtcctactagctgaagaaggattttttaaaatcactaaatagttataaacaaacaaaaagcttacagcttttaaaaactgcatttgggaatcatagttttacatccccactgtgaagagagatcatctgagcacattcttttgtttcagaggagttcaaattgcacctgctcccccagaagaagttggctcctgtgtcttctgacccatttctttttgttcttttctttagggagtcaagggcaacaggggtttccctgggttaatgggtgaagatggcattaaggtaatcctctccctaatagcctattttaataggttgggttttgcctgtgcttttacttttacctccaaccctggacctaagtacaagggattacaataacagacttcattcaaataccctactaggtctgttaagaagaaaagagagatgtggcaactttacttaaacatttgaagggtgttcttgaggaaaaggtattaaacttgtactgtgtacttgaagctgtctgacttaggaccagtgagagtgcagcttcccatgaggaagaggttgaaaaaatcctacaattgtaggaagtttgtggttatttgagatcaagcataggctagagttcatgagtcttaatctgagtcatgatacattgaaaggtcatgatcaattagttgtgaactgtattctgcccttctgacaatatgttacaaatattttcaaatcatgtgtagtcatgtgttgcttcaagatagggttatgtcctgagaaatgcatcattaggtgattctgtcattgtgtgaacatcatagagtgtactcacacaaacctagatggcagagactgttgctcctggactacaaacctgcacagcatgttactgtactgaataatgtaggcaattgtaacacaaaggtgggtatttgtgtatctaaacatagaaaatatgtagtaaaaatgtgatattataattttatgagaccactatcatatacacagtccatcactgacccaaacattgtcatgtggcacatggctatatatgtaggtatatgtgcagagtcaagatttaccctttaatagtatcacttccagtagaattctgaaatgacttcttgaaggaaagggggttggttacagctgggacacttggaaatgcatacaccccacagactgatattcctgtgcctctgacctgggtgagaacacaggaacatgcaatgaacatgaacaagcattgcagatggtgttgtgaaagaaacctggagaaccaccagggcaataactacttctgtacaaccttgtagatgggattccttacccagatacgcgctctccaggaaaataatttaaagtcagtgtctctttaactttaatttggtttgtacatgacatctacatatcaatatattgttcattttaactgtacatcttgctttttatatgtaaatactttgggtgaccatattcacaatttgtaaatgtctttcactgtagggacagaaaggggacattggccctccaggatttcgtggtccagtaagtgtgattaaagacaatatcaatgctatgtttgatcaagttctttaaagtagcaaggaaattttgaatcagtgtctctcattaactgtgtgagagagattataacatttaccttgttgtcaaaccagggcagaaaatagctggtcactatgtgtccctttgaccacgggtaaatatttctatttggtccctggaaggcactagtgatgcccatgatgggctatggaagagaagaaaagctttgtctaagcagcccaggcccaaggtgatcctgccccttcagggtagaggacagtgagacaacaagggatgaagaagtcaacttctcctccctccacctgggcccgggttatgacaacgtgtttaatacatggtcagcaaaaagcaatcattccggcccaagctctgtgtagcaggcagtgctccccttcccagtggacatgtatttgatgtcagctcctaactgcagagcagccacattttatattctgtgactctgcagctgacgaaaaggagaaaggggacccggactctgagtgctggtgtccattcatctcctacctcaaaaaacagtggttctcacattcagtgcgccaagcaaggctgtcgtgaatggtcatgcaggttaaacaaaacggcacatggtggcaaaagggtcatgaggggaaggggtgtcctgttaaaaatgcagttctcagacccccatgctcagtaatgtaactcaggaattggagtggggcctggaaatctgcatctttacactggatgcatagagcccctgtcttagtctgttctttgctgctacaatagaatacctgagactgagtaatttgtaaagaacagaaatttattttcacagttctagaggctgggaagtccaaaatcaagatgctgacccttggtctggtgagggcttttttggctgcatcctcacatggcagaaagcagaagggcaagctgacctgaggctgctcaaagcctcttttaatagggccttaatcccattaatgagagagaaacactcatggcctaatcacctcctacagaccctacctcttacttctatcacattgataacacctgaattttggagggagcacattcaaactatagcagttcctaaatactttagtggagttgccaggaagattaaataagtattttgtgaaatcacttagcactgtgcccaacacttggtaggtgcacgcatatcattacagatttcatggtggacattattatgttatattattaatataatacttttgtgattttatatatattgcttaaccacaagactcttgttaaataagtcaacaaagtaattgatccatctagcatatgaaaaagcaaagaggttttttttttttcaaacctttgatatttccaccttttttccttcaagataaatatactgaatgctaaatgaaatctaccttttcattacatttcagaggaattcttagcactcttcactgtatattttcttatattcaattccatataattctgtttgcagcttctactaacctcaaaagaagttccacttaggaaggaaatggttaagaacaccagcagtaggtccactgagcatgtcagaaacaatattcctcgattcttgcaggtcaaggattccctggaatttaaagaaacaataaatacagtattttttgatgtgtgggttccatacacttccaaaatggaaataagttcagtccaccaggaccagcaattttgaaaagtgaagtagaatagaataaaaagtatcagggttgatcatatgttgtaataataagtcattattttgtgaaactttaatttttctatacatatacacacatacataggtatgtatgaatgtgtacatataaatgtgggtgtgtaaactgagtcacatcataaaatgtatttctaattgaaagcccataaaatatctgatactgtgataccacaaaggtctacttatttaaatttttccacctacatttacatgactatcatatacctgctaacatgtaaacctatgaattcaggaaaataaggaagccatctttgggccaaaatgaagaaactgaagtaatgatgtttggtgagctgtccataaatagctatcctttctctgtatttgtttctttctcctctaagacagaatattatgacacataccaggaaaagggagatgaaggcactccaggcccaccagggcccagaggagctcgtggcccacaaggtaagaataaatttcttcctaaagcatttgctgaacatatttctggctttctttcaaggtaataaatagcatgtgcttatggaattgacatgggtgaggaaagggaacagagatctcttcattttcataaaggtgttattttttgatgtctcctgctcttcatatttttatttcataggttgtataccaggaaggtaattaaattatctttatgtagcaaaacataaagttcaaatctgtcatggaaacatttgctggagggcaggaggagggagtgcaaggcattggcaatctcaatgggattacgaagggaaaaatggagaccgcgaacaaactcacacagagatgtgcaagggggaactgaaaccctggtttcctgatgcttgaagcaatgatctgtccttgatgccgtgaattattgtcacatgtacttatgctgtatcactttggagaaatccaaaagttctgggccaatccctctcatctctggctacatattgaaaaccctgggaacttctataatggcctcgtcaaggtcccaccctgtgattctgatttcattgtctggaggagggctctggacactagaagattgtaaaaactccctggactagtccaatgtgcagccaggattgggagccactgatctagacaaattattgctatgaagaagatttcaaaggaaattctacttaaaagaataaaatttcccagtgtatttaaataaaaggacagatgaatacagacattgatatagattttcttaaaaatctggtacacttactgtaaatcactcacatgtatatataaaggaattataacccccagaatattacagatggaagcaatctaagatggaacaccaagacaaactgctatcctggatgttccagcactgtttgattttctggtgtctacacttccagcaaagtgctaaacacagagcaggctcttagtaaatctaggctgaattatgtgaaaatgataaggcagcatgatttacttttgagtgttagacttccaagattagttttctcttgtctaaataagtgaaaatttctgatatttgtctaggtgagagtaggaaaaaagtatgaaaactctgtattattaactatcagtatattgtcacccaagattccaaaagtggatgggacagcatttatatctttctaagcaattaattaatgttatatattcccaggtcccagtggtccccccggagttcctggaagtcctggtatgtccatgtttcttggggtacaaatagaaatgctattacaaaggaaaataagctgtcctctattaagtttacattatttacataagacaaatgtttcattaactgatctagaagtgtttccaggctgggttcaatggctcacgcctgtaatcccagcattttgggagaccacggcaggtggatcacctgaggtcaggagttcgagaccagcctggcaaacatggcaaaaccccgtctctactaaaaatacaaaaaaattagctgggcgtggtggcgtacgcctgtaattccagctagtcgggaggctgaggcagcagaatcacttaaacctgggatgcggaggttgcactgagctgagatggcaccactgcactccagcctgggcaacagtgagactctatctcaaaataaaataaaacagtgttctcagcttcttaaattgtcatctttgcaatttatagtggaagaaggagtggagctgatacaaactgatacagaaatgctctttttctcttctcagcagttttaactatttgcaaaagctttattgtccgggatttttacagtgacttttggagtatgagcagggaccttgaaactcagaggaggtacagaaatagaaaacaatgtcatggtaatgaggttgcttgaaaatgacagttttcataacatatcatgagttgcataaggatacctacattacactttttctgtaaagttctaaactttcgtctctgactcattagagtgtttaccttttgagagaggaaaaagagttggatcagggatggtccacagggactcatcaagtataactgtagtgtgttctttttaacgaaaacaaaactaagaaaaaagagcaaaatttgataaactactgggcatgtgccctgccactgatcatatttttctctatatgatgttgtatattatactacttcataattttgaaaattaatcaaaataaagcagactgcagaactataagtatactataatttcactattaaaaaaatagatacagaaatggataaatattatatgtacctgaatatgcatggaaagatatacctcaaactgttaatagtagatatctcttacagttagaatggggcaaaaagatattttagagctctgacattaaggaagacctccttccccctgccaggcccctaagtaaaaaaaacaaaacaaacaaacaaacaaacaaaaaaacaggctcctttaataagccgatgagaggaaaactacaaagctctaattccagaagaattttaggatagttttttctgtttctgtgaaaaatggcattggtatcttgataggaattgcactgaatctgtagattgctttgggtagtatggtcattttaactagattagttcttctgatccatgagcatgggatgtctttccatttgtttgtgtgctcttcaatttctttcaccagtgttttatagtttttcttgcagggatctttcaccttgttggttaaatgtattcctaggtattttattgtgtgtgtgtggctaccgcaaatgggattgccttcttgatttcttttttggctattccattattggtgcataaaaaatgctactgatttttgtatgttgatttcatgtcctgcaattttactgaatttgtttatcggctctaagagtttttttgatggagttaggggtgaagagagattggttaatgggtacaagcatacagctagatagaaggaataaattctaatgtttgatagcacagtagggtgactatagttaacaacaatgtattgtatatttcaaattaactggaagagaggacatgaaatgtactcaacacagaaatgataaatacttgggtcaaagatactcaaaaataccctgacatgatcattacactacacatttgatacatgtaacaaaatcttacatgtatcccataaattagtacaaatctaatatgccaaagtaaaatatgattaaaaaaatacaaaactctgaaatggatgtcaatcagaagattttatctttgtgttcaaataataggacataatcagatattaccccggctggtttctcagtcctttgctggtggcatctctcttcttaatagttaaactgtttgtgggacagagatttgagactgtcccctcctcacatcctcaccactttaagattagggtggggttcgtgccaccaggcacggctcctttcccaggagatgactatcccccatcacagccttttatgtctaagacactggcaggaataaagtccacttaacaactttctctctttctcattttgcgcactgggggcatcctctagtctctaataaaaaaaatctacaaagtagcatatatggaagtattcctcacttccttttaaataaaaagactatagtgcatcccaaactctgtttcagtttcttgtaataaattttcttgtgggaatggaatgttctgcacttcactgtactgtggttatttaacaaggccacagatgaaaaaagcaaggatattcacttttttattttatatgtgttatgtacctctccattgtgcaatttttataaataaaattaaatcactcttgcaattaaaaaataaattcgtattaatcaggaaaaaatgtaaaatacaagaaatgattattttctccaaggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtaaagatgtggaaggggaccccttttgtgcacagtgccaaatgacagatgtgtgcaaaccacgggcaacaaaccctcctcacagcttagccatcagtctgtgtggtttttatgagttacctttccaatggtcttcatttcactaactgtctgtgaaagaaactgatgcaatgactagttaacaaatgcagcaaagtcttagcccgagtttcccagagagcagagtaggaggcagggacaaagagagtgatgtggggaaggatgggtggctatcaagttggccttgaccaattgcaactgcctgttcagccctggagactatctgtgccaggggagaaagaggcaagaatttatccatttgctcctagttcccatgggtcaaagatttccccccaagagaggagccgccccccacctcccatcctcccacttccaggctgtgtctgcatggttcccaggaagtcccatgccttggcatcagcagggaagccccaggacagtaggccagaggtgtgccgcatgggtgtaaggcaacatgctatgaggtaaaggggtcagagatgacagagatgtggcccaatggacttgaagtggtgctcagaggtcctgacacagggagcctttccttcgcatccctctagagagccacttagcattctgtgttggctcataggtacaataggtcctcacaaacatatagatcacactttatattttaacataccttttctggggccaggtgtggtggtgtgcctataatcccagcttcttccaagtctcttttaagatggaggtttagtatcctctttttttctatgtcaaggctgacatacagagttcacagggctaatgaagctaaagctgggatctgggcccaggtgcttgcggctctctcccgaaggtgtcatgctccctctgtgcctgctacactctgtccaggggtctttgcttcctactttcccttcgctaagcaacacccatctgtccttcagacttcagcttcaagttcaagtccagcagaaagctttcagtgagtccacatcctgtaacctccaaggttatcccaactgtagaagttttcacattgccttctctttgtctttgtcagtttttcttacaagaatcaaagtattttgaggtcaaagactgtgtctttttggctgtttaagcccagtatgtagcatggggaacactgcaggtactcagatattttttgaattaagcattaattgagtatgaaaatgtataagtatacaaaaatgtatgaatgtagaagtattcatataagtctacactaagtattaaacttttatcagattgtactatttaaagatgaccttccaggtattttaaagatgcagaaaactgatcacaagatggtcattctgtgttccaacaaaattaaatggttccagtggtaccttgtttttctgaaatttgggacagctatggtagtgtttttaaatatttactttcatcaccattgccttcaacctgtaattgaaatggcaaagccaaaaattagattactgaacacaattaaccagtttaagagaaggagctgttcattgcaacattacagtagcagataatgtggaagctgagaagagctttcttagagacctgctttaaggatgacaactcaattgatgtggacaagcaacaaagagaaaacagatgataccctgagtcagaatccatttttcttttactcaatatatattaagcatctacagtatatcaggaaaatacaatgtatccaaaaatatccagaataagagttgatcctttgcctcaagatgctaaagggattgtctgtgtattagtccattctcatgctgctaataaaggcatatccgagactgggtaatttaaagaggtttaattgactcacagttcagcacggctggggagtcctcagtaaacttacactcgtggcagaagcagaagcaaacatgtccttcttcacatgatggcaacatggagaagtgctgagcaaaatggggaaaagcccattataaaaccatcagatctcataagcactcattcactattacaagaacagcatgagggtaactgcccccatgattaaattacctcccaccaggtccctttcatgacacatggggattatagaactacaattcaagatgagatttgggacacagccaaaccatatcaacttggaataattggaaacaactaagtaagataaaataggttgattctgtgaccaaaaaaaaaaattatacaatgagctttcaaagatcaactaccttaaaaataccacatctatgtaatatgaagggaagagctggtcaccatgctttctcagttgcagataaacttctaaagactaggcttccaatacaaagatgagagagatgcattttaaataatacatatattacaatacttgctaattgaaaaaaacacaaataaaaaattgtctttggtgctgtatttttataggtgacatcgtttttcgcaagggtccacctggagatcacggactgccaggctatctagggtctccaggaatcccaggagttgatgggcccaaaggttggttcaatcaataatgttgtattaggataagcctttttcatcgtcattattatcactgatttttccccctgagataacaatgatcccaaatagctaccagtcagtgatgacttattttccattagctaaaagtattcatttatctgtaaatcaataatttatttggcacccatgcaataaattgttggatatccctaaaatgtgagtttttgcctgcatgcaaggaaagaaacactgaaatagatgttttatgttagacttttggaatttcccctttcagaagaactgtatagctcagaacattaaagtaagcagatctataataaatgaatttttaaattaatatgtataacgtcctagataattttcactacataaaaatgtttaaatgtaataaatgatagtgtggttggaaaatatttgttctttctgaggactcaatgtagctttttaagtaatgctagtatgctctcattgcaggagaaccaggcctcctgtgtacacagtgcccttatatcccagggcctcccggtctcccaggattgccagggttacatggtgtaaaaggaatcccaggtacaaacaatttgcatgcaagtgtttttgcaagcacaaaagggtcaatacactggaagaaaataaaggcattggattggtggatgtcacaacgtggtttagatgaacttggagggagagtttcaaaaacatatattctattaacataaagtcagccaaaatccaagaaaagctggtatttttccctattccattttagttgctgacccctagcaaagtattgtgttaggcaggaattgtgaacacagagtcctacaagagaacagcagttaactgaaggcagtgaagcagctgcatgaaacacacaccctctttctcttccataaagaaatatgctctctccctttttttctcaaaagacacaaccctactcagtccattttttcatgttcctacttttaaaagagtcatagaaaaatgtggtatttcactttcttcttaaggatgcaaatgctctttaaaaaattgcaacatcctccgtgctggggacaagagagttgcagaaatgcaataaacaaactgagggtacatttgaacgggccagcgggcacttggctgcagcccattgttactgtgcaacatgtcaggccctgcattaataaatcttccaagttttcatgagaagaaaggaattggaatttttatttaaaatctcatggtgtttttttaaaaaaatattagccactaagtcaaattttgaaaggaaaaaaaaaaaaacacaacattttatagccagtgtcctgaggcttaaataaaggatgagtcacaagccttctcttgacaactgtgtgccaggccaggactctccacaccacacggttactcccggctgtcaccacctctgctttcgacctccccgtcttcagtcacagaactgcctatgggcaaaactttgaagtacaaaacgtctctgtttactgactgggttcctctgcccctcgggccactcccctgactacacagggcctctctctccctcgctaccacccacagtcctgactctgccaccagcaccttggtcttcagacaatgtcatcaaattatgtatcattgaccattgagaggtgaagttacagagcccttggcctgtgtgttgggcgctgttctaagggtcttatgtgcctccattcctttatctctcacatcagcccgagaggctggtgctataattaaccgcattggacagatgaggaagctgaggcatcaggtggcatagctaataacatggtagagactgaactgaaatctagacgcgtgctcttaccctccacgcctgcatcccctgactgcggtgctgtcgcctgtctcctagggggctgcttttggggagttaatccaaaggtctacctgacaacctggatagggaacattatacattatcactgtccagtagccatttgcattggcatagggtcttctgggagactgggtctcaatccaaagatgaaagactaatggcggcagccgtgaacactgtggtcagccactggatgacatgcacttgggcagggatcctttgtcccctcagatcccactcacttctcctttatgaaggcctctgctactttcagtggctgcccctgccctgactcacaggcttgtgagggaaggggcaggggggaggtaggagctgttcctcttgttactcctgttcagtatccaaatatccagcggaaatgttctattaaaacaaaaaccaaaaggaaggaaatgaaggagggaaataaggaggaaaaataataaaagataaaaaatcattattttcctatactctccttgagtctcctctttggctcaaggggagcaggtgagcagctcactgatgctgaccacttattgcattgttgcattttccatagtttctctacatttggcctatccaggtgcagctcaaagaagatatgtaagcagtaaaatggtttggatcactataaaaagatacaccccagctcaagatcttgcaaaaaatagaatctgaataaatatgtgttgattaactgaccagagacccacccagaaggtcatttaaagggatcatcttgatagagatatttaaatacctatgggaagtataaaattgtacaataaaatgcaatttggcaagagacattcaaaaccttagaaaagtttgagactatttggctctgctattacacttttaaaaatttattataaaggaaataattggataaatttggagagctaaatacccagagacatttttcaaagcattgttcacaacagctaaaagttgaaaaatgtctacctaatgtctaaatgtctaaaaacagcatttagctaaataaatgatggctcgccaacacaataggcagcatgcagccatttaaaatgaagctataaattcatacttattgacatatgtatactataaatccaaaatagtgtgtctacgagtcctatgcacttatggatataaaaaatgtatcattaatttacattaaactttggcaaatattatcttctggtagatttataggtgatttttagtctcttctttctgcataattttcttataatgagcatatattacttttaaaagtaatatatactcagaaaaaataaagatatattcttaaaattatgaagataaaattttaagaagctaagatctgagttactttttacatgatctcttgttctgttatttactcccattctcttattgcatttatgttttatgatagaagttgtctttctttccccacaaggaaacactctattttcttcatacattgtattaccctgtctacttagagttggcgttcaatgaggagttagttaataattcgttgatttgcaggaagacaaggcgcagctggcttgaaaggaagcccagggtccccaggaaatacaggtcttccaggatttccagtaagatttcatgtttttaaatctttagcttcaatttgacaaattgcacactctagaaatatggttgcaacacacttaccagtttggtgccttgcaaacagtaggcacttaatagatacctgttgattaaatgaataaatctgtgactgattaagtgaatgagtcaatgaatttataaacagtttgaaatggtatcagaaacagaaagcagattagtggttgcctagggctgagagtgggaacagaggttcattgcaaataggtttgagggaatttgggagagtgatggagatgtttgaacgtgattgtggtgattgtggcataattctataaatttactaaaaatcattgaattgtactcttataaaggagaaattttatggtatgtaaattatacctcaataagtccgttaaaaattagaatcttgactgtcatagtgaatcaaaaagttatagataaatatacttagatcaaactattcaaagaggcttgttaaaatttaccaatattcaaacataacctgtattatggtgattgttctatggtattaaattatattattgtctgtattgctttgaattatactatctaactgaattatttttcagttttggaagttaacaacaaagcaaaacaaacaaaatgcttgtaataatagttgtggaccaaagagtgtgttgaaaaaattcatgttaaaattgaaaagttcttgtccacactgtttttaagattgacagaagaagaattctaacaaaatacaatacagattcatttgtgtactaccctagggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggttggtatttagcaactttaccctccctataaatgaagtactctgaagttaagagataaagtgatttcttttccaaaaatggttggccgctcagcacagttcatcactctaactgcagaatgaaacatcttcaaattagcaggaataacccaagcaaatagttatagtattttgacagaataaataggtagcattcagtgatttcaaccaatcaaaattctacattgataatgaccccatctcatacacaaattacagttccatatttgtatcaaatgagtctatggaaaagttcagaaaatgatgtatagtagaaagtttagtaaatattttggggcgatgtccatatttttaaataaaaataaatgcataagaagacagcatatttaggggtatggtagtcaaataaagagattaaatgttttgtcattcatttaattttatggaaatttaatcccttttcatgagagagtttctcacatatttaattgaggtaatacctaccaagattttttttttttttttttttttttttttgagagggagttttgctcttgttgcccaggctggagtgcaatggtgcaatctcagctcactgcaacctccatctcctgggttcaagtgattctcccacctcagcctcctgagtagctgggattacaggcatgtgccaccacacccagctaattttgtattttcagtagagacggggtttcaccatgttggccaggctggtctcgaactcctgacctcaggtgatccacccaccttagcctcccaaagtgctgggattacaggtgtgagctactgcacccagacctaagatttattttaaaatgtcacagagtgagagggtgagcacctgtcatcataatgtatttacaagaggtttgcaagggatgctgcccaaactattctatgaaataccagtttctcccagggctaatctgtgttagccaataaaacagatcttacctcaaagaggtttggagaaacttggtaaacaaatttaaagattcatttacagaccctttaatatcagaatatgaactgtgagtcttccacatgaagataagctatctggtctttcctaaatgcttctgactacaaaaccctttttggctggcagcatctatggtgccagcagttctcagaccctgccttggccaagtcccaggttgttcactttgtggtagttatgcttataaagtgacagtgccagaattctgatggtctaatattaagagaatttgtatgatgtccctacttgcatctcactgatttttctttataagttctggtaaagatgctccataaagtaaatgagagaaaaatcaaggtggtgatttgttgagtcttacaccctgtcattaaaaaaggagacagaccacttagccatctgatgatattgaacaatgaaaaattgagtcaaatttatttcagagggccatgttgggaaggaagagggcttaaattattttgtcaaattcaatttcttttaaatctacaaatcattttcaaggttatagcatatgaagatttaaaaactagacagtttatgagagaaaatggaagtgggaaatcccctttgtcatgaaaatacctggtgaaaccagaaataaaggtttgctgtgctcattttatttcagaaatgtaacattatcatgaatatcaccactaaagtcatttgaactattggtcaatttgaacatagttttagtggctattaccatatgggagacccatcattgtaagatatctcaagtgggactcaagacagttccaagttcaaaaaatgttgctaaactccaaaggacacaaaacggaagaaacctgcagtgctcttactttagtaataattctcatcaaatgccaaatgcttttaattcaagatctcaatgacagcctaactggtattcatatttggaggatgattaacctgttgtaagaatatactggaatgaagcacgattcaaacacattcctgttgtcacaggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggttggttagttttctttccagtcctgttttccgatggagtgggttgatggtttctagagctaacgaagcttctccaagactaaggaaaatatagaaacttgcttctaacgaatagaatatgtcaactcacagataccaggaaagaatatgtagggtatgttagagaaaactcattttttctccattactgggcaattcaactgaaatttcctagaatattctatatctattacatacatacatatatatatatgaaatgaatagatcctaagcgttattgcaaatttgttttttgtggttttctagagacagggtctcactgtgttgcccaggctggagtgcagtggcataattatagtttactgcatcctcaaacttctgggcttaatagatcctcctgcctggtctcctgagtagctggggctacaggcacgtgtcaccacgaccagctaatatatattttatttttattttttgtagagacaggatgttgctgtgttgtccaggctggtctcctactcccaaccccaaacaatccttgcttcagcctcccaaagtgctaggattacaggcgtgagccactgtgcgcagccacaaatttgttgattttgatccataactccataggcaggttacaaataaaactttaaaatatctaagacaaatgaaggaaaatggtctgataatagtttaaaagtccaggtaacttttgggatatacatatactggccgtagttctggattcaggagtgtggctgaaggtcagaatagcatgctactgatagttttgagcaaataatgccaacatggtcatgttttacttctaaaatcaccttaggctgggcacagtgactcacacctgtaatctcagcactttgggaggccaaggtgggcagatcacttgaggtcaggagttcaagaccagccgggtcaacatagcgaacccccatctctactaaaaatacaaaaattagctgagcatggtggcacatacccacagtcccagctacttggaaggctgaggtaggagaatcgcttgaacctggaaggtggaggttgcagtgagccaagatcgtgctactgcactccagcctgggcaacagattgagatactgtctcaaaaataaataaataaataaataaataaataaataaattttaaaaatcactttaaagggtaagacccagtaaacctctaaatcattttgtagtgtcttccctcatcagtaaaactttttgagtgcacaaccttacattatatgttataaatgtatgcatcatttctgtccacacatgtatgtaaatcttattttatgactttctctatatattaaataaacaaataaatatttatgtttatctgcaccttactttggagctgctttttttttttttgtctgagatggaatcttgctctgtcgcccaggctggagagcaatggcgcaatcttggctcactgcaacctccgcctcccaaattcaagttactctcctgtctcatcctcccaagtagctgggattgcaggcacctgccaccatgccaggcgaatttttatatttttagtagagatggggtttcaccatgttggccaggctggtcttgaactcctgacctcaggtgatccacctgcctcggcctcccaaagtgctaggattacaggcatgagccaccatgcctggccgaaggaggctgctgttctaatccaggtactagcaaacggtggtggaccacagtccaagaccagcccactgcctgattttgtatgatcctcaagctaagaatggttttcacattttcaaatgattgaaaaaaatgtttaatgatattttgtgatgcatgaaaattacatgaaattcaaattagagtatccataaataaagtttcttggaacacagctgcactcctgtatgtactgtctctggctgcttttatgctacaatggcagaattgagtagttgggtagatttcaatcacgaagcctaaatttcttactatctggccctttacagcaaaagtttatttagccctgttctaatccatcaccaaatgctctgttgttgttgttgttgttgttgttgtttgagatggagtcttgctctgccacccaggctgcagtgcagtggcgtgatctcggctcactgcaacctatacctcctggattcaagggaatctcgtgcctcagcctcctgagtagctgggattacaggcgcacaccaccaggcctgattaatttttgtatttttagtagagacggggttttactatgttggccaggctggtcttgaactcctgacctcaagtgatccacccgccttggtctcccaaagttctgggattacaggtgtgaaccaccacacccagcctcttctgtgatttctaagtgtgaatctttactaaaggattccattgtcataaaatatattattaccaaaattgtcccatcacatactgtaaacctatttttttctataaataaatgactatatggacaacacttatcactaaacatgtttttaatgtttgccactgtggtcagaatattatctcgtgtccttatctgctaggtaggcattctttcccccgcgacagatgaggaacttatcagagaggttaagaaaagtgtccaggtttacaaaccaatgtcagccttgcccatatcaaaacttactgttttgttcaatagccttcctgtggaaactagccacccaataaataagtatcctatcagtattcaccaacgtttaaacttaattccatattatcaattttttggaataggctcttttcaatagaccagcatgttgggctattaatttcccttttagaaaaaaaaaaaaattgcagctcgctgccagcgctcatttaattttacataaacacattctttgaggctgaagcaaatctgattttcaatgtgaaataaaatacaataactgttcttggagttatttctaaacagaatttgtctctaatcctaatgtaagagggtaaagttaggaccgtcatctgtgagttatctcagagtaaacaggaaacaggttaaaacaaagtttagacgattgtctacacttataaatatttgttgattcaataagaaagtttctatgggctggtcgtccttaagctagttttgaagtctgtgaaaacagaggttattttttattttttggggatatgtttataaaccctttataatcgtattttccgctatcgtctaagacaagcttcaatatataccccaatcttatgaccacaaatttccttaaggccctaggggagagctcagtgtttcaacaccagttccaggcccaccaggacctccagggccccctggccatcctggcccccaaggtccacctggtaagtatcctctgccaaatctggtacatggcatcagacacacacaacaccctgactctcttggaaaaatactgtccccattataaggaaaaaaatgtattcattggctccaaaagagagcacagggcagtgtcttacctgataagcaagcaggctggggacttgctatagttctctgaggttatccaaattattctcactggtgcttctaatataaaggttcccgaggagaacctatgtaactacttaagaggaattttagagcagaaaaaccgttctggagttttggtgggggagcaagtgatgtttgcccactggcaattcatcaggatattttccatagcatcttcatttgaaaactgattgtctttgccaacgtgatctaaaactgagttttgcatgcatggagggagacttacatagttcaagacatctagaatatttcctgttaggaattaaattatattgacaaaattctttgcagttcctaaagattagtccattggatagggacagggagggggagcatatgattggggttgtgttaaaaattttttcttggccgggcacggtggctcacgcctgtaatcccagcactttgggaggccgacgcaggcggatcacgaggtcaggagttcgagaccagtctggctaacatggtgaaacctcgtctctactaaaaatacaaaaaattagccgggcgtggtggcgggcacctgtggtcccagctactcgggaggctgaggcgggagaatggcgtgaacccaggaggcggagcttgcaatgagctgagatagcgccactgcactccagcctgggcgacagaccgaaactccatcaacaggaaaaaaaaaaaaaaaaaacaatgtgcaaaagggataggacgacacagagaacttagacattttcttttaaaataagatgaaggaaagttgctgatgtggagatgcatatgtgtatttgtttctaaggtatccctggatccctggggaaatgtggagatcctggtcttccagggcctgatggtgaaccaggaattccaggaattggatttcctgggcctcctggacctaagggtaaatttaaaattttttcaaacataaagtttgttgtggatatttagaagatgttcatatgtataaataaaatgagtaaaatacaatatgaagatataaataggatataagatataaaatgagtaaaataggaaatatccataatactctttaaaatgttttctggccaggcgcagtggctaatgcctgtaatcccagcactttgggaggccaaggcaggcagatcacttgaggtcaggagttcgataccagcctggccaacatggtgaaaccccgtctctattaaaaatacaaacattagccgggtgtggtggcatgtggctgtaatcccagctactcaggaggctgaggcacaagactctgtctcaaaaaaaaaaatgttttccaagagccacaaatggaaaaaaatcttataataatgttaggtgaattaattgaattttttaaaacacagagaaaacaactagaaggaaactcaccaaaatggtaatagtgaatcttgattgtcagattttaaagacatttttgatacttctcagtaaatgcctgcacatttcacatgtatacatttcttttttttttaataagaaaggaactattaaatcacaaatggctgattttcccataaactccaaaataaattatggaaattattttcctttagggaaaaaaatgctgtttcccctcaaagaggaaacactccaaaaaaatctagacgctgagagctcacacaatgacataagcctgcccactgacaagtacatgaaagtcctgtccaggatggcatatgagtaacctgagtccctggattctcacatagaactgcaagttttatgacaatttcatgtttgttacaatattctttaaaatgtttgtcaaaaatagcatccttgttttggtgtttcagctcttggattagtatgtcatcagtgtttattatacattaattttgcccaaatatgagaatattgatttcaatttatgagtatttgaaatggaaaacataatctcatttctcctggagtcttaagaatggctttgagtccaatttcttggttttcttcctaatgatctgtgaagtaagggagtctgcctcacatttgtacttcattcttcttggaccctgcattaataaattacatccctactttgtaactctaggtattgactctctggaagaagactgttgactgtgggaaccagaactagcccaagagctccttgaaagtggagatttacaatttcacaattgaatctaatgaatcccatgaactaactgcaaattaaatattggtcaaattagggtatgaaggaactccctgaatgcagccttgcttcaccgtggcttcctcttctgaaccagagatcacagaaagtgtgttgacccctttctcaagtcacctactataaatgcataagaagttaatcccttgcatgcaatggatgctatagggcattaagacttaattctcttaagcaacccctgttgagaaaggctacctggggtgctgaaaacgttctatatctttttttttttttttgagacaaagtttcgcttttgttgcccaggctggagtgtaattggcactatctcagctcaacacaacctctgcctcctgggttcaagcgattctcctgcctcagcctcccgagtagctgggattacagacatgtgccaccatgcctggctagtttttttgttgttgttttttttgttgttgttgtttttgtatttttagtagagatggggtttctccatctccatgttggtcaggctggtctcgaactcccagtctcaagtgatccacccaccttggcctcccaaagtgctgggattataggtgtgagccatcatgcccagccaaaagctttgtatcttaatctaggtcatgcttacatgaatatatccatatataaaaatccacttacctgtacactgtatgtaaaaaatacttcaaaaacaaagtcaaatggtcaaccagcatcagtggtttgaagaattgctgaatcaaaatcatggccctactaaacaacaaaatagagaaagttattttttcaaataggaaccaatgtaatttgatttggaacttttaaaaaattgctaatttatcagttggttttattatcatttaaattttcataaaagcatctctagctggttgagagataagagagttactgctcagaatatttcaataagactaatcctacaacaatgtttattgttttttctctgtaggagaccaaggttttccaggtacaaaaggatcactgggttgtcctggaaaaatgggagagcctgggttacctggaaagccaggcctcccaggagccaaggtatgcaaaaattcaagctatcacagaagagagggtgggtgaccattaactggccagtttgtatgcacttatctggcagagcactctagatgtagaaatgatcaatatatttgtagatgatgaagatattaaattttttaaatgtttctctggatcatcttccattttagaaaggaaaacataaggtgtcagaatgcagatttcatcgtgatatcatctttaatggtttcataaataatcagagtatttaaaatgggacaactctagaaagaaatgtggttagctataagaaaaactatcaaaagtaaaaacatctagatttttctctttatagacaatcccacagtcttctgaaaaagtggaggctacatatcctgaagtattattaaacataatcttacagaaaagtcagcaactagagctcaaaaaggaaagttgatgacatggtagtggctgtgcaacagggacttagagcctccataacagagagtcaatatcagtgaagatttggaagcactatatagtaataacacaatttctatgctgtagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggtacaatagcaagtgtcattacttttctccactgtgagctctgctaaaatgcagcaaactgaatgtgaaggtgttctaggcatgaagaattctcccatccaatgttcctgccctacctttcttccttctttccttcttccttccttcttttttaatgagtgccctctagaaaaggcatattaatggcagtaaatatagatctgatttaggtggaaaaaaagttaacagaagaatgactggtacagcaataccaagaccttaagttctagcacctgggtatatacttgtgctttcttttgcaggagatccagggcagcctggaccacctggagaacaaggacccccaggaaggtgcatagagggtcccaggggagcccaaggacttccaggcttaaatggattgaaagggcaacaaggtaggaggagggcctcaaaactggccaccagaagggcaggagacatgagactcctgctctgtgctttgctgcttaacatgggaactgtccagccacaagtcctgaccactgttcaatgagaaatacttcagaagtgtaaaccttgctgttatgggtttgttgcacacagtagtgtgtaccacctataaaggaagaaacttgaagttaatatagtgagttgctttgtgtcttttatgcaagaaaaatatgaatgctgaagacagagattggtgtgtgtttacatatatttatatacatattaaattctcagaaaacattttacctttaatattttcataaatatattaaagtggtaagtttatccttattattaaaatagggtaaatgtatgcaatgataccagtttaaaaacttataaactaaaatatgtagttgattgttttacatacaatataaaagaaaaaacatgaaaataaatctaaatgatgcaggctagatgttccagatgatggaaaactttgtttttggatcctctcctcatcagatctgatgaactgttcctggaaaaatgtatttagaaatcagttaatgtctgtggtctatcatactgcttatatgttcacaaataaatttttgaccaagaccttaactgttacagtggcattattattttttccagaggcatccagtggcttacctctatgcgaacggctctgtatgtcttctgcaggaaacagagtgagcagcactcataaggtgcagtcccagaatgtgtctgcaggactagaaaatagatataaagactacacttgtattactgcataaatcattggagcagagaatgttagagccagaagggagctcagaaattttacagaggggacattaaatacatacacacacacatgcgcacgcatgcgtaagtgtgcagttaccccaaatcacaaagctaaatatttacagccataaaatatttctaaagtggccgggtgcagtggctcatgcctgtaatcccagcactatgggaggccgaggtgggcggatcatttgaggtcaggagtttgagaccagcctggccaacatggcaaaaccccatctctattaaaaatacaaaacttagctatgcattatggtgcacgcctgtagtcccagctatttgggaggctgacgcaggagaatcacttgaaccagggaggcggagggtacagtgagccgaaatcgccccactgcaatccagcctagaagacagagggagattccatcttaaaaatatatatatatatatatatatatatttctgaagttagtaggggaaagcatttgtgggttaattaattcattcatttattcgtacacaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtatccttttgtgtgtttctatttttcttcttatttcttcttcttcttaaggtggctctgtcaactgtacataggcatacgctttttactctatgcttttacttaatataaggttttccttctaaattatttgtaagaaaccaggggccatggtgcagggaaacggtggcggcaggatgaacaattacccagaatgtggctatttttgctgtgtaatcctttttatatacgactactataatatacttgctagtattttgttgagaatttttgcatttatattgagaagggatattggtctgtagcgttcttgtgatgtctttggtgttggtgtcagagtaatgctggtctgatggaacaagctgggaagtgtttcctcctcttgtattttctggaacagtttgtgaagaatcgacgctctttaaacatttggtagaattcaccagtgaagttatctgggtctgggcatttctttttgggaagtctctaaatgactaattcaatctcttcatttcttataggtatattcaggttttctatttcttctggagtcagttttggtattctgtttctctagaaacttgtccatttttataagttatctgatttgttgttgttgttcatcatatttctgtataattgttttaatttcatggctatgtttattgtttatatgtttggggagaatattctgttccctcatggcataaggacctcaccgatctcccctctggaaaagagcctaaaacaacttaatcgacacattatcctttcattcatgttattgggctactatcacatgccagcattcttctaggccctagagacacatcagtcagtggacaagtctccccttctcatagtagaggatcaataatagaaatatttaaaatctaagttcaatttgagacaagtgttatgaagaaaataaagtgaagggatagaatagaaagtgactggtcaggggctgggaggatggaatgctccaaaacttccacatatgctatcctcatccatgaatatgatttgctaccaatcacttccacataggtgagtttaaaagaccacttaccgacccatctcctagactaatacagtaattgtactatgtacagaggccattttttcaactcccaatctctgcttctaagtataatttattttagtatatggaatattttgcttttctcactctgtacaacacgtgctgctttgtgttaatttgtttccataggtgaagatggagtgattgggatgatgggctttcctggagccattggccctccagggccccctgggaacccaggcacaccagggcagaggggtaagtgatagagtgtctttctaaatagcaggaagcataaacaatgttcatttattttgcagcaaaaaaagttatgtttcattggagggaaaaatagttctgagagagcaacagtatttgattttgctgttttctatgttccttttctccatttgaatggaatcctgttttctgtaggcttacaccactacccttatgaggctgcctgcctggggaaactatttatcaagttctcagcactgttagccttttttgtttgatttgttctgttttatagtaagcactgccaactttttaatccctatgaactacctgaagaattaaggacctgatgttgttactcctgtctgttagggagccctggaattccaggagtaaagggccagagaggaaccccaggagccaagggggaacaaggagataaaggaaatcccgggccttcagagatatcccacgtaataggggacaaaggagaaccaggtctcaaaggtaaagaattgcttgtttggaatcaggacatcagagctgattctcaggctaataaattatccaggcaaatccgtttggttgacaaataaggacagtgagggccagtgtttagttacctgcccatcacacagccggttggtggctgagcaggccttagaactgagtcaccttccacgacatgttgcctcctcgatgtgtaacatttttatttctaagttaattctgcattttaatttgctatatttaaatcatcagcagtcagtttttaaattataagcctcaaaactccctctttgccaagtatggggaaaattaaacccttaaaaaaattccacattaaaaaacttttctggctgatgttgaaacctccatctcaaattcaactttattctgtagactaccagaataatattttctgattctatctaaaaacttcttctcctgttcaaaatcctttggagaataattactaaaaagaaatgcttcaatgaaaatttaaccctttagaaagactgttgttagatgtggctactaggctaaaattcaaacccattcacattatttcaagttatttgggccctttttatggcagttttcatgatatgatcaatacgaccaatataaaaccaaattttcagaagccctcccttgcagtcttcttgaccaaatgtaatcccaagcaactttagaaaaacagagaactgctgggtaaaatattacatttgcagatcagactctcatagcaggaaaggaataaaagaaaaatgtatcatggcaagaaaggaaaaaagaaaaatgtgtttgcagttgcaaaaccatgttaagttttgagatatttgaaatgacttttgagaaatgagactgtgttcaacaaatatttatatgcatggcacatgaggatgtaacaaaccttcacatgtactgccaaacctaaaaaaaaaaaaaaaaaaaaaaaaaaatttgcacagggtgctgtagactacaatataaaggctgactaactggcaagttaggaagtaaaggccttctatgtacatagtcctcatctaacctggtgttgaagagacactttagttctggtacaaaaagaatattgcatttcatttttagcaatgaaaaagaaagtaatgcgacttttataaaactctgctaggactagtctaagccaagatatgaaaaaaaaaaatactggcaccaatctccagtcctcataaactgtctgcatagacaccacttcactagactattttagattatttaagtagtgttagaaacattttggaaaaaatatgaatagcatatctctgcctacataagcagaaatttggcgctcacagtataaatgcgcagtgagtactaatttgcaattgaagaattccttttgtaaagtacagaaggacacatgatatggggctatttctatacttccaacaaaactcttttactcaccctaagtacagtatgcatcgaggctgttctgtatgttttctttaggcttttcaaatgcataaccaagggacacagattgaagaacaacaaaaaaataacctgtatctaggcctccctaatttcaatatgatccatttatttttctaaatctgaatttctgacttaaagctattcacttcaaatgtggaagagatattgaatatacagagaagcacaataacaagtcactatcctctccacaaggaggctgcgtggcagacttaggcatatgtagaaaaagataataaagacgcgaggtgcaaattagcatgctatattatttaacaacgacctaagtagcatttaccatgtgcaggtactgttccaagttttacaactattgactcatttaatcctcacaataaccctaggagtaggctgggcacagtggctcacggctgtaatcccagtattttgggaggccaaggcgggtggatcacctgaggtcaggagttcgagaccagcctggccaacatggcaaaaccccatctctactaaatatacaaaaattagccagggtgggcggggtggggagcctgtaattccagctagtcaggaggctgaggcatgagaatcgcttgaacctgagaggcagaggttgcaatgagctgagattgtgccactgcactccaacctgggcaacagagtgaggctctgtctcaaaaaataaataaatacataaccctaggagtaggtactactattgcaatcatcccattttacatacggggaaatagggaggtcaagttacttgcccaatgacactctgataggaaatggcagagatgggcctcactcttggcctcctcactgtgctgccagagctctgtaggagttgagggaagtagaaaatacagcaactaagatagtcagtgaaacctccataaaagaggacttaaatgttgaataagattcagatgaacaaataaaattcttggcttaaaatctttccaaggctccctgtgctttgagaagtgaaacttcttggactgacatacaagtttattcaccacttgcacttggcctgtctctccagccacatgacatttatgtactcaataattaccttttacttaataatacctatggactaggcattttgctatgccttgattatacagaggtgaacaaagcagactttagtttcctagtcatgatgaaagttacggtttagtgggggaaagacacataatgggtccataaacattttccatttaggctaggtagtaagtatcttacgctttgtggctcacatatggtccctgttgcatattcttctttgcttttgtttttaacaaccttttaaaaatgtaaaaaccgccaggcgtggtggctcacgcctgtaatcccagccctttgggaggccgaggcgggtggatcatgaggtcaagagatcgagaccatcctggccaacatagtgaaaccccaactctactaaaaatacaaaaattagcgggcgtggtggcacacgcctgtaatcccagctacttgggaggctgaggtaggagaatcacttgaacccggaaggcggaggttgcagtgagctgagattgtgccactgcactccagcatggcgagaaagcaagactccgtctcaaaaaaaaaaaaaatgtaaaacccgtctttaaccctaaagccatacaaaaccaagccagattcagcctgaaagctgtattttgccaactcctaaaacactgaagtaaacaaacagactaaacagtatatatctttttagattgcaatcaatgacataaaaggaaaaaatgaaagttgtaaaacaaaacaatctaactccctgatactcatcactcctttctacatgctattttactctctgggaatcctgtctcattccagaccttcttcacccaattagttttcatttggtcttcaagactgagctaaaaaataccacctctttcagaaattcttccctgtagtatattgtgcccaactctagtatagagtttatcttcctggatgataattatttgtttacttgcctgtctccccagttaaacactaaaaacctggggaaagagaacatgatgatttatctctctggtgctcagcacaagacctatttattaattagatgctccatccatatgtgaatgaataagtacatatgcaggaaaagagccaagggaagtgaatctgcttgagaaaaagcacaaaggcaggctatagacagattgcagaatgcttcatgctgccgaaagagtttgcaatttactctgtaagtaatagagattcagtgactatttatttatttattttgagacggagtctcgctctgtcaccccggctggactgtaaatggtgtgatctcggctcactgcaacctccgcctcctaggttcaagtgattctcttgcctcagcctcccaagtagctgggattacaggtgtgtgccaccaagccagctactttttatattttttagtagagacagggtttcaccatgttggccaggctggtctcgaactcctgacctcaaatgttctgcccacctcagcctcccaaagtgctgggattacaggcgtgagccactgcacctggcccaatgactatttatgaacaggagaagagtatgatcaaagtcatgttttagggaaagtggaatggtttcctgggacgtttatgagctttccagctgggcagaactggattcaaatccaagtgttattaactgattgacactgtgattctggcctttgacttacctaatactttataaattataattttaatacatggattgagaatagaatcatctagatgagaatactgtagtggataacactttgtctttactattaaaaaatgaagaggtatttaggctgctaattcttaaaatgttgttttaaagagtacatattaagatcattgctagtgttcattgaggaataacttatgccaggcactgtgctaatgcttgacacatattatttcatttaatcctcttctttaagagacagaagcccaaatccgcccatgctcttaacatatatgctatatgctgtactacagtaatatgccatcggtttaaaccaggatgtggatgggtctgacaaaattttaacatgaatttttgatgcctggttttttgttttgggtttttttttttttttttgagatggagtctcgttctgtcgcccacgctggagtgcagtggcacgatctcagctcacttcaacctctgtctcccaggttcaagtgattttcctgcctcagcctcccacgtagctgggattacaggcacctgccaccacacctggctaattttcttgttaatacctggtttctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgctactaaattaactaaaagaaggtgttgatagttggcgtgtcattaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggcaataacacttcaggatgcagttggaaatgtattaccatatgtttgcaggagcccacttttttcccgctggtgttggtcctaggatgattttagtgtttgaaacccaggtctgctaacgagaatctaactttctttagttttccatgttccaggtccctagttccctcttatttgaaggaaaaaggacagctagacaagtgcccaaaccagccggtctggctgttctgcattcattcatgcatgcaagcaacaagtatttattaaacacatactatgtccaggaactgtgcagggcaataactacttatttgttctcaaggccccagaggagatttgggcagcactgggaatcctggagaaccaggactgcgtggtataccaggaagcatggggaacatgggcatgccaggtaatgcataaggtcctgttatgagcccacaagctcatgatgggtgaggactccagattttctgtgttgtgtactgttttggttttccacttggtagaaagcttatattaaaaaactagatttgcggggccgggcacggtggctcatgcctgtaatcccagcactttgggaggctgaggcaagcagatcacctgaggtcaggagtttgagagcagcctggccaacatggcgaaaccccatctctactaaagatacaaaaaaaatagctgggtgtggtggcacatgcctgtagtcccagctactcgggaggctgaggcaggagaatcgcttgaacccgagaggtggaggttgcagtgagctgaggtcacgctgctgcactccagcatgggcgacagagtgagactccatctcaaaaaaaaccaacaacaacaaaaaaaacagatttcctattagacaaatacacagtgtgcaaccagaaaatgggtgagaacaaaataaatattgatattatataataatcatctattgtaactacctgatgcagttgcaattctgaaaaagccattcttgggagaaagcttatgtaaaactgaaaagtagaaaacttcaagatcctcatgtttatctattttactctatgttttccccctaatttcaggttctaaaggaaaaaggggaactttgggattcccaggtcgagcaggaagaccaggcctcccaggtattcatggtctccagggagataagggagagccaggttattcagaaggtacaaggccaggaccaccgggaccaacggtatataggccactgaaatatttacattttagtggtggagtgagtgccttgaaaaatatcaacaagtacccagattcggtgtgggcagagaaaattgaaactgttactatactttcagacagttatttggatttttaaaatcctatctccacaacagaggatgcttgtctgtcacagagctgtcaacttctgagagcctctttcagtcaccaaggaatttctcacactgtctctgcaatttaggtgtgctgccagaagaaggcagtgattacaggcccatacaatcagataggacagtgggttttttcttgtgatacaaagtggcccatttctgctgtactcatctcagacttataaaaataaatttccaaaccttctaataaaaaacacttgtcggccgggcgcggtggctcacgcctgtaatcctagcactttgggaggccgagacgggcggatcacgaggtcaggagatcgagaccatcttggctaacatggtgaaaccccgtttctactaaaaatacaaaaaattagccgggcgttttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaacaaaaaaaaaaaacaaaaaaaaaaacacttgtcttacaaagactaacaaaagatacaaaataaaataactttacagcatcattagaaagcgaacaaaatcctaagatagatacatttatctttcttgttttagaactttttctgtgtaatggaatggaaatgcttaatcttgtttcaatgttttcagtgtttgtgctttgtcaaattgaggttggatgttaaagcccttactactgtattatacaaagcagcaaccagatgtttcaatagggcttggctgctttcttaggtttattctcttcccaattatctgagtacagctctcacactaaaagccagagatagaccactagagaatgattaatagaagttcctataagcagaagttgctaacgtgggattccatggaccactgggaaaatctatgggatcccaagaagcccagcaacctcttgaaactaaatgcaaaatgtttgaaaatgtttttgtagggtagagtctatttttcagatttagatttttagattttcaacagtatatgtatgactccaatatataaaaagtattacttagggaaccttctccctctttttggagacaataaaataccacctttcctaaatatttccaccagctatagtctccagtagtaactgctaaaacaagaaaaaaatttagacactacacagacccaagaaagcaactgtttactacttggagcacagacaaatgtctttgttctttatatttagattaagtcctcagaaaacctgagattgcttccactgagatatttgctcaacgaaaaatcctatttgacttcacactcaattaactgatagtttcatttagatttaaagttttcacaggtaaccaccagaataaatttttagaactgtgcattgaacacaaaatgagctggttttatcatgtcagcaaaatgagagtaacagagtagtatattttaattggctaccatagaaattttgtaaatctttatcaaacctatatgttcgggtttgtcgtaaaactgaagtgaagatttaatgaacactaaatcattggaaggtttttaaaacatgtgattgacatatgtgcatgcatagcatttgtaggatacatctttatttagtctatttctttcttactcccagctactcatcacaatttgtaactatatatttgtgtgattatttaatatctatctccttactggtctctgaagctccatgaaggcagggactgtgtatgtcataaatctatataggttaccattatatcctggtaaaagctggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcacctatcacagtgctggcagatagcagatactaatatgaattgatgaatgaatgaaaaaattagtgaataaagtttatgctgaattcttaccacatatcctgcttatatgagaattttaaaggtatttgactacatttaagggggatccaggactgccgggtgatatgggaaagaaaggagaaatggggcaacctggcccacctggacatttggggcctgctggacctgagggagcccctggaagtcctggaagtcctggcctcccaggtaaggcttgagtttacaattctaaaagctggaagcattactcagagtatagccctcctgaaatcattgtggtaaacagaaagctatttatacttttatgctgcagttgcttttattcaactttgaacttcaaattctaacacactaagagaattcattaagagagcccaattttactaatcagcccatttggactgaaatacaaaaatatgttcctataaaaaacacttttgaagaactgcctcaacaaattcagcccaaggatacaaaatgttagccgttatacaatcataatgtttgtattagtttgtccaggcttccatagtgaattccacagactaggtggcttaaactacacttgatgttagccaaaaggctgagaagtgattaggtggcttaaactacagatgtttattttctcacagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggcccaccctactgacctcattttaatttaattacctgtttaccagccctatccccaaatacagagtcatgttccgaagtactgaaggttaggacttcagcatatgaatttggggacaacacaattcaaactacaacactgtgctgtgactctttttcgaacccatttctggattgaattttggctttctggcttattagcttacaattcaggtttagggttttgttttattaaaaacaactgtgaaactatcgggttgcagattcaggtcttacttaaatacaataaactacctgttcaaatacagaaagtttcaataaatttgcatttaactcgcaattaaaataaaatcgcatattgagtggtgcttgtggttggtgtacacacatctttgaaagtgattagacacatctctgcactggttctccaggaaaattgcagcctggacaaaatcatggggtgaccttgcaacaagagagcttccttaaggccagcgtgagcatggttgactataaaaacagaccgtttcagtcactgttgtaatcatttatcttttggtgatcttttttcttccttcccctctcttcatttccaggaaagccaggtcctcatggtgatttgggttttaaaggaatcaaaggcctcctgggccctccaggaatcagaggccctccaggtttcatttttgtactttctctttttccttttcatgtgggagacacattttctcctgaggtttggatttctgtaaacctactactctatagaaggtagctcctagttactcagtatccagacaaaaatgcaaaaaaaatggggttagatatttctatctatttaattcaaatatttggcaacctattccaaactgataatcctcatgataatagtaatctgtatgtggttttccctgggaacatagcttcacatagctacagttctgaaaaacagcctgtttaacacaattccacacatctccctggtattcccattaggccactggcaagaaataaatcctctttttgtataccatagtttggggtttttgggttttttttttttttttcaggtcttccaggatttccaggatctcctggaccaatgggtataagaggtgaccaaggacgtgatggaattcctggtccagccggagaaaagggagaaacgggtacaacttgctcattatctttgatccgttagttttattttggatagaatcattagtaacagtgtaatcctttgctgctctaaagatttttctctgatagaactgattatctttaacatgttttcggtgtgtactaaacttttctcatagacatataatgtaatgaaattgaccaattattaacatgccaagattatctctttcaggtttattgagggcccctccaggcccaagagggaaccctggtgctcaaggtaagcagttcttcttccctgtcctaatgtacacattttcaaggagagaaagcagttgaatatgcttgaaatataaagtaagcttaacctagtgaattaaagatgttccaatagtaatacaggatatttatcatcttggtcttcaatttaaaatgtttaattattaccatcacaacaaatggaatgaattagaaactgtgattcaattttggaatttcctactaagaaagtcttgaaaagtaaaaaggattcttctgtatatgtcttgctgttgttagcatggtttaaagataccacctcctaaaaggtgaaggtggaactgatgggttctcagtaagcatctgtccctgctgttctgagacacaggagtaatccgaatcctttcccacctgtatcttcataggtctgactccaacccccagatccagcttgcggtccatgctattgtttattaaaggcgacccagagagtctctcaacatctcagacatggcagtttactgaacatgtcattcagagtatttacaagttttttgtttggcaggccacagatctggatttctcatgtcagtgctttacaagataaacagcttcttttaactcttttccattttctagtcaaaccttccaggagaaacatcagattgtttgcacatttcattgacccgtctcagccacgcgtcctatgaatgggagcatttcattagcaaagaggcctaacacactgaagggctctagttattgatgttcacgcaaaccagcaaagagcagctggatgccaatgagaaactcagttgggcaggaaccacctcttgacaaaacagttaaagtgtaaaagtagacaagagctgttctctcccatttgtttcttactggtttgattgttctttcggttgagctcagtcttcccacatctctcagacctctcctttcccaatgaggatgaaggctcttcctgttccacagtgtagctttagaattttggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggtatgaatccttttaattagtttattctcccaaatcctaaaaagaaatcatattgcagagcatgtaatcattttaatgaacatgaaatatataatccaagccatcttggtacttcaggtcattgccatgcaaatacagtattacaaagcttggagtgaactgaagtcatctaagcactttcttttaaaagcataaattacaggcattaaaaagctaaaggatgtgaatagacatagggctagatcgtcaatattcatcaattttattttcattgtaagtctttactatataataactccccaagccctcccctgagctattagcctccctctccttctccctctccttctgcacatctatcttccgttttcatgccatttactgctgctagaataacacagagatgggagagcagagggagacattatttgcaattcatacaatatttttcattcatgaatgtcaaagcacaatttcttgaaggttttctaagatgaaaaatattagtattaacctgtgacctttttggagggtctttggtaaatccaaacctcctgccactagtattcctattatggggaatgtgtggggaagttaactaaaggacagaataaagactgcaattttgttgctcctttgtctggatttagctggataatacttcaaatgcacacatcagtgctacgcagtttagcttcttatgctctaatgaattatcagtgactcaacaatgtcaacatgactaagttaatcagctgataataactggcttatatttatataacactttagagcttacaccatgcttttatgtctgtatgttatctcacttgatctgaaagaattagctagaacaggtattaccttcattttttaaaataagaaaatcaaaatttgtaatagtaggtaaatctgaagtgactttgccaagatcagacagctagttggagacagactgagtctcaactcagtttttgtagctctatattgcatttaccagcaatatattataaaatatatattttagaaacatatattctgaatctgaacacttttaagcaaagtacctacattattaaagatagtcaagaactctaacccaagcatatgggcattaaagaaacttattaagccttcttctttgcaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtaaagggtttacttttaaacagcataaaataacaaaaatcatgtttgacctcaaaagttttcaacctcctcctcatgttaccttgttgcttcttctttccctgtggtcatctccattcccccactacctgtggttcccatacccagcagttgtcaaggcaaggtagcctgtttgagggatgcatagttaataaattaacgagcctggctggacgcagtggctcacacccgtaatcccagcactttggtaggccaaggcagacggatcacttgaggtcaggagttcaagactagcctggccaacatggtgaaaccctgtctctactaaaaatacaaaaattagccagtcttgcttggtggtgcatgcctgtaataccggcaactcaggaggctgagatgggagaacctcttaaacctgggaggcagaggctgcagtgagctgagattgcgccactgcactgcagcctgggcaacagaacaaaactgtatcaaaaaaaaataattagcctaaaagacagtgatgcattcattcaactctatttgttgaatccctagagctgggctaggctctagggaagcaggcacagaccctgctgtaacagaccctcactggggagaagcagatcctgctggtgggtgccaggtgcttcgctggcatcatcttctcctgtctttaccacaatcccatcacatgctccaggggaaagaatgtttgtggcaatgctaagtgaagggtttatacttcattagaaacaatcactgataaatagaaccttccaagctccctggctggcaatactgacagacttttcatgaattcaggtgcgcctggtccccctggacctccagggagtcatgtaataggcataaaaggagacaaagggtctatgggccaccctggcccaaaaggtccacctggaactgcaggagacatgggaccaccaggtcgtctggtgagtatggataattattttgactcattattaattcaatatcaacttataattattcttatattgtatattatatcatatattgttgatgttaactgtattagtccattctcatgatgttaataaagacatacccgagactgggtaatttataaaagaggtttaattgactcacaattctacatggctggggagacctcaagaaacttataatcatggcagaaggcacctcttcacactgcaacaggagagagaatgagtgccaagcaaaaggggaagccccttataaaaccatcagatcggccgggcatggtggctcacgcctgtaatcccagcactttgggaggccgaggcgggcggatcacgaggtcaggagatcgagaccatcctggctaacatggtgaaaccccgtctctactaaaaatacaaaaaattagctgggcgtggaggcaggcgcctgtagtcccagctactcaggaggctgaggcaggagaatggcgtgaacccgggaggcggagcttgcagtgagccgagatagcgccactgcactccagcctgggtgacagagtgagactccgtcaaaacaaacaaacaaacaaaaccatcagatctcatgagaactcactcactaccatgagaatggcatgggggaaaccacccccatgattcaattacctcccactgggtccttcccaggacatgtggggattataggaactacaattcaagatgagatttgggtggggacacagccaaaccatatcattaacattgacttatcgttagtacaagagtactattatactcttataaattaattgccagatcagatgggcctggaggcagcaaaaatttacaatttttgatgcatctgtgcagtgtgcctaagggaacacagtccagaagtttctgaaaatcaaaaaatcttcagagttggaatgatttggcctctaagaggcctccaaaactttggtctgtatgggactcacctctacagcattccagatccttgcttatttagaccctgaacaagtccagtgacggaatcttcaaaaagcagctgggagttcagaatcactctaaatgacattgtcacttttccctctacttacaggcttctgaagatttctgcattcccctgtaaatgcctatttattttctgccccccaaatgcctgccaatgtttctaaataactgccatttctttccaattattttattcctggataaatacttggttctttcaaattcagtttaactatttatcagccttgcctctatactgaatacaccctagtttcaatcgccctaaaaaatatagcctctggaatgaacgccctccagaagtaagaagtcaataccccagtgagtggctaaaggacagaagggtctactgtccggaacatcaccattttaggaatcagacctaaaattccacttgggccattgggctgacctacctgtctccacattgtgcctgtaatcaactaaagcccatgggccttttcctcatgaactgctactaagttttctccattatttcttgcctagcttgttgttgctgatgtttatttgggacttaagtgtagaacttttacatttatcaatcttagacatcatcttattcatttaggcctgtgccccaagcctgcaatctctcaattcatattctctctctcaacaccacagccgtcgtccctagctttctcttagcagcgtattagacaagttgacccctctgtttacatcaaatccttggagacagatgttgaatagatgaatgtgactcagggatcataactgagtgtctactctgtaccaatggatagaaaaacaaaaagctacagtcccttgccctagaggagcccacaataaagtgagggtgatagacacagagacggccattttcacactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatgaggacaccttgggaggagtctggagggctaagcaggagtcaggtaacggaggtctggttttctagactaagaagagggaggaggacatcacttgctgatccaagaaacacttaacaaagcagctctttgtgcccagagtttgctctctaccagctggaattaatcccttaatgaactgccttttgatgtggctattcaccaagctttaaatctatccttgttgctctatgcagcagccattttgtccacaaaaatatagtagagagagctaccatggcacatggcacagctctctctaccatgtaaattgtcagtgtaaatacattgacaattcatatgtaaatacagaacatctatggtataactcattttgtcctctactaacctcatcagtgatgcgtaatgaggtgctttgccatagctcattgttaggaatcgctcttaagtactcttggtatttgatttccagaatctaactttaaaagtttttttgaaaaatgacatatttgcccatcttcagtctgtaggtgtctctcatgttctccatgattctttgaaagttgccaatttgatccatgattacatctgaagaccttccaaaggacactgggatatataaagcttggtttggaaacatgatcttacttaactcctctggtgatttcgtggtcattcataggcttctatacttacagttgaaagatatttcttgatggatgtctcaactggcctggggcctttaacagctccctcctgctgccagggataaccctggcaacatgccctttttcatagttaccttagcctcaagagaacaggcagacatcagaagccagcaagtccttgaccagatggttctgttttgtctctctccttttttaacaacactttatccaagcaatcagatggttccttctttggtcttcttgctccaaagatagctggttcaaggccagttttatccttggcacttttcatgaccttcaaagcacattattctcaggtaatagcattatctcaattcacatggacagtatgaaagtagatttagcatacattttgacaaatagctctttccagaagccctgctccctcctccctccttctatggctttgcttgagcatctcctggctataagaccagttcatgtgagcctcacaagaagagagcacctcgttcctgcttagattattgcatccttgtcaaatatgcctgtcaaatactctctcttgacaactcctgtacactcccatccctagacattacttctcctaccatcatgatcaagtgtaatttatggctctgctagcttagtgagaatgaagcttaggtgctgtaactcaacaacggttttgttgtctttgcagcaattataaatacagattataattttcattctgggccaggcatggtagctcactactataatcccagcactttgggaggccgaggtgggcagatcatttgaggtcaggaggtcgagaccagctgggccaacatggcgaaaccctgtctctactcaaaatacaaaaattagccaggtgtggtggtgcatgcctataatcccagctacttgggaggctgaggcatgacaattacttgaatgtgggaagcagaggttgcagcaagccaagatcatgccactgcactccagtctggaggacaaaacgagactctttctccaaaaaaaaaaaaaaaaaaaaaaaaaaaaatcattctggcagtactgggctactccatttaggacacagaatatccagttgaatccaatactaaaacaacatacaccaacattagaaggtatgtttgctgttgggcttaagggaagcttttgttttacttttaaaacgatagtcctaaggaaaggttctaagtggccagaggagttatagccttgattgaaagataaaaatgatgtctgctaacttcagcttattctcacccaacataatattataccctatttgcatttttaaaaaactgctgtgaattgagtgattttaaaaatttgttttggttctgctccctttatttgaaatatagggagcaccaggtactccaggtcttccaggacccagaggtgatcctggattccaggggtttccaggcgtgaaaggtactgtttttgtgcattgctctttatatgcaaataccataacctcaattcatattttagggcacacaagtgtttgctgaagtacagacagctggggttagtacaaataggacctcaatacgagtgaagtaggaaggctccactacactatttcaagattctttgaaatagagtatttcttcagatcaatggctctcggtaaccttcttttatttgtgtaaaagactgtgattggaagagaagtcttaccactttattagttcacatcaaagcaaatattctctatgtgctgaaaagaactcctaacgtaactaactctaggctattagtaaagctagagtaataagctgagaaagtaggtaactatgacaaccaagcaatataattcaccacatggtagaacaggttttaatgtgactttgtatgttaccgtaaatatcaaattggtttctgaactcaaaaagtggactcttagggacccttccccttcaatgttaaaatacaagttcttaatgcctacttctggaatatatttctttacagactcattaagcatgacctactgggtcccagtgacatgccaaaacctatgtgaacaaaatgaaattgtagcccttgtgacagaacccataggacagagcctccaggcacacttctagtatttgtccttagagtcaatcatcaacctgaagaactaggaaacccattgatctaagtggaatcacactgtgtctttgtttgtttttaggagaaaagggtaatcctggatttctaggatccattggacctccaggaccaattgggccaaaaggaccacctggtaaataaacgtccttactattgctgtcaatgaagaaaggtaacacatccgtgaggccatcatcttcttcttatgtttatgtcaacaggtgtacgtggagaccctggcacacttaagattatctcccttccaggaagcccagggccacctggcacacctggagaaccagggatgcagggagaacctgggccaccagggccacctggaaacctaggtgtgggactggcagcattgacttggatcactaggaagtggttgaaccaaaatacctgtaaactgctttggaaacagctgatacaacttcacagaaaatgttgaacatgatagtggttttcacaatcagtcttaggattgagctcattttacccttgaccagcaaataaaagaccttggaatctattgaaagcagttgttcatagtataacttgaacaaatacactttagggcagcatgttttttttattattttttattaaggtaaaggtatgtctatctcctctgacaactgtcagtctcggggctctatttctaaatgattgtctgaatatacctgagttctgtgaatttatacttttctaacatttggtacagcaaagtattaggaaaaaatgatttagaaatcttttcaaaatactggtgtttggaaattgaactaacccctctacatatgcacagcatatcgtaataggcttctgaatggaatgattatgccttaagtttgtctgaatcacctgggagataaagatattacttatttgtttgatcaattcagggacatagtgaattctggaagaacataaataaaaattgcagcacaattttaaactgctgcatttagtatcctcatagttcattttcgagagtcttattttctgggaagtggggctaacaagttaggtgactaatcatcctagcttgcccaggactgaggatcttcccaggatgcaggactttcattcctgaaactgagaaagtcctgggttaacgggatggttggccaccttacttttcatcctatatgataaaatgcaatacaatgttggtttttgcctaggaccctgtgggccaagaggtaagccaggcaaggatggaaaaccaggaactcctggaccagctggagaaaaaggcaacaaaggttctaaaggagagccaggtaaacccccagcttgtttcctcaccgaagaagtgctatttcgacatacagagaagtcttgttcgagtgggtgactatatgagttatctaggcctttgagtttatgttgttcagatcagaccaaaggccaaggatcaaatgttcatttggaagatgagaatcaagaattattggaacacagtatttttccgacctcttagctggtcagatgggctccaaactgatgcacagtttagcctgaggacaaatagaactaataagtcctatgggtgttctttcaaaaaggccaatacctgtttttaataacttataggagttgttagttaataattatttataggagcagtacataagtatgtagctagaaaaatattaccttggtatgagtagaagagcaactgagtatccttttttaagaaagccatcttttaaaaatgccattcttcatggtggtgggtgcctgtaatcgcagctacttgggaggctgaggcaggagaatcgcttgaacctgggaggtggaggttgcagggagccaagatcacaccaccgcactccaacctgggtgacagactctgtctcaaaaaaaaaaaaaaaagccattcttgaatagaattcaacaattcatgcgtgtcctgaaaagggaactcttaagtatagtgttttattctgaacatatgctgtatgtgtcagtttgatacctggatcaacatctaccttctgcagatgtttcaaagcactcttctggaaactacctcgatatccaaatcttctatttttaggattgctgactttgttaaagcaagaaaaaattctaaatgtgctttctgaatttactgacatatatcatgctcagatctactatattaaaatggtaaagactatagacttaaatttttaaaaattcaaatatgatgttaatataatactaattgcataactacatgtgatttaatattgtcataggtgcacagtagagtgctattaatcattcaactttccttaaagtgtggtttttgaagtgataaaccattcttattaagaattctattaatttaaaaattttaatgaccaaggctttaatgccctaagaatggggcaacagcaagagcaagggcactgcaatataaattttgtagagaactaattagcaagtagacagttcaatgctatggaggcctcacaagaatgacaaagggatctaagagtcaaactgcactggcataaactgatagccctggcccctttcttggagatacagaaatgcattggatatcacacatttgtataaaagctcacttccagttcctgccctgctcagctaatcacttcccaattcctgtgcagagatgaggagacatcttttgtttggggccaactatagctccctctgaatgagggcaggggttaggaaaagagaaaaatgtgtctccccaatatattaaaaccatggcaacttggatttttcaagtaagacatcagaccggagaatttggatgtggcctatttttaatttcaaaaaaccactcaaggtccctggaggagacaagagtgggcagaattcagagaaaattgaaaaaatgcataatattggggcttttacaaatttctgaggaaagtcctgacttccgagtcaggactaaactgtgaccctgcctgactcccaggggcacggatgtcccaggggcaacaaaactaattcctgtgatgatgtaggcccaaagtctaaccatcgctgttttctctgtgattccttaggaccctagagaaccatggcccaagtctggttggggagggagtcagcgtacagtggcagcagaaatggatgggagtgaggaagtggtagccaatgccaataccataaataatagccgttcaatgaaagaaaggagaaggaagttaaagaggaatggaagagaggatagctcactggttctcatctagaacacgacaagtgtggattagccttgtccaaatccatactccaaagtatagaaagtttttctccacagagagaaaaatgtacagaaacgatttactttgtttttaactcatataaataaactaacccttattacagtgaaaaaaaaagccttctcttcttacttgacttacaaattgatcaaaacttccttgaagtttgaacctttaaaaagagctttcaatgttttctgcaattgtttattgtagacaatgttgcaataatttgtgaatttatcaaaaccataagtaatttttgttatctactcgaatagactaagttgtagatatttgatttttcccccatcacattgtaggaggattcattcatttattcataaaaaacatacataagacctaccagatgcaggcaggccactgtgccaggcctcacagaggaattcaaagataaagacctgatctcaaaaaacgcatcaaatatacacaaacattgataagaagaggcactgtgtgataaactgcttaacatttaataatactgtttggccatttttataagccactcttctctaggattgctttcaatttatgggctcaacatatataaaatatatttaaattagtactttgaaaaaacgagtttaagatttttgtgtatgttgcaacatttagaatgtgttttttgaaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggtaatgtcccagtcccagttgccagttgtgctgttccacatgcagattgtaaatctttatagcctaggatgcttccctctgaagttaagtgtaaataaccttgagtgtctcctgatacattttaaagagagcaaataaaacactggcctgtctaattttcattctggaatgtaaaatggtggaaggagcctagctcaggaatgctagcctagctcctcccattcagtgcaaacaatttgcccctaaaactccctaaaccacctgtctgcatttatctttttggtgctttttctttttcttttttctttttcacacagggtctcactttcatcacccaggctggagtgcagtggtgcaatcatggctcactgcagcctccacatcctaggctcaagccatcctcccacctcagactcccaaatggctgggactacaggcacacaccactataccaagctaatttttttgattttcagtagagatgaggtctggctatgctgtcaaggtttctctcaaactcttgaactcaagcaatcctccctcctcagcctcccaaagtgctgggattacaggcgtgagccaccatgcccagcccacccatttgcttttcaatctcacaaataactgcttttctaaacctttatttggttattagctattatgtacatatgaataagtgggaatactttgaagcaaaaacactatcccaactgatctatgctagcccccatgttctaaatcgattagaaagagccaccggaagtattaaaggtgggagaaagaagatttgtttgcctattggatctttgatttctatcagtatgaaaacttttcaatactacattttgcagataactcttttgtgttgtctttgtccagcttttgctgcaggttacatttaaattagcttctctctagtaacgatgctgaaaataactttaacttactgaaagtgatactcagtctgatgtttcattaggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcaggtaaaaatccaatcccctagttttacaatgggaccaagtgaatcacttcccttgtaatggaatgaaaggcagcacatgacagtgcagaaagtggcaatgccgccatagtctttgtttcatgttacagatgcactgtttgtgaaggtcctgcgatcgccatagccgttcacagccaaaccactgacattcctccatgtcctcacggctggatttctctctggaaaggattttcattcatcatggtgaggagaaaaggaacaggaggtttagggtaaagactacctgtagaatgttacattgtgctgggtaaaatgtgattcccagggtcgatgctgcctgctgtccgtgtgtgcaacatgccatagacatttccttgaaaatctacaaacagactttttttttttacttttggtaaataatggagtactaaaaaagacttctcaggaggagattacctacaaattctattatgaaatttaggtgaatagtagctgcgttttattgataatggaatgtctctttttattattttttttatcttttgagacagattctcgctctgtcacccaggctggagtgcagtggagtgattttggctcactgcaacctccgcctcccaggttcaagtgattctcctgcctcggcctgctgagtagctgagattgcaggtctgtgctaccatgcccagctaatttttgtatttttggttttttgtttgttttgtttttttagtagagactgggtttcaccatattgcccaggctggtctcaaactcctgacctccagtgatctgcccaactcagcctcccaaagtgctgggattacaggcatgagtcactgcacccagcctggaatgcctattttttataagataactgctttacatacattctctgtaatttttatgaaaacgctcataggtaatttctatcatttacagttttacaaataagaatgaagtactttccccagggtcttacaactatttagtggaaaagctaggatctgaacccaggtctatctgctccaaaatctgtgccccttttgacattcatatggagataaaagcaaagaaaaatagtcttttaaagaaaaagctttcagatgtaaatgctagtgaagaagtttatggattggccatgtgtgactgtgatgactgtcatagctgcacgcaggtggttctttcttttttctttttctttgtctcttgagacagaatctccctctgtcgcccaggctggagtgcagtggtgcaatcttggctcactgcaatctccacctcctggctcactacaatctctgccttctggctcactgcaatctctgcctccagggttcaagcaattctcttgcctcagcctcctgagtagcttggactacaggcacatgccaccatgccggctactttttgtatttttagtacagacatgatttcactatgttggccaggctggcctcaaactcctgacctcaagtgatctgcccacctaggcctcccaaagagcgagctgggattacaggtgtgagtcactgcgcctggccacataggtggttatttctaatctgtagcatcgctcatgatcattcctcccctttctttactcacagttgcccattcattcaaaaaaaaaagtagagaattgaaaatttgaaccccaatggacagagtgtttattcagatttttaaaattgtggtagttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcaggtaactattcaccatcaagcttaatctgatgactcaattgcagaactattcaaaggttgcctgtgttcttgggtcaacgagtagccatgattttgtactactgtgccaataaagacaaaatatgggttttgtcatcactaaacacatttaatatttgtatatgaatttatagtaaattacttgatacaatcacaaaacgatctctcatctgaatttactgtattgaaagacttgtgaataatgtggataatttaaagggtgggagtagtttttattaccaaaaagatgatctataagttttcatcaaggcctatgtttctttaatgctgctgaaatatgactaaaattataaaatgccaccatatataccttttcagaaatatacttcttccataaagagaaatagtccattaatataataaatttctctccttttttttttttttcttgagatggagtctcgctctgttgcccaggctggagtgcagtggcgcgacctgggctcactagaacctccacttcccaggtttaagtgattctcctgcctcagcctcccgagtagctgggattacaggcgtatgccacgacacccatctcatttttgtatttttagtagagattgggtttcaccatgttggccgctggtctgaaactcctgacctcaatttatcctcccacctcagcctcccaaattgctgggattacaggcgtgagccaccacgcccgaccctgtaataaatttcaaaatagcaaaaatattcattaataaaacaaactcagcaaaaattcccttttatgcataaataaatgaatttttttggtttgtttttatttcagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgga

SEQ ID NO: 20 - DNA, 161743 bp, Homo sapiens
  source 1..161743: mol_type = genomic DNA
gtgcccaggaggcgagaaagggctgggcgcctgaggggcaggtgggcgcggatccagggtaaggggttaaggaggtgatgctcccaaggtccgggggcccaggcggggaagtggggtgcggtcggaggtggggcgtttgggggtgtgcggtggggaggtggctgcgcggtggggaggtggctgcgcagggtggagggagtggccagcggccctgcccagattaagcgggaggcgcgccgggcgtctgcactcgggaggccccgcttgttccccgcgcccgcggcggtccgcgttccccgcctccagcccgcctccaacttgcggccgccgggcttggctgcgagagcgccgcgaagaggcagcggggcgcgggtggattggggctggaggtgcgcgtcccgtggggtggcaaggcggcagctcctggcgctgcgggcgtccccacaggtaaggcgcccataggtggggcaaccgctgtcccggggccccggcacctgcctgggaggggcagtggagggagcgtggcattcaaggggtggtggcgggcccagctggggagttgtggcccgggggtcaccagaggagagcgcgtctggctcctgggcttgtctgcctgggctttaactgggtgctgtgtgttttgattaatttggaggctcgagttaccggcctggcagtcggggcactccaaaatgccaagagaaagaggcagctgaggagaaagagaaagcccatcttattctccgctgagttgaactgcttttcaggccaaatcttatctgcggaaatgcagggcaaaacaagactcagctctggtcagggtgcgctcttcctgggggtggcctgcgatgcaaatgtgccagggcacggtcctccagccggctctcgccgtttcctgtgctacggaccacactggctctggtaaagcaattagactgtttctcagaagaatgttgtgaaatgcataaaatacaattaaatcagaatcagttttattggaatgcaattatggaagtcctcaagtcgtgatatagtaactaacacaggtgcatcatcattattgcattaaatagcttgatttaacagcaggccgattaagcaacagtaatgtcaaagtagtgatgtctgcaaatggtattttgagataatagcccaaactgaaatgtgacatgaaaataccggtgggtgcaaattatcaagaactgccaatactactgtgctctgttgcctgtgctcataagggaaggacatgttgaacttctgtgacatgttactaaaagtaaagatgcaacttattttcctatgtgagtttcctatacagatcacctgaattccatcctcaggttaagaatctttgctttggaacagtgttgctgatatttgctgcaattggcttcagacaccaagtatgatcatgcagttggtcactgattttagggaaccacttgcttgcagttaaatttgggatctattggtatcttagaactttgtagccatgcaggtaggcaaaaccctaacagtgaatgaagacactcctcccattctttttattttgactatagcatgaatcttacagtcttctttctgtcttttatgccagtgattctcaactatcgttgtgcattagaatctttgggaggataaaacaatgttgctacccagaccattccaagccaattttatcagactctctagctgttttaaaatttcctgtacattcccatgcacaatcaagtatgagagctcctgttttcacgaacatgtgaaaatttcacgcacatgttgaattaggatatattcttagtagaataataaaaagcacatatattaaactcttcattacaacttgggaacactgcggaatttatgaccatatcgcagatgttgctgtgtggtatgcagtagcttctttccattggtagggaaggttcttctggaaacttctgccactcttgtggaatgaaacggtaggtgttctgttgatgaggtgacagtgtccaagagttctgagagtcacatgattatgtttcacaaactgacagtatttaattttaaaaagtacaaacaaaaaaatctcaatgctaatgttaaatgcttctctttgccaaattccagaagattcctcaatttgaattttaattgccttttcctgaaaccaagtcattttgttggaggactagacttggttttatcaattttggaacaggaagtaatagtcaactgcaagtcatttctgttgcagatacagagctggaaagaaacttgtgatgtaaatacagcaagaaagaggcaatgctggagagcttgacctctggagtagactctggagttttgaatcctttccatacttactagtgtgacctaacctctctgggctggagtcttccttctataaaatagacatactcaccatacccacctcagggagttgttggaatctaatgagatagcaaaaaccctttgtgcagaatcttcacacagtagtcacatagtgaaatttgattctttttttttttttgtacaaaggaaaataggtggccctgatgagaaatggtggcacgtggtagagatgctcttctgagctcagtactaaaatggctggaggcaagcatagcctatgaactcccttgaggttaatacacttccaaggcctctagaaccttgccttggcatcccttgggaccagcagcattggcctccctgggagcttgctggaaatgtagagtctctggtctcactctggatccactgaatcagatcccacattcaccaagatctccaggtgattcgtatgcacctggtacttaaaactctgagaagttgcttatctaaaagccacatttaaccacctattccccacctgccacatttagaacaatgtttgacaggctcacctgtcaaacaaacaggtggtgttaattaactggaaggcttgattgttaaaaaaattgtctttgggtcaagagagttgatttttcacagttggttctttaaatgtaaaacagcaagaggaaaggaggatggttcttttcgtacattcaaaggacacagaggtctctatttttttactttgatgccatgtaggagttttaaacaaaatgagtggttattgtctttgacaagtcctatgtaatttgttttcacagtatcatgtccgttttctacacactgtttaaatagttgtgtctgcttcactacatttcaatgtaagccccattagggcaggggccatttttgtgttctttactgatgttgaatgaatgagtgaggctgttactgtttcctgaatgaattaatgaaagcacaaatgaagttgaatgacttgtcaaattcacccagcattcacacttagtctggtttcttcctaagttcatgatctacctctagccttcattgtagagggacgagcctctacttttaatgagatacaagatacacctcttatgctgcccacagctgcttcattaatcttgtttcatttcatctcccctcttagccatccttttccttttaagaactttctcttttccatacctctgaaacaattaggctcttgggtgcttttagaatctgagtgattaccaactcatatcatttcttgccattgcatctctggactcctcttctgcttctctaagttcgtggctcctgccttgcactatcatctgtggattatggtagctatctagctagttttctgtcctgcaggctttctactctgaaactcatcttctatgtaattatcagagttaccaattaaaattgcaaattatgctagcaaggacaggtgactttagaggcagttacaaacaatccccccagtccagaggcttatcattatggaagttttcttatcatttctactacatattcatcacgggacatggggaggtgggaatggggtgggggtcctctgtttattgtagccactcagggacctcctggaaattccctctcaacatcttctctaatcacctcagaaggggaagagaatgtgctaaagtaaaactacccttcaaccttcctcctagatgtgacacaggctacttctactcacatttcactggctaagtggatcacgtgatcatgctttattctgtaaggggcagggaaatgaaatctaccacatgcctggaaagagtgggaaacaggtggcaaatgtcagtaatactcatcacacacatcgtgccacttgtttgtttaaaagcttccagaagttcccctttaacttcacaactgatttcacatttcttggaatagaatagtgtggtctcaagtcaacatttttgttttatctcttgtgtcatcccaagctttttatgatttctctggttcactatacagacttcctcacctcacaccttcgtatttactattgcctctgcccacagggacctccttcttggtctgtcttctacaactacctgtgctttaagatctaggtcaaggattaaagagcatggtccctgtgaacacctttgtccagaactttattatatagcacagaaataatatgtggtgatttgttgttctatattacaaagcctttgagggaatgttcagagattatttgttaagtgtattagtctgttctcatactgccatgaagaatcacctgagactgggtaatttataaagaaaagaggcttaattgactcacaattctgcatggctggggaggcctcaggaaacttacaatcatggtggaaggcacctcttcacagggcagcaggagagagaatgagtgctgagcgaagggggaagccccttgtaaaaccatcagatctcatgagaactcactcagtatcatgagaatagcatgtgggaaaccacccccatgattcaattacctcccactgggtccctcccatgacatatggggattatgtgattacaattcaagatgagatttaggtggggacacaaagtcaaaccatatcattagggaatctaaaaagtatatttcttgaggtataatctatgttccataaattgcatccacttaaagcatggaattaaaaaagttttgccgatgcatccaccctatgaaaccaccactgcccatcaagctgcagtatttttctatcactcccagaagtttctttctgcctctttgctatccatccctctttccaaaccccatcctcagaccactactgatctgctttctgtcactgtagacttcattttagttggcattttctagaattttgtgttgacggaattataccgtgtatactatcttacatctggcttctctgactctgcatagcaatattcagattcatccatgttgtgtagattaggagtttgttattttctattgctgagtagtagtccattgtgtggagatcacactttgaaaaaaagtccatttacctatttttgggaatttggattgtttccagtttggggctactacaaatcaagctactatgaatatttttctacaagtctttttgtgggcatgcattttcatttctcttaagtaaatacctaggaatgaaatggttaggtcatatggtagatgtacatttaattataaaagaaatagttttccaaagtggttttattctaccttctcaatgcaaggtagaataccatgcataggagttccagttgctccatatatttattttgctgttaattttttaattttagccatcctaatgtttatacagaagtatcccagagtggtttgcatttctccaataactaacgatgttgaatatcttttaatgtacttattgaacattcatgtagcttcttttgtgaagtgcctattcaaatcttttttccgcttaaaatttggctttttatcttcttattgttgaatagtaagagttatttatatattgtggatacaagatcaatgttagatacaagtattgtgagtattttctcccattctgagaattgtcttttcattttcttattatttttaagaagcaaaagtttttattttgatggaatataatttataatttttttcttttgtgatttgtgcttttcttgttacctgagaactctatacctatgccaaaattgcagaaattttctcctatgttttcttcttgtgtagtattgttacttttacctcaatgatctcttttaagttaatttctgggtatggtatgagataaggattcattaaattttttttccatgtgaatatccacttgttgtggcaccagttgttgaaaagactttttcccccactaaattgccatgattgccatggcacctttgtgaaaaatcaattgatcatcatgtttgagtcttttggttccatttatctacatgtctattcatttaccatcattcttatgactagttttttagcaagactagtgtaagtccttcaactttgttgctttttataaaaattgcttaggctattctaggtcatttgcatttacatatatatggattttatttgttaatattatgttaaggagagtcatgtttatattcacaagatatattgttctgtagttttcctgtaatatctttgtcagttttggtatctgaataatgctagcctcataaaataagttggccagcactctctttttttctatattcagaaagaggatataaaaaaactggtattattttttcattaaatgtttgatagaattcactagtaaagccacctagccctgaagttttctttggggaaggtttttacttacaaaattcattaattataaatttaattgctatagggccatttaaattttctattgtttcttatgtcagttttgataattgatgtctttcacaaaattatttatttcctctacattgttaaatttattgacatataattataagaagattctctaattatctttttaatcccctttgtcatttaatactgtcatattgtcatttttaatattcccaagttttcaggtttatcagttgtatacagaaccaactactaatgttgggtttcattgatttttctctactgtttgaatgctttctccttggttaatttcctctttaatatttattattttcttcattttgcttcaggtttaatttgttcttttcctagttttctaagatagaagcttaggtaattgattcttgatttttttcttttctaataggaaattttatacctagaagatccttttctgcactgggttagttgcatcctataaattttgatatgttgtgtttttattatcattcagctcaaaacattttctgatttcttccttgactcatgggttatttggaagtgtgctgtttaatttccaaatatttgggactttcctagatggcttaccattgaattctagtgtaattatctgcaagatttcagtcttttgaaatgtgttgaaacttgttttatgatccagcatatgatctattttggtggatatgccatgtccatttgaaaagaatatatactattatggcttggtatagtgtcctagtatatattaaattaagtaaagatggttgatagtgttgttcagatcttctgtgtcttaactggtattatactttgttctatcaataaccaagagaagattattaattcccaattatattttaggatttgtctattttttccttcaattttgcagtttttccttcatctaatttgaagttctgttgttaagcacatatattaatatttatagcttcctgcaatattaatttttaaatcattatcaagggtcactgcctatcctgaagtcttttttatgtgctgttaatatatccattataggtttcctatgctgactgtttgtgtggtatatctttttccagtcttttattctcagagtgaatttatgctgactgtgattctacctagaattgtccttctgtatatctccttctaactaactgaaaaatttatcccttgtaatttttctctcctgatgtttaaaagatactttataaggtactgtcatagcttattcctattttttttttccatttcccgagatcttccttccttcctaaatcaagtcttatctgcttcctggggtctgcctggtgtgccctggttttcactttttttttttttttagacggggtttcactgtgtcacctaggttggctgcagtggcctgatctccactcacgcaacctctgcctcctaggctcaagtgattcttccacctcagcctcccacgtagctgagaatacaggcacgtgcaacccagctggctaaattttttgtttttttgtagagatgtggtttcatcatgttgcccaggctggtctcaaactcctgggctcaagtgatccatccaccctggcaccccaaagtgctgggattgcaggtgtgagccaccacacccggccgggtttttatgtttattgctttttcccaatgtattgtgagctcttttttttttcctccatggcagattagaaaggaaggaaagaaacatttattgagctgctcctacatgccaggcattgcggtaggcaccaagtcctactcatttaagtctgttaggtattaatttacacactgagaaatgaagtgttcacaggggctacaaacttgctaaggattacatggcgaagtgtaatttttagttgcataattaattaattacttatatgatgggagtcatcaagatctgaacacaaatcttcttaacttcaaagctctacttttattcagtaaccatgagcacagagatagcaatggagggaggcagatggtttccatgtaggggcagtggcagcagaggtgagaagtcatcgaaggcaaatgctagcctcacattgtatttgggagtggaccctgcctagtggaattgttgagtattaccgctggagttcacgcccaaggcaattccaggaggtctgaaaggtccagagaattcagatagagtctccagccctacttatggggaaaatcataaagcaaaacaaatgtgggggattagtggttttggcaagagacttgacaatactctgaatcaagatgtcattcttaacttggaggcaaagggctcctctgatttggaaagtcagttgtataattttggaacatgtattaccttcttgtggttccgagaagtgacattattatggttgctgtcaaattttctgttgatattgggaggagacctcaaggggaaaatgataataaaagcctatattgccagatggtgggtgaactgagatctggtccaattgcactaacaaactcaactccagtgtcaactgaggactctgcagcagtctcaaacagttcagctgaatctggagggaaggaaaggtgggggtgggcttggccatagtccagcacattctgatcaagttggaactccgagtcattctcaagaatttagttgagtaattgtccagttttccttgctgcttctcagaaaacatgaagctccatccacattccggtggtccatggaccacatagactcatgacccactttgaaaaccttgggatgtgggatgagagtgactgttttgctaaagagctcaaaccaacctaaattctttgaaagtctgaaggtagggtcaaccccaaaaggtgggattttagaaagagcaaaaccaagtaaccagcttgtatgttgggaaatggttaggttgactctgaacagaaaaaaatgtagccctccaaaggaggtgtccaggtagatggatgtgaataagacatgtcattctttttctgggaacactttcatgacctctgagatcctctgcttatttctctacaaaagctgaatattcgagaattctgttttagaaagagaaatgtatatagaaacaggtgttcaagcaatcacaaaaattattttggaaagagagtattcagatggctcagtgtcgaaaggccaaaaaggaaaatatgtgcagtcagtgagttagtagtaaattattttactgaaccaataaaaaattatcattaaacagaaatcaaagatttaatgttactttggaagaggagaaaacatttttaggcttctgttacctttctgtgactggaagcatccaatactcagtgttctgtttatctggtcccccaatcttagacatttctcctcccccattcgatgagaaccccagcagggtgtatttgttttcaagattgggttgctgagaaaataaattccctgtggtagagataatgatttggaagatctcagatcttgttcccaaacctgtcatttggaaagcattgggcagagactcataagaagtcccaggggaattggagtccaggaattttcataaaggagtgaaggggggagaaaaaagcctcacggaattagaggaggataacaaaatggtatttgctgaatgtacatgctggaaattactgccgctgggaaagaggttgtggatcttacttgggttggtgagcaaggtggacttcaaaggcccagggtgcttatgttccatttccctcttggaagagaggaggaggaggaagtgagctgcttcttgtggtggtggagctttggacccagctgtgaagggtggggccatgccttctgtccaactgggctgcagaggtcagtttgctcaagtaaattgacgtaagactttatgtcaggaatggggcagctctcaggagtaagctgatcatttatcctttcatgaaaccatctgtccttctctttttgcattttcctcttttgaaacaggttttcatgcttactcagtgtgtccattttctctatattcagttttgcccttcactttggcctgcctcagccatctaatgtccaattctacggtcagggtatctcctgatgcatttttctttcttcatctctctctttctctcctgtctcggtttcctaatttcaactctcctagaggagtgatccacattctgtctgtactatcctcatcccagagtcagttctctgtcactcagccaagttctgggttgggctgctttgggtcagtggcttatctcgagcctttccgtgtggctggggagacaaaatcaggtgatagaaaacctggtcatgcttccacatagctgagctgaaggtggggctctgacacaactgtagagaatgctcccttcttgagaataacagttagcaaaataatgccctttaaaaggcacagcacctctgcagaagtttcctgtagagggaatcttctaaaactgttgtctgcaatgttagtgctataacactttggcttgttgctgttatgatatggtttggctgtgtctccacccaaacctcattttaaattgtagctcccataattcccaagtctcctgagagggacccagtgggagataattgaatcaatgggggtgatttgccccatactgttcttgtggtggtgaataagtctcatgagatctggtgattttataagggattttccttttcgcttggctctcattctctcttgcctgccaccatgtaagatataactttgctcctcattcaccttccatcatgattgtgaggcctccctagccatgtggaactgtgagtcaattaacccctttcctttacaaattacccagtctcaggtgtgtatttattagcagtgtgagaacagactaaatacaagtaattttttttggtgatagtgatagactcgaacagaaacacactgcttcgtctattcccacatgatgacacctattcattcgtgggaaggtagatgagtggaatgctcttctgagtgatggggtatttttgtttggtgcagtcaaaagctttgttgaaacaaaatattttgtgctcttaacacaggtggttgcaacaaagaaaaccctcttagattgttgcagacaacatgtggctgcactttgcgaactgcaaagcgccaggcacactgctgtttacagtgtcaggccaacagcaagatggaggctctgctcagctgtgatctagcagttgcatcttaggcaggagaacagtcataaaagtctctgcaactcttttgtggcttgttttaaggcctgcttctggtgaaacagtgaaaagggcagtttttaacctttagcagctcattcaagacagagatcttcaaactgaagcacatggacccttgggagacaaaaagattctcaggagttatgcaagcaacttggaaaattcactaaaggattccatttccagattctcaattgtcatgtatatccttttgtagaattgctctatccaaaaatgggtgtttcttccaagttttcacttcctctttcacaattgccctgcttttcaaaagaaaggcaacccctcaaccaccaatttttcccaaatattaccaccctgctttgtcccagggtgtaagaactgtctgggggctgaatgagggccagtgcattggctggtgtcaagaacaggaacctgccagctccacaactcctgggtcagggagtttccaactttttgttttcatcataatggagggaggacttgtcagcctggaaatcattcaaattaattctagatgataaattagtatctcactcttggtatatatgttagttcattcaggctgctacaacaaaatacctaagactgggtgatttatgaacaacagaggtttattgctcacagtgctggaggctgggaagtgcaatgccaaggcaccagcagattcagtgtctggtgcaggctgctttctgctttacagatggtgccttcttgctgcatcctcacatggtggaaggaaggggcaaacaagctctttcaggtctcttctgtaagggcactcacctcattctggagggctcaatcctcatgacctaattgcgtcccagatgcctcacctcttaataccaacacattgggggttaagttgcaacctacgaattggaggtgcaggacacaaacattcagaccatggcagtttactactcaagagaagttaaaagaattgagtgatatttgtgtagcacatttttttcattcacaacttcttgtttatgttgaataaattttattagtacctacagttttggaaactaaaatggaataggattgttgctgaacctgtctcatttcagtagaaaggatcgttgatcttgagctacataagctgatacgaaataaaaaggcccaattcattcactaacaactatatttcccacaaaattttacttttgatattcaataattgtttatcaagattaaaatttatgtttttgatgaattatatactactaataattataatgaaagccaattttggaaaaaattttaagaattagagacataatcataagtattttgttgcagagaaatataataatgtgatcaatatattttcaagtatggaaatacattgcattaggatatatgtgggggaatggaatggaaatatgaatttaaaaaatagcaatgtaaaattcctgttaaagagcttgtgtgcatttattttaagctgatgctggtaaaaatcagactgctgtgacattatgatttattggatgcatctaaaataatgctgtagtagttttattttaaaggtcatcatttataatactccagaaattatattctttgtagctattaaaagagaagatgaaagttttaagatgttaaaaaaaaaaaaaggagggctgatatggtttggctctgtgtccccacccaaatctcaccttgaattgtaataatctccacatgtcaagggtgggaccaggtggagataattgaatcatggaggtggtttcccctatgccgttcttgtgacagtgagtgagttctcaggagatttgatggttatataaggggcttccccctttgctcagtactccttctgtctcctgctgccctgtgaagaggtgccttctgctatgagtgtaaatttcctgaggcctccccaaccatgcggaaatgcaaatcaattaatctcctcttttctttataaattacccagtctcaggtatttcttcttagcagcttgagaatggactaatacaaaagtgtatagttaaaaaatttttattataagataattcttataataagagaattcttagtagaagagcagagaagtccaaaggtagctaagctggagtgtcactagggagaagggacacacactggagtcaacaaactggttctgccacttactagccttgtgactttgcataattacttaaattgattcactttttttcctgcacaatgaaaatattaatttccttactaaatcatggtaagaattaagtgacttgatatcctacatgtgatcaaagtgtcagtttctctccacttttcccaaggccagttatccctcattcttccttcttccacgccctcacttatagtcaaagttagtctcctttcatatcccctattaaatatacttgatttacattcaaaagatcccaaagtatcttctatatgttcatttacccaaccaatatatattgagaacttaatacattccaggcactacgatggtactggggatacatctgtgaataaaaaaagacaaaatcgctattgtcatagagattatatggtaaccaaggacatgtgatgagaatgcattggctactcccagtgtcctttcatggttttggctagtgagagaccagttatgtttctgcaaattggcccatccatccgtctgtctgtctgtccattcatccatccatccatccaattaaaatgtactgagaaactcccaggtgttaggaccataatcaggccttccctctctggaacgtgaccacaacaacactctattttaataaaattctcctctgtacaacctttatcacaatacatgtgaattttatttgtatcatatattttgggatcaaaatgtaaatacctcttgtttttctttaatttttgactgtttcctatttattaaaaaatatcaaatgctgtttaagtattcaaaaaatttgcgttttccttccaaaacaagaatttgtttttattgagatgtgctttagacaagcttgtccaacctgccttattttgttgttgttctattttgttttgttttaggcttttagcagcctgaaaccatgatttttagtttctttctctagtgataagcagaaaagagagatgaggaaggggctttactggcccaaccagaaacagaaactagggacctatgactgaattctctcccttaggcacccctgagtttataactaaaacaaatttaaaattatggatttagggataggaaaagatctgggtgttcaaagtgattcagtttctgcttgatattgaaactttattgtagaatgttgttctaccacttacttgggaaacaagtcttccatacatacagcattgaattaatttgctcagcttttacctagaagtttaaaaataggtaatggccaggtgcagtggctcacgcctgtaatctcagcactttgggaggctgaggcaggctgatcacctgaggtcaggagttcaagaccagcctggccaacatggcttaaccccatctctactaaaaataaaaaataaataaataaataaaaaattagccgggtgtggtggcacactaactactcaggaggctgaggcagaagaatcgcttgaacccaggaggcagaggcagcagtgagccaagatcgcgccattgcactccagcctgggccataagagcaaaaccccgtctcagaaaaaaaaaaaaaaaagttggtaacattgaacattcccggtttccttctctctacctaattctcatagagacaggtcttttaaagaagccaaagttttttaaatgatacatttcaattatttgagccaaatatatcttttatcaaagtaaagacttcttcgagtcaagttttaaaatattttttctattttatattgataaaattaaattttatctcaataaaaatataattcacaagatgaaataaaattcagcattttaacttttttaaagtttactattcagaggtttttagtatattcataatgttgtgcagccataaccactgcaattacatcatcccagaaagaaactcaattctttcctctcccaaaccctgacaactattaatcaattgcctatctatctgtatggatttcctattctggactttttatatacatagaatcataaaatatgtggcttctttcacttggcacaatgttgtcgagattcattcatgctgtagcacatatcagcacttcattccttttcatggctgaataatactccattgtatggatataccatattttccttattcattcacccactgatggacatgcgggttgtgttcaccttctggctgttatgaatatgcttccatgaatattcatgtgcaagtttatgtgtgaacatgtgttttcaattattttgggcatatacccaggagtagaattgctagatcatatagtaactctatgtttaactttttgaggaactgccaaaatatttttcacagaggttgtatcattttacataaaaatacttttatatgtatttgctgtatgtgtacaaatatacaaaaatgtatgtttgtatactagaagtttccttttctagtttcataaagtaaaagaagcatttgagtgaattttaacttggatgttcaagggaaaaaattaaacagaagaaaattccacatagcaaaatgaagcaattatttatacatatataaaaatatattttatatttaaaaatatatattttaaaaatataatatatacacataatttttccatttatcaaaaatatattcatgatatagaaagggtttgaagattttttatttctgaagataaaaactgatatttattcagtttcaccatcactaaggaaagattgttgaagttaccctttagaaaatatttccataacgataaaaaatgaaagtaattattttcaacattataatgcatgctgtgttttaagtgatatatttatatctaacaggaacagactttgacccagaacacagaacctcacttgtcaacaagaaccttctggaagagaagactggcagaatattttttaagtactaagacttgcctgcgatgtggtctctgcacatagtactaatgaggtgctccttcagattgaccaagtccttggccacaggtccctggtgagtatcctcagtgtgattgcctgcttttatttagtaatttctactcaatgtttgttctatggatgtaaaccgtctgaatgcttaatatgtcaaaaagccaaatcattccagaaagctaagggtatgtctgccatttcatgactcatttttattattgaacaccaaccctctcaattttccctgaaatgcatccacaaaatcaccaaatgggaagttgcacaaggaaaggccccagattcttgctcgcttactcactaggtttgaatagcaaaagacatatgcccaaagtttcagggtccctataactagaagagttaggacagactacttcacaagtacagattaataacacccccagccctccacagatgtccacgtcttaatctctggaatctgtgaatatgttatgtcacatggcaagatggcaaggggtaattaaagctacggatagaattatggttcctaatcagctgacattgagatagaggagttgacctgagcttgactatctggatgggcccaatataatgacaagcatccttggaagtgaaggagagaagcaggagagcagtcggagaaggagctttgactacaaaaacagaggccagcgggatgcagcaagagagacgcaactggccactgctggctctgaaggttgagggggaccaggagccaaggaatgtgggcagcctctagaatctggagaaggcaaggaatcagattctccccggggacctccagaaggaatacagctctgccaacaccttggttcttggcagtcagacccatttcagacttctgacctccagaaccataagataatatatatgcattgttttaagcctctgagtgtgtggtaacgtgtgacagcagcaataggaaaacaggaaaccaatatgagattgttcaacgagactcaaaatgacattgggagttaacacagggaaatgttaaacagtgaaaaaatacaaaaagttctgaggataatgaacaagaaattacggggagtgaaagaagtgaaggtggtgggaaggaatatggtccagtcttaactgatttggggtggacgtggaagaaatggaaaggaatcttaattgtggatttttttttaaagaaaaaaaaaaaaggaatgatcttactttttaatatctacagtggcagaaagaacaagtccagtgcagtataaagggactatgaaggagcttcggacctgacccgagctggccccctcggggccattctgtctgcactctttggagcatattgtccaacttttctaagtctgtttgctcttctataaaaggtttaagaaacatgctgtgcctacaatccttgatgagattatatagagaaaagcgacaattgctataaaatgcaacatatcctatttaaaaatgtccagtgataataactcatttaacaagcaagagttgtaaatacacattcaacctgatttaaagcagttgattcccggtgtttaacacctcctttatatttttctctttatttatttggttactacaatgaaaagccaacctggcttgtgttggaattatcatgaaaacagctgaggagagaggaaatttagtgtgggagccattaagtatgggctggacccagttactcgtctcccagatccacagccctgtaaacatctgtagtgtctgtcggcatctcagcaaaagaggaagaagtagagggtggagaacaaaggctcacttaggacatgaggttttagagaggagaaggctctacagagaacaaaagaacaaggatggcagataaatcacagcccagaactgagccccagttctcctaccatcctttggaatggtgtgacccgaagttctaaccacagctgttttaagcgttaaataagatgatggatccagaagctgtttgacaaatataaggtctagaaaatatatgcagatgtttaatgggtgttttgttttgttgttttgagacagaacctcactctgttacccaggctggagcgcagtggcacgatctcggctcactgcaatctctgccttccgggttcaagtgattctcttatctcagcctccggagtagctggggttacaggcatgcaccaccatgcccagctaatttttgtattttagtagagatggggtttcgtcatgctggccaggctggtcttaaactcctgacttcaggtgatccgcccacctcggcctcctaaagttctgggattacaagcctgagccaccgcacttggccttttagtggtcttttaaaattgcatatgtcctctgttaaaatttgtttgtaataatgaagttaccccagttggatttctgcctcacttataaggccctggactacataacttttccctaaatattccatattatttccttttttctccaaaccatcctcccagtccagttaggtttccttccaccttccctccttctagttgcttccactaaatggcattatgggatacactggtctcagcaatgtgcatgtctgaacaaagctgcctccttccttctctcctgcagttttcattctgagaatcatcttctttcactcatctgtccctccaggtctcactttcagagggtcctcacggtccccagcacaatgaggaccacacaaggggttcaacacacacttcttggctgattaaaaagaggaaaggcaatgatggcagccagagagaggaaagcatggatcttgtcactgatgacaagtcggctagtaggagcagcctcatagaaataaaaagtagctttctggaattaattcctttactctttttctttttgtttcacatgaaaagaaactgtttaaattaatctgcgtttttgtttttctgtaggtcacttatactcattctcttttctgtacaatatgtatatggggtaagtacattcactagctctggttgcgttgtgaaaattcactttatagaatgcataatttttgttatactttcaaagaaatcaccctctgggactcaattttcttacctgtaaaatggagaataggactaaataaactctaagatttcttttatattgtatagtcaagactgctttctgaattgcctaggtattggggatttctttattttaatacaaacataaccctttctttaaaagtttttttttggagacaggcaagaggcagctgggccatttcaagattaaatcaagaaatacaagaataatttgaacattttagctcagaagaaaaataagcccagaacattctgtaataagctatctttcttctgcttcctcactgaagaatcccagtcattaaactcaccctcagacgtgtctgggaaatcccattgtggcctgcctgcaactcaggttgatcttgagacaactgacttggtttaaatcactctagtgaacataaccctatctgttcatactctccaccttggattcacccaatgcaatttcagtgaatcaagttattgtaggttttttcaaagcaaatcaaagtgcaaaattaccttctgttctccttttcctacaagttgggagcagaaaacacctgggtcaaagaatgaggagccagtggttcttggctctgccaaagattcatttcttaacttatataagactcagttatctcctgtattgagtagggatgataagacttgcccgactttgttgacatgcatttgagagtatcacctgaaataatgagtggaaacaatactatgatatatacatgtgtattttttctatttctcttacctgatttttaaaagtttatttttgtgttatattctttttcctgttataaaagtctgcagagtcctagattttactttttttaaaatattgcatacaagtaaacataatttctgaatcaaagatttttctatcccaggacttctaccagcttgtggtgtgcagagagtctagagatttcacacagggagtggccatattatcattgggttttaaaggtagcaatacaaatcgatgcgatgtctgtgggaagcgatttggtattacccatccggattttgaatgcacgtacctattgacacaggaatgtgtctttttggaatttgtcatacgtgtttattctgattcatgcatacagataaatatgcccaagagtactaatttcagggtagtgttcagtatagacagaagggagctccctaaatttccttcaacaacaactggttaaacaaagtatggtatgtggtctgatggataggcatatgtattactttggaatgattttgaagactttcaattatgtgaaaacagcaaaatatagagcaatccaccatttggataaaaataaaacaagtccaaatcaccaaaagtgtgtttgtacacatctgtgcctgtgtgcccatgtgctcatctgcctctgtgtgtgcgtgtgtgtgtgtgtgtgtgaatgaggtcattgtatgaatatgcttattaatgcccaaacacctatttgaaaaaaattatcctgtataggagggaacttggggccagtgttgaaagaggacatttgttttcctgttacactctttggcaccatttgaatttttaaaattatgtgtctatattatttgtttttcaaaaaagaagatggaattacaagtataagacattaataacttctttgtttgaacttttttttttttttttgtgagacagggtctcactgtgtcacccaagctggagtgcagtggtacgatctcagctcactgccacctctgcctcccagttcaagtgattctcccacctcagcctcctgagtagctgggattccaggcatgtgccatcacatctggctaatttttttgttatttttagtagagacggggtttcaccatgttggccaggctggtcttgaactcctggcttcaagtgatctgccagccttgccctcccaaagtgctgggattacaggaatgagccaccgcagccagcctttgaacttttctatgtgacaaatatatgtttaacaatatctgagataaggcagatagtgacttttccttttttctctttgaagaagagtaacattagtttccgagagcgtgaatgtattcccagtgaatgtcgttcgtactttgaatgtttaattgtctgaaatattgtgtttatcttttaaaatgaatttatacaatctatttttgaggtgcagacctctataatttcaccctcctcttttaaatatttattggggaatgtttacgtagaataactttgcagaggctaaaatcacctcttgctttttccttttactgatccaagtcaaaccttgatatgtgactattcctgtttttttttttttttttttttgaatctactaatctattttaaagtgattctttcctgaaacatagttttgctgcaaacatctcagtgatgtttggcaaaaataagcaaagaaataataataacaaacttgcccttattatcaagccatctaatcagctgaccttattttttttcctctagttgttttgatatttcagcgaacacatagtaatgaagcccaaccttaaatgaacccaagtattcaatctagttactttaagtgctttcatgctgtcccgacctgggcccgggcatttaattttttttttaaccttatcagggtgtttaacttaatatttctgcatttatagataacaacattactcaaaactcaagaggcatatatttctgaaacttcaaatacatttttaaacttaaactatctaatcgcttgactctcgtcaagcttcaaattcttgtatgcttttaatgatccatgagaatattgtttacaaagatgtctttttaaaattaatgcttaaagatattttcttttggattgtgtctgagcatatttttctccaaaaaataagcctaaactgtgcgagtgaaaagaaaaataatatatgctgattagactcttttccctcccatacacatatacctgttcatatatatgtatacgtacatgaatattcacatatacacatatatattcaatgcattcacacatacatatgtatatatgtcttccatgggactataaatattagttttattgttttatgttttcccatcatacagtggtctaaaggcttgagtttacagccttaagtttaaaaaggttgatcaatcataaaattgtatggccaatgtataaatgttgcaatgacagctaggccagatcatgagccaggcaaaccttttctctgatgctttcttgatattcttatccatgcccttgggtcctagcacctagaggtgatttgtccactacacaggggcctaaaccaccactccctccccactggcaggcccagcctgggaatgcacgctcagtgctcatgttcattgcaggtgcatcatggtgattgctgttaagggatctgcctatggaaatagtactctgggactatgcttttatatggaagtggatgatgactctggatataggtgattaggattcatgagaacaaggagctgattcttcctaaagggtgtgtgtgtgtgtgtgtgtgtgtgtgtgtgtgtgtgtgtgtgtgtgatgctctaaagacagtgttggaaagtttgctaaaagtggggaaaaggtccaaattattcaagttcaggagtttctgtttgagaaacacattagagaaaccatcttggagtctcagcaaattgtaggaacaacaattttaattttaagcccaaggatgggacagaagaattgtcctaggaaggacagtttgatgagggaggagatacactgtagctgatcttgaagataaagcaaaacaggccctgaaaaaaaaacaagcttttcatttaaactagactccactgtctatgcatggattgcctaaccacatagtttacactctaagactgttcacaacttaataaattaagtcttaccgaaagggagaaactgcagaagattccagttaaagccaaacgactttagaaggatacttattttccttcagcatcctcagtttggaagcttcttgctcatataatcaaccctccttattattaagctactgtgtaagttcttcatctttttatatgtcatgattagtcttttcttctcatggagtcaaaggtaaaccaagagtgcttgttataatgtatgtgttatgcacgtagttaaacgatgagtactggtatactaaataagatgcttcactttccagagtggaaagaaatacattggtccttgtggaggaagagattgctctgtttgccactgtgttcctgaaaaggggtctcgggtaagtgatgtaaagaccaacatgggcagcattcctgaattttgagaacttgtgaatatttaatataaagtaatcccagattcttggcaaattttagtcctcgataatgtttatgtatttcacagccgaagtttttcacattctaatagcaatctcaactatattagacagtccaggcttagaagatagtctaggaagctgcgattcacccattgttttatatgacactagtcttgtgaattgtcctgtggaggaagggtcctggtgtgaaatggtaactactgggtcaccatcctgaaatatggcattttaaaggctctgagaggtactgaagttggtagaaaaaaatccaagtttgtttggtctttccagacagttgaccacaggactctttcttggattgtcgctattgaaacaagtggcacagtgttctaatgaagtgatagctatattttttgtatgcttgttatgtgccaggcactgttctatgagttcaaaatgcttctgctcattgacttctcgtaagaaccttcttaggataccatgtttgcagtgcaggagactgaagcccaagaaagttagtgtcttgctcaagtccacccagaacgtttgcgttgatgaccacgctagattctctgttctgcaaagccaagaacctctttggttactgtctgtcaggtctcttgaacatttgttaatgtctcccccatgttctgacagcagcccactaattcatttgtgataaagtattagatcaaacaattctctaattacaattactcccacaatctcacaagaaaggagtgtggtatagaagtttgggacaatttttgagtcagatcaatgattcttttgaaatgtgtcctcatccattctcgctgctgtaacagaataccatagactgggtggcttacgagaaatttatttctcacagtccaggagggtgggaaccccaagaacaaggtgctggcagatccagtgtcttgctgaaggcctgcttcctggtgtgcagatggtgtcttctcactgtatcctcatatggtggagagaaagagtcctctggggtcccatttatatgggcattcatccaattcatgactactccgctctgattaattacctcccaaataccccatctcctcctactatcaccttgggggttagaatttcagcatataaattttgggggccacaaacattcagtctgtaacagtgttcaagtcaattgtagggggctgtgcatgacattcaaaaagcacagtacagtaaagaggagtctacaaggacacaaaacactacccacaagagaagggacaacatatttctctcatggtattgcttcatctttacacagcaggtgtgcaatgggttcctttgttggcctattttactgggagcagctaccttattgagcataagttatgacaaatccactgatgcttaaactgctttgttccttcttcagtacatcaaaaattttgttcatcagaatttatcttgagctttttcttttttttttttttgttttgagacagagtctcgctctgtcacccaggctggagtgcggtggcgcgatctcggctcactgcacgctccgcctctcaggttcacgccattctcctgcctcagcctcctcagtagctgggactacaggcgcccgccaccatgcctggctcattttttgtatttttagtagagacgggatttcactgtgttagccaggatggtctcgatctcctgacctcatgatccgccagcctcggcctcccaaagttctgggattacaggcgtgagccactgcaccaggccagagacctttttcttttctattctttttcttttttagacagggtctcactctgtcacccagactggagtgcaatggcatgatcttggctcactgcaacctcaaactcttgggctcaagtgagcctcccacctccacctcccaagtggctgggcctacaggtacatgccactacactaggctaattatttttttgattattattattattattattatttgtagaggtggagtcttgctgtgtttctcaggctgttctcaaactcctggcttcaagtgatcctccctccttggcttcccaaagtcctgggattacaggcatgagccactgtgtgaagccggtcttgagccactttcataatataattttaaaagtgaagcttcaagaaaacaaagtccttagcttttttgtgtaaatgtgcacattatatagaaaaaaagcctggcttttctgtgaggttattaatgtaaatataccaagattgtacaaatgcaaaaaggaaaaaaaacctcagtgcctctaaattttatgactttgagcttcaggaccaagataaatagatttgatcagccctgtggcaagaaagagatgagccgaccccaaaacaaagaggaccagttgctttgataaaggcacctcagtgggtctcccaatgtgaatgaggctgagagttgttttagcagaaaaggggatgctactggtttccagcaagtagagaccagaagtgctgttcaacatcttacaatgcacaggacagtccccacaccaaagaattatccatcccaaatgccaactgtgccaagattgagaagccctgttctaatctcacctctgctctgtgatgcaagtattattatttccacccttcagagcaaggaaactaaattcccaacagttctaaataacttgctaggatgcaggagaaccaggaatcacacccacgtgtctggcttcaaacccagcatttgctccatgatcgtggaaagatcattacacgaaggtaccaactgctgggttgtagcatcactttgtaaacttgggttgccacttgactctgaccaagcctgggtttccttgcacgtacccccattggtccttctcttctatgtccttgggctgttaaacaagcgcaaggcattgcatgtgtagatggtgtactttccaccctctaagcagtctctggatagggaaggctcccagtcctgagcggcactctgctgtgtgtgtctttgtgtctgcgtggtcaaggagagctgtgtgtgccacaacagggagcctgtggtcttcctgagatgaatgggttttccatgggaaggctgcaagtcgttgtgacatcttccagcgaggatttgggagtgtgacttgtgcgtaacagaaggtggtttgggaaagtagcactgtcaagtcctcagcagccggccaaccttctgagctgcagtgacagctcacgggggactatcagaataggaacacaccaaattcctaaggcttgagggatctgcctgaggctgcacagccttcaagtggcatagcgggctattcctaagaaggaaagtgttcctctcttacaggttaatgcccgtagtagcagtaggtagtagtaggtagtagtttcatcaaaccccacatcaaaactgctatgtctaaagcaatcgttgacaggcaaggctggttctgtgctgaggaacggccatggttcgcaatttaactggagaggagagctagagttagaggtggagatggaacaatctaaggtggagaatcaaggggggcctcctttgatgtctacagaatgaagtccagccccatcactgtactgctggaggctcacagtctagccccagcatgagttttcatctgtaatccccattactgcccctttgaccctctccagctgcagcagttgggccactcattcactcttgaagataatctgaatatttccacttctctgcccttttctgagtgccttccaacttgcactctgcctctgtctttcctgttcttctcaaaggagctcagtggagatgccaaaccacaaggcctttctgctcatcacagtcagtgtcgatgtctccctgccagagccccctagcaagctgcttacctgcttctcttttgctgtacttgtcctgccctgctctgtagctctggctggatttgagagtgaatgtgcccgactttattgattagattgcaagcatacacttcttgaaggtggtcatgagaacacaagtaaaacgttgatcctgattcctgacccactgtggacacccttgaaatatagtttgcctaccttcacttctcccctttgtaaactgggggtcattttttgtactttgagattatcacagtagatagcacacaacaggcagttaatacacataaattaagaaactaaaattcaggggccaggcatggtggttcacgcctgtaatcctagcaccctgggaggctgaggtgggtggatcacctgaggtcaggaattccagaccagcctggccaacatggtgaaaccccacctctactaaaaatacaaaaaattagccaggcatggtggcgggcgcctgtaatcccagctacctggaaggctgaggcaggagaattgcttgaacccatgaggcggaggttacagtgagctgagatttcgccatggcacttcagcctgggtgacaagagtaaaactctgtctcaaaagaaaaaaaaaaatagattccagcctggacaggatttgggagctgagctggtggtcaggccagcatgcagggactctgtagggggatctcccatacccaagagaagagggggacagaattagtggggagcctcttccccaaccctagactttctccccacacactagcatttaagcctgttaggaaatgagtaatctcacatagttcaaattcccttgtgaatttcaggtagggtcagaaataagcactttgagcagcagcaacaaataagagggttgcagctcttggaccttttaaggtacaatggcaccctaagagctccaggctgaggggaggagactggagcttacctccttgatctttttcgggttcagagccctcacctgggatgtgagaatttgtcctagagggggctggttggtcccctcggctctagcagcccatggttctgtgatatggggcgtgggttttcacatatgacagctatttacttggtttcccaaatgacttgtgaccaggccctaacatttccatgaacctcactatggcccatctttaagggtgtgaatgaggtatatcaggcaggattttctattattccttatcagtttcaagggaggaagctctctgtgtttactggtgggctccttgcagggaaaattacatgtccttacaaattagaatgaggaccttttataagttatactttagtaacaaggatgataataaagacactgtccacagttttttccccatattgttttctattcaagggagtataacaattgcaaaattaacaaaaccttatgatgtggtggttttacaaacacggaggtcaaatgacgtaaatgtcaagaattgtcttagtctttttggtttgaaaaccaaaatcaaacgtgagtgagtcattctttcttcggagaatttcaaatcactaaaaaactgcaagtattttccctgcgatctcattcactcatcccttatactcctaagagcttgcattccatgataaaaatggaatttacttgggaaagtttaattactgttaacatttttcatttcattgaattacttgcactcaaagttctagaactcagtctcactatcactcacacagctgtgttttaggacattttctacctgtagcctgatacatggttcagaacaataatttttatgtccccaaagttcacttaagtcaattgtgttccattttgatgtaaacaagttccagtgacaattagaagttggcaaaggtggtctttcaacccctgagcttgttgggtttgcttttttgttcttcttgctatatcttcctcctccaagaactctctggctcattttgttactactggagaattccctggtaaatgaagtccctgtcagagatggcagactcagatgtccttggggaacagctggtgacctgaatgtagtaatggggagaggaggtgctcaggatggggctactaggagctggacggtgcatttgtcatttaaaggcatcagaattcagaatttttaaaaaacccagtgcctagcaattaaacacactccccagtaaaattcagcccaccagcttccagtttataatgtgggcttagcttgttaaagtgtcccccctgtgtcaagaacaggaaccttgatttctgaagaataaaaaacttgcaaaagttaaagcctgaatcttcagctataggatgatctgtgtaggcttgagtaaggatttctttcttttttaaattctttttctttttttttttcttttttgagatggagtctctctcattcaggctggagtgtcgtggcgctatcttggctcactgcaacctctgcctcctgggttcaagcaattcttctgcctcagcctcccgagtagctgggactacaggcacccccaccgcacttggctaatgtttgtatttttagtagagatgggattttgccatgttggccaggctggtctcaaactcctgacctcaggtgatctgccaacctcagcgtcccaaactgctgggattacaggcgtgagccaccacgcctggccttgagtaaggatttctggacagggtttgggaggcctagagagtaaaggaaggatccctgcctatcatttaatgctttttggcgtattaataaattatagtggtagaagtagcagcagcagctgatgtctacatgggaaaataactccaactaactaacatcatttcagtagactgagaaatatctctttaaatccagcatccgtgcatgagaaaagagagaaaagaagcttttatctgcctactacactgtagaatgtattacctattttccaaacagaccgagtctacgtatagagctaacataacaagactctcccctgggaatcctagttgtggtttgggtctgaaggcagttttgggcacatctgccctggtcagtcacctcattaacttgtcagtgatttgcaacagggcctttggtctcctcatgtggagttcaattccacagcaacaactgccaaactgtgtgacccagcatgacccaggccaggctgggtgcggagctcagcaaatgcagggccacactgaacttgttattggcaagaaataagggctagcgatacaggtgcactcaaaagcagggcacagtttgggggaaataatctactatataggaaaatagaaagcacttagtataagaatacctctttagtacaaatgtaacgtctgactaattagctaagatgaggaattataatggttttaggaaataaaagcaaatttctcctttcaaacaaccatattcaataatttgccaagaaatccacaaacagctgtctccaaggtgcttatttctctataacacaatcttttttttgtttattttttattttttagacagagtcttgctctgttgccaggctggagtgcagtggtgcaatcttggctcactgcaacttccacctcctgtgttcaagcgattctcctgcctcagcctcccaagtagctgggattacaggcacacaccaccatgcccggctaatttttgtatttttagtagagccgggatttcaccatgttgactaggctggtcttgaattcctggcctcaagagatctgcccatctcggcctcccaaagtgctgggattacaggcaagagccactgcactcgtcctctatcatacaatcttaatggcaacgaataataataccaataataatagctttccattcattcggcaagtaaccattgagcacttgccacatgccaggcatccaaccaggccatggaggcctcagtcgtaaagaagaaagtccctgcagcctggagctcagagccaaaccgagagacagacaagactcccctccggccactatttctggctgcctgaggagcgccaggcactgtttgaggtgctcaagtcacatcagggaaaagatgagacaaaaatccttgctccctccccaggtggacaatttggtgccctggcttgctttgcatgggagcatatcggggtcagggcacagggagctgtgggttagcacttgagcttgaaccgggtggaattagaactctcctagccacagtctgaaggagaagccttctgtcagtttctatggctgtgtaacaaatgaccatatacatggtggcttaatacaacagaaatgtattctctagaggccagaagtccaaaagcaagctgctggcactgccaggctccctccacggctctgggggagaacctgctccttgcctccttccactccttctggtgtcagcagtccttggcattccttggttcctagcggcctcacttcagtctgtgcctctgtcttcacatcgcctgctcctctatgtgtccacatcaatctccctctgcgtcctccttataaaggtgcatgtagtagcatttagggcccacctaaatcacccaggagaaactcttcagctcaagaaccttcactttatcaggtcttttgccgtctaaggcaatagtcacaggctctgggcttaagacatgtcgtatctttttttgtggcgccattcagctccctacaagtgttcagacaaggggaacagcctccgcttgagccctgaagtgggaaggagacaggctagcatgtttgagggactgaaacgtgactagagagaaatttgaccacagtgggtaaggaacccggcagcatgcaatgcagcttaaaaagcagacaggggcagggtaggttggctcatgcctgtaatcccagcactttgggaggccaaggtgggtggatcatgaggtcaggagttcaacatcagcctggctaacatggcgaaaacctgtctctactaaaaaaatacaaaaattagctgggcatggtggtgggtgcctgtaataccagctactggggaggctgaggcagagaattgcttgaacctgggaggcagaggctgcagtgggccgagatcgtgccactgcactccagcctgggcgacagagtgagactccatcttaaaaaaaaaagaaagaaagaaaaaaaaaaaaaagcagacagattttcctgcataataagaaatttttgaaagattttaagaagggaagaagcagattggatttatgttataagatgatctggtgctgtttggaaaatgtggctggtggcaggtaggtaatgttagggaaaacctgttatgaggctgctgcagtcatgcaggtgggaagtcttggtggcttagcgagggggtgagtgtggagggtagggaagtggatgggaggtggacatatttgggaggcagacttgataggaatgaggagactcacctggcgcagttggggcaggcagttagaggcatgcgggcctcccaggagaggtgtaagctgctgtgcagacagtggtgcccgctcaggaagcacgtttcaggggcgatcatgagtccaggtttggacttgcagcgcttgtggtcagttggatatgtgactggcactcagaaagaaaggtctgggttagggagggacacggagggattgtctgtgggtgaaattgaccacttggaaatggatgctttggctggagagaaagtgacaagaagccagggcagccctgaagagctctgggggagactccaaacaggaggaagagggggccacaagacacaggtgggagcaaatcaaggcaaggccaaggggcagggatgctggagaacagggcaggcaagaaggagggagagttgagtgggttagagctagtcagggagcttaccaggagcccttagccttgtttaggccccgcagaagacgcagatgccatgttttaaaatgggaaaacccttctccaatggcctggagtaaggggtgaccttgttgttcagtggcaaagccatgtctcctggttctcagtgcagggttcttcccactgcaccatgctgcctcttaagaacacagtgaaaatctcgaatgagtgttactccaggctaaatccctcagttgcccctatttcattgtgaacaagtgcggttactttaaggtacaagaaaacactctgccactgaagtccagtctctggattgtctactgttgataacaccttttgttatttattttgataactcttcctggcacctaacgggcctttttcctgcaataggggaggctcctggaggcactgccaaaggattcgtgagtgatgttgtagtgtcacccagtggctgactggttgaattacaatcaagccttaaaaaggagggaagcattagaaaagaaaggaatgataataataatggattaagaataatgagactcataaaaaggatgaatatatttaaaagaatatttatttgttcattttaattgtggaagttttaattgatcatgtaatccatgagtatatgtttagaatttatactgtgcaagacagtggtcaagatgctgaggtggaaataaaaacgttcatgaatccctggctgcaaaaagtgtaccagaggccaggcgcagtggctcatgcctgtaatcctggcactttgggaggccgaggggggcggatcacttgaggtcgggagttcgagaccagcctggccaacatggcaaaacgccatctctgctaaaaatacaaaaattagccaggcgtggtggtggccgcctgtaatcccagctacttgggaggctgaggcaggagaattgcttgaactgggaggcagaggttgcagtgagctgagattgcaccactgtactccagcctgggtgacagagtgagactctgtctcaaaaaaaaaaaaaaaagtatactagaagacatcaccccaagcagatattaagcaaagtagcatgcacaaggcaataatgaaaaataggtgatgacgttatttagtcattaattattttagggtagatgtggtagtttggaggggagtgaaattgatgaggactgcagttaaatggaagcagaaaccttgaagtcagaactgaacagcctcaggtcctttgtctcatgtctttgagtctcagcttcctcctttgggaatgaggtcgtagatacagggatgactttctgctttacagggtggtaaggattccatgagaagaatgtattaacacactgttgtgttgtgtctagatttgtacatggtggcagttattactgctactgttatgattataatatttttggagggatggcagaatttgagctacaggtaaagaaaggctactctgacctcatggaaacaagtgtgattggggcagagggtgggggtgtggaaactgcagggaataaggttggcgggtgtgcggaaaggagattgtccccattgcaggtgttggtgaaagcaatgacaccaggaaaggggtgactgaagaagattcattgacggttgcatggggcagtggggagaagatcagggttaaggagacgcgagagattggtgcttgtggaacccgtgcgagagttgacaagaccatgggccaggtgcttggcagtgggaggaaggtaagatgggagcatgagatttgggttttggttcaaatcgagatgtgattgacttggtcatgagaaggacatggagaatgagggaaagagggtgacaaggctggcagctggatggcgagcttagatgatgccaggaacagagttactctcttcagtgacagggaaggaggaggcagagggctgagctcagctttgacccaatgtgtgagatgaattaacaggggaagaggatgcaagaaagtttctagaaaacagttggggatataggataggaccagaaagttaaatttgagaaccacaaaaaatagaggtattcaattaattcaattaataacattgtgtcctaaagaaactttataaaagaacattgagtgtatctggatagactgtttttaagtgtaaaaataagaagaggcttgaagggattgaaacgtcactccgggcatggcatgagcgtgatttagtggatgaaccctccattgtgctaggctcaggctcaggtagggggaagaggagaggtttaggtgagagactgactggtccaggtgtgaatctgagcttgctaggtgtgagagcctgaataagttacaccttccttcatctatatggggatcatagcctacactattcagtgttgctggttgcattaaataaggtaaggtatggagcatggcagccacataatccataaccaagcctaataaatacattccttccccttcctgtgacattttttatgataaatgtcatggtcttaagagttcaagggtgatttggaaaatctgtataattagtataacaaaagcatctttcctgtttgttcagtttttcatttatttataccttgcactgatttataccttgcatttatttataccttctggctaagaaagagcaggaagtcatggcagaaaaagtgtggctgtacctgtatttgtagttgtttatttgtagtgtttctcctagtgctcctactgacaaaatgacaaacgatttcttagatttttgtcattccccatatgttttggtccctggggcaaccagatcattgccagccaaaaaggctgacttgaagattttggtttttaaaaagtacagtacataccctcttatcttttggtctcttttactaagttgttatgaaataaaagtaattttatcttagccctgttcaagagacattctagacttaggcaaccgacaagggacaaaatcctaaaggaatgccctggcttcagaagacagggaggccggcggttctgtgtctgctctcatctccttcatcctttatttgtacagctggcccgagagcctactgctgctctagggaggcgcaaataacaggtttgatgatacggtgtcaatttggcctttgaaccaaaagaaagaaagaaagagatgatctagtggcttcacatggcatgccaaagtctcctcagctgtcaagctgattgtcatttctggattcagcggctctgtcttctgacttcgaagctgcagaggcagttgcatgcgcacgtagccaaaaaaacccaggggtgctgtgcatctgaaagccagtcattccactgggtggtttttctctttttgctagactgactctggcacagcaacttgttttatagcaggttattgttggtggtggagagtgcagggttaggactgggtgaaatatttctttaaagactttttttagtgatgcaaaattcctgtgattatttaatgattctctagttataaaaatgtcttttatgggcctgctacttatgtctatttgtcctgaagtgaattctattataaccttatgaaaaagtaagcctacatatttacctgtaagcacaagttcttttactgacccattcttttacatgaaacaatttaaagaaaatagaattattctctgtatgctgtgaataaattatttactcaaattaggtgaactaacaaatgactatttcaaagattggtgtttgggaaattttggtgagcagctttctgacagattttgtgctgttatttgaggtttaatgtatttcctttaaaaatttatcatgtagcaaaatacttattaaaatacaaaaaaaccgcactaaatacaaaatcacaaagtcttcacagttgtaaaaaaggagaaatttatgttagtttttccacttgcaaagtaggggtagtgtttgccattgcatatggttgaaataaaggcataacaacacctacattatagctcaacagcaaaaaacaccaacatctctgttattcagagtcattgctcatggtgtgaagttgtactctgcacagtttgctgtggaatcattgccattttgcataattactgttaaccaacgttctaggaatgacaattcagagacataagacagcatttacacttatctctttgcatccatgaggaattggttccagttcccctctggataccaaaatccatggatactcacgtccctgatacgaaattgcatagtatctgcatataacctatgcacatcctcccaaatactacaaatcatttctaggttatttagaattctatgtaaatgctatatacagtatacagttgttatactgtattttaaaatttttaatttttgttgtattgttcttttctgtttattgattttcgaatattttccatctggatcggttgagtcctcagaacgggagccagggatatggagggccgcctgtcttgccttggggtagaagtgggctaccttattattttataaagagtttgttgttctctgcctttcttaccatcatgaccttgggcacttagactcggccttcccctccaggagcagaggttgggtggctgtgggcttgggagggacagacaagtgaagagggtatgatagtcacgggtgagagtgttactgcagaggcaccttggagaggcatctccttctccagaacaggggcaggagatcaggggaatctttccactgcagccttgagagatgaatcagccagaggcagagagggggcgctcccgggacaggacagcctgcgcaaatgctgtgaaagaacagagcttgtctagaaatctggtgcagggaggtcagggtggcaggctgggaggagggaggagatggtgagagagaggagttagcatccttcaataatgcaaataaccattccctgctttactttttttttttcctcccgaagtattttatatgggcagggtgcagtggctcacacctgtaatcccagcactttgggaggccaaggcaggaggatcacttgaggtcaggagttcgagatcagcctggccaacacagtgaaacccagtctctactaaaaatacaaaatttagacgggtgtgatggcgcgcgcctgtggtcccagctacggggggaggctgaggcagtagaatcgcttgaatctgggaggcagaggttgcagtgagctgagatcacaccactgcactccagcctgggagaaagagcgagactccatctcaagaaaaaaaacaaaaaaaaaataaagtattttatatggcattttctcaaatcagcacacgtttctatactaaatggagttttattattcttaactgttgtgttaaatatttccacgccttttttcccctctgcaaacttcccattagctcactggatttggtattgcatgcctaaaatgaaacacattaaagagatttatagtcagttaattggctctctctttttcagttacccttttatattcaagcatgcattttagtatgtatctaaataatacattactgtaaagtactgcattcacaaaagataatttggggaagtttatgtataaactgcatgcaagatgaaaagataattcccaaacttaatgaaaaagtatttatttcctgaattttatatgtagaaaacatgggagcttttagattatgttaattaatcttatttctaacacaggttagacagaaaggtgctctgaagtcattgtttgtttttacttttagatcgtagtttagaatttgtgcagtcacctattgtaagttgataaaccctcacaataccccaaatggtttgtgctcacgtaattacactttgtattttattgttgtctttttcataatacatatttatgtatttaagtttcctttaaaattctaagcttttagcatttatatggatactcaataaatagtagctatttaacaatgatgaatgagcatgaagaaaagggaaaatgcctataaaatatagttttgatttgtaaaatttaggcagatgttaaaggttgtcaatcatgtttgtcgagttaatgacttaatggtgagcaagaagtggtaactaatctttattataaaatcacttctgctgatggtaagatgtacacaaagtatgaggttggtgaagaagtaattgcggtctttgccattgcttttaaaaggcaaaaaccacaattacttttgcaccaacctcatagaatgtaaaattgccctggcttgtgttttcacttatgagacatgcagtttcttttatgtcctagaaatgttcatttataaacatctatttagggaaagtgtctgttcttttgtttctctactggtgggattatatgacatactattctgtggcttgtttttctcctttaacaattatccatttataataataatatataataacaatagttagcatttgttatgccaggcactatgctaaacaccattacatgcattattctttttatgctcataagccattgacagataaagatgccaaggaacagagaggttaagaaacatacccaaggtcacacagcaagtcagtgtggtcctgggcttcaaacccaggaggctgacgcatagcctgggtgctcactctgtttctccctcatgagcttggggaggatgttctatgtcggcctgaacagatggactttgctggcagcttgcacgtgcttttggggtcccacacgtcttcctcagacctgttgtttctgtgctcaggctctgggggacttcagctgctggcatctgtgtctgtcagggctttatccaaagccccggaggcacagttggcaggcactccatacccatcaccagggccctcagccaaggagataaatacccccactcccttcccctagggcgggataacactgagatgtgggctcccctcagggttaagtcccaggtgcccacagtataactgacctgaaactgcccctttcttggctgccttcacttccgtgggtcgcgctctgttcctgacctgcacctccttcacttctcaaatggagaagttggtctcattgacttctcatcctctgtgttgctcctggagcaccctgatgaagtcaggctgtgagggctttcctgtttgaaggcaccctaatttattcactgagtctcaggttggtgcctttcccgtggatttccggtttctcttgctattgcatataacactgtggtgaatgttcttgcactatttttacggggctcctgccccatctccctcctggtgtctgggcctggccaaggccagcagcactatctaaagtgacatcccacctgggcatggtggcttacacctgtaattccagcactttgggaagctgaaggcaagcggatcacctgaggtcaggagttcgagaccagcctggccaacatactgaaacccagtctctactaaaaatacaaaaattagccaggtgtggtggcatgcaactgtaatcccagctacttgggaggctgaggtgggaggatcacttgaactcgggaggtggaggctgcagtgagccgcgatcacaccactgcactccagcctgggaaacagagtgagaccctgtctcaaaaaaaaataataataataaataaaaataaacaaagtgacaccccaagtgtggatcaggaccaggtgggtcttagttactgtttcttctcgtcaaggtgctctctgaccttctacccaatgtggggttgaccacatgaggagctctggccttcatgctatgcgattgtctggggccctttggttgagccctggttttggagggtggctgcctagcagaacacttccatttgcccatgaagtatttccttgatgggactgcacaacattgggttgccagagtagggctggcatgctgatttcgggtgactccagtttttatatagatgcgactctgcaagaaatattttgctcagggccctgcattcccaaggggcaaccctgtattagccctggagacctaagacatctgatctgagcagatatctcctaaaccctgccaagcttttctgtccatacatcaagacttacttgcttatttaatgcagtcatccatgctgttttgtgaagcaagaagttataaaataatttttcttaaatctttgcaaaaattttgagaggtatgaaatattgcaagtcgaactcttgacctcaggtgatctgcccgcctcggcctcccagagtgctgggattacaggtgtgagccactgcacctggtcgggatatcgctttagatggtgctgctggccttggccaggcccagaccccagaagggagatggggcagggccctgagacatgggttctgaggtaggagccccataaagcttcttcacttaaaacaagaggtggccttttcattcatggaaagttggattacataaatttaatgtgacatggagactaattccaaaatatgactaagaaattagataaaagcagccaaaaaagaaatgttgtccttcgaaagggcaggcaaatcattagttatttgaagtaaataaaagatctggcagtttcccttactctatttgtgtcacgaacataaaggtaaataaaactttgattttttagtttcttgcttcattaaaaagcccaagatctctaaatttgattgacagaatgaaaatagtaagataactataatcacttgatatatgtgtttctgtgcacacacatacatacatactgcacacatacatacatatacacatgtgcagtaattgaaatttatcatatagcttaattcagattaaaaagggcaatgccactatttcttatgttttaagtcaatcattttcttttcttgtcttgtttttcctttcatttccttttccttttatcttttcttgtctttcttttcttttctttttttttttttttgagatagggtctgtctctgtcacccaggctgtagtgcagtggtgcgatcagctcactgcaacctcggcttcctaggctcaagtgattctccacctcagcctcccgaatagctgggactacaggcccacgccaccatgcccagctaatttttatattttctgtagagatggggggtctcactttgttgcccacgctggtcttgaattcctgagctcgagtgaacctcgttgtctcggcctcccaaagtgctgggattacaggtgtgagccaccatctccagccatttgtttctattattagagttgtgcaaatctaatttccaagtcttctgtaggcctgaatgagtatatgtttgtgttagaagacagtaattaagaattgcacccccatttctttttaatcttccttctcagggtccaccaggaccaccagggccacagggtccaattggacccctgggagccccaggacccattgggctttcaggagagaaaggaatgagaggggaccgcggccctcctggagcagcaggggacaaaggagataaggtaagccacatcttatgtggagattcacatgaaagactcaccagcactactgcaccattttttgtttttgttttttttagacagtcttactctgtcactcaggctagaatgcagtggtgggatctcagctcactgcagccttcgcctcccaggttcaagcgagcctcccacctcagcctcccaagtagctgggattacaggcacataccaccatgtccagctaatttttgtattttttagtagagatggggtttcaccatattggccaggctggtctcgaactcctgacctcaagtgatctgcctgcctcggcctcccaaaatgctgtaattacaggcgttggccactgtgcctggccagcactggagttttataaccacgagtagtatatacttgaaccttataataaatgaagtccctgaactcctctgcaataattcatcctcatttttggcccctttccagaggagcatgctcttctggacctttaaatacatgtgtgtacccagtgagaagttatattgtttcatggctttttaaaaaacctacatgacattaattatatgcatcacactgagttttctcttttcactcaacaatatgtcttagagaccattccttatcaggctatgtagattgaacttattcctgaaaaaacattgtataatatgccatagtatgaataaaactatagtttattccctgttgatgagcacttgagattctaccccaactttgggtagtgcagatgtgcaaaaataatcctatcaattgcctgtgttcacagttaagggtttgttactctaggatcgagattcggagtgttagatttctgttcacagcatgttgaatgatttacttaaatcagtactgctaggctgttttcccaagtacaaaagaaaagcacaagaattggttcttaaatgttggcttttagactcatcatgtaaaaaataggtgacaatgactgctcagcatgtttaaagatgagtaattaattgttactattttcaagtaaatcagcttattaatttaataatttttatctctttgttttattttctgggattttagggtccaactggtgttcctggatttccaggtttagatggcatacctgtaagtatccctaaattttctccacttttttcaaaaaggcagaagtactcatcaaaatccttaaaaccacatgtatatatacataaaatatatatttatagaaaccacaatatatatattatatatagcaaatatttgctatatataccacaagcaacgtaatatatatatatctttcaccataatatatatctacatatataaaagatatatattagatatacaagatatagaatacattaggttggtgcaaaagtaattgcggtttttgctgttactttcaatcccccacaattacttttgcaccaaatatattgtatatataagatatgtatagtatgtatactatacaatatgtatcttatattttacatatataaaatctatagtatatacgatatatagctatcttacatatattttatatagtatcttatatcttacatatagtttatatatcataatatctgttaattatatattgtataacatgtataaaatatggtgcaagatatatatatgttatggtgcatggtatatattatacatagcaaactctttttatattttctcattttagtgcatgaaagggtgtttacatttaaattttgtacaataactcccagagcaaaacactttacttggaaagcaacgttttctaacaggttagagaaaaaattccaaaatatgagctaggtatacttgttatgtcaagtacaatgttcttgaaattaatgcatactcataaggaatgtttttatttgctgatgagtcctaatatttgtagtgagcttaatactcccatttctcatatgaaaatggaatggaaaaaaaaaaagaggtatgtgggggctttataattcattatagtatttctaaggattttaaggaaggtcccctcctcaatttcccagagtactgcaaactaaattagtttaaatttgttatcttaaaaaaaatttaggttttatttttacatgctacgtagccttttggggtaaagagaaagtttcacaaaactaaacagtaaatgtgtgaatcacaattgccataatttgagtattcatattgcataacctttatgtaatgatattttcgcaaaaatgcttcacttataattttgttttctgcaggggcacccagggcctcctggacccagaggcaaacctggtatgagtggccacaatggctcaagaggtgacccagggtttccaggaggaagaggagctcttggcccaggaggccccctagtaagatacccacagttcatcttaacaggaatcttaagtgaacaggccctgtggtggaacaggcttgatgtattcaagaaacagagttaatacaagtgtgcctggagcattgtcaacaaatgggagtggctgggggataaggacagagagataggcaggacttagaacatgcaggactttgtggatgatggaaggaggctagattttcttatccatgttaggtaaaggcactggatggttttaaggaaggaagcaacatgatctgattgatgtttcattaagatgtctctggctgctgtgaagagaatagatagtagggaaaaaagagcagagagaccaggtagcaaaatgtaaattgtttatcattcagggttaattgcagaaacaaaccccactaggtattttgaacagaaagggatctgctacagggattctggcacttattataatagttggaagagtaaaacttaggaccacacgagaccactgatttcaaaggttcacagctagctgagatccggagtcaggaagctgtaactgcactgtaaccactgcctgtcaccccacgtctagacactagcaaacagaacactcaagtttctgctttcctgcttggcagcaacaacagaccaggaagagaatctcttccaaacttctgccttccacatctcctaggtggaacctaattcacatccagctataaaggagtctgggcaatgtagtttttatctttctagcccctgtaatgcaaaaaaatatattagaaaagatttggaatggatgtccagcaacagttgatagtatccagcacttgggggaaaacttacggctcttagctttttttttcttcagaattttggactttcatttaaacataactggagcaagagctaccccccatattccctttctttctctctttttctttttctcacttaaataaagatcagagattatttgacctttccaaattgtttttctgtgatttttttttttttagcatttctcccttccttaataaaatatcatttcacaagtttctttctagaaagttttcttagcatgaccaccataatcattcattctgctgtcactcacgagtcttccttttgctccagattctagaggaactgatctgaacactaaactcaaaaagaattttccatactcacatttttcttctggtatcaaataagaacatccaccacctttcattgttaagtttttcaaccatcctttactttcaaactcagccatttgaaaactcaagtgcagtctggtgaatgcacatttattaagctcctcaaatcaggccaaacctcattctacagattcatgagcattcaagagagcaagggttctcagttttaactttaacatagcatgcagtaccagccacaatcctgaagtttgtcataatggtctctttgcaaagcaaccaacttccccttgactcatttactatacagacacccctcactttgcacagtaaagtaagaatgaccaggcaagctaaaaaccacgcaaagaaaccttatcaactgatgagaaaattaatattgtcccatgacttttaaaatgttttgttaaaacattagaaactttgccagttatataaggaaatgaaaaaactaaatatttctttaatatactgtaatttgaagcattgagaaccaaagtgttttatttctttgtaaaaacttatcaagagtagtttcaacagtacttgcctttttctcatcatgtaacttgtgatactaaaggaatatgtcttttatgttttgaggaagtatgatactcctaagttcggatctgtttccagtgttgtgaaatatctctcagggttcctttaatgtgaagttttcatctgtgtcactttacctaggacgctgtcatccttttcatcacaaccactttcctggtttctctttactaagttcctctggctgcaaatagtctctcaaatgacaacaatctcattattcccatgatcagctattgcttctataactccacttatgttttatttgaatttcatttccagcattaccattttcatttctttgcttcattttcatcattattggccgatttcctcttccaactatccatttttgtaaaatgttatttgggtttattgctgggagataaggaggcaagccagctacaaactttgctgtctgtgtctgtgtgtgtgctctgaataatacgtgtgcaggggccaatcacagacagactttgacagaaatcattgaaactgacccattagtcccagagatgttctttggatcaacatagaaatggatccttctgatcttaaagtttgaaacctatgtgttttatctgagttccttcctcaggagaggacccccaggcctctcaagaagtatcaaagaactgaaacacaccagatcatggcatccagacaatgagatgccagacccctgattttgtttccttacctaggtcctgttttccaatacattgttacgtttcttccctgctatgtgaacccctaattttagtcagtccaggagatggatttgagactgatctcccaactcctcagctgcagcacctaattaaagccttcttccttggcagtagtcgtcctctcagtcattgactttctttgcaacatgttttggtaacatcacgtgatcatgcagtaatcacaattcacatctgttatttatatagcgatttgtgggctgagaggatagcaatgaagtttgtacgttatgcaagtactcaatacacaatggtgactgaaatttgaaccatgttgttggagaactggtgttatttaacttaactatgaaactgaaattcattcagactggaactgtgcaaagccaaaactgcagatactaccaaacctgatttctcaagtaaattgttgatgcaatttaaccttatgctgttaaatatctcccatcagaagccaagtcaagcactcctctaagagagattaactttgaaatgtatatatctttcatatgagcttgatatataaagatggtaggatttttatgtggtaaccaagagaagatatattaagaattgaagtaggggccgggcacagtggctcatgcctgtaatcccagcactttgggaggccgaggcgggtggatcacgaggtcaggagattgagaccatcctggctaacatggtgaaaccccgtctctactaaaaaatacaaaaaaattagccaggcacggtggtgggtgcctgtagtcccagctacttgggaggctgaggcaggagaatggcaggaacccgggaggcagagtttgcagtgagcagagatcgcgccactgcactccagcctggtagacagagcgagactctgtctcaaaaaaaaaaaaaaaaaaagaattaaagtaggatattaagatattaagtaggaaaaccttggggaggggaagaatacactgaggttatttcattcacttttaaaaaatatcctaagcaaactagcaactatatacaaaaaccttctgaaaggaacatgttatgtttttaaaaataattcttaggcctattttgaatacaagtactgaaatggataaaatctctctctctatatatatatatacgttttactgtttctagggcataaattaacaattgcaaaattagttatttgtaggaacaatgcatgtgttttatattgtaaggaaatatgaaaattttctgctaaatagctatatatgagtagatattctgtcttagaagattccttaacagatcttaactgaatatggagtaaatatatgtgagaaccttagggtgataataatatggaagaggatacagaaatgtcttcttgttaatcatgtcaataatggtaattttaactgatgagttatattttatatagaaaagaaaatactgaaatggtaatatgctattttcctgttaagtacatacatattttattttcagggccatcctggggaaaagggagaaaaaggaaattcagtgttcattttaggtgccgttaaaggtattcaggtaagtattatgatcatgatgggttaaaaaattttttcttccaaataggtaagcccatgcaggaaatactcagacaggatttttcttcaaaatgtccctgaatacaccaatttttatcattaccctgaccctcagggatggcatcatgcttttgtgtgaaggcagtggctttagtcgccagtaaaattccagcactgtaaaattccattacttctgaactagtcagaactgcaagggatgtatttatttcaaggtttctcaactcctgacattgtgggccacatattcatttggtgtggggctgacttgtgcattataggatgttgagcagaatccctggcctctggcctctactcattagacgccaatagcatcccccacctctgaactccccaaagcgtatatccagacattaccaaatgtcccctggggggaaatcaccccagtggaggaccactgatttatttgtaattaaaacattgtaatattagtacttgccatccagtacagtaaaagtcaccattattgaacttgaaaatgatgtaaaccttatagcactttgcttgatacatttaatggtgttgtgttttcagcagggagtgatgtccaaatgttcagaaataaactcttgagtgaccacctcatctctcagatgagaagccatggatgagtgatggggatcagtggaaatgatgcattaacaggaaaatacagcccatgttcaagatgtgtggtcatttctcttaaggaagaatattctgcagcaattagatagaactagtcctagattgcttctatgagaccctaggttctgtgccacgcagaatggacacacctgagcagtgatccctttagtaagctcactgtttatgtgtgtagcctctgtgcctatttgtccttcttaaacagcaagaacgatggatttgtttatagcttaaatgatatattaataaactaaacgtcaacagcagggtcattctaggaaccaggatggtgtattggaaggagagaactgaggcttactctccactgtgactttaagcaactcccttaacctcctcagcctcatgttcgttatttgtgaaagaagattaaaataatatttaccctgcccctttcttagtgttgttaagactgttataataatttatattgcagcacattgtaaatggtaatgtcccatattagttatagtgagcatttttttgtaattgtggtaatagaggacatgtgacatacaaatatagaagggggatgaatatagagaattccttatcttaaggggaaacagaagatccctaataaaaatgacctgtagatcaataacctttgagagacaatgctcttaagagtctatatccactttatactcattctaatggctatgataaaaaaaacaaatctagcaattgttggcaactacatggagagttggagccttatgcattacgggtgggaatggacaatggtgcaacccctgtggaaaataatatggtaattcctcagtaaattaaacatagaattactatatgatccagcaattccacttctggatatataccccaaagaactgaaagcaaggacttgaatggatatttgtacatgcatgttcatagcagctttattcacagtagccaaaaggtggaagtaatcgtgtccatcaacagatgaatggataaacaaaatgtggtatattcatccaaaggaagactgtaaaagctttaaaaaggaaagatattctgacacatacaacaacatggatgaaccttgaagatataatattatgctaagtgaaataaaccagtcaaatatcatatgatttcacttatatagaaaaatagtcaaattcatacagatggaaaatagaagggtggttgccagtggctgcagggaagagggatggggagttagtgtttaatgagaacagagtttccactggaggagacataagagttttggagatggatggtggtcatgggtgaataacaatgtgaatgtacttaatgccacttaagtggcattaagtgaactacctgtacacttaaaaatggttgaaatgggccaggcgtggtggctcacgcctgtaatcccagcactttggaaggccaaggcgggtggattacctgaggtcaggagttcgagaccagcctggccaacatggtgaaaccccgtctactaaaaatacaaaaaaattagctgggcatggtggcgcatgcctgtaatcccagctatttgggaggctgaggcaggagaattgcttgaatccaggaggtggaggttgcagtgaagggagatggcgccactgcactccagcctgggtgacaagagcgagactccatctcaaaaaaaaaaaaaggttgaaatgtcatattttaacttacatatattttacattttaaaaaaagaggcttcattcaagagaatatatagcctttgatcttttaaagtaggttgagtctcagcacagagtcacaaggcgatagaagtagacagaggctggtgtgaggcaatttccacctgagtttcttttctgtccactctagggtagtcaagggggtcaagatgtttataaagcatagcaaggtgtggaaagacaccagcaacaggtaaactgtgaggaaacgggaccactggattgagaatttagaacaatttaaacaaagaaaaaatctcattttgattccatgtcattacttcagcgacctttctctgttgggtagaaggagaattcagagcttaaggagaaggaaaatcacctccgcatatcccttcctcaattttagtcaacaccaaaaaaattgaacaaactgcagttagatgagtccagataattttgtgtatatttctatttttacataatctctgttttaggaacattgtgtggacttaaagcaatgcattcttatttttgcagggagacagaggggacccaggactgcctggcttaccagtaagtctcctgagcaggctctatgcttctatttcctcctcaaatagcctatgatccacgttttaatcccagcaaagccagctacataatttgtgcggctcacctagtgcaaaatgaaaatgtgggttccctgttcaaaaattattaagcatttcaagatggcgaccacagaacatgaagcatggggccctgtgtaactgcaccagtctcatgcccatgaagctgtacttgaagctcatcaagctccctcctgccttcctcttctgtcttctaatgatctcgtgacattactcaggtatatgcagccacttaatatttaggaaagtgagtccacttagcaactacatgtataatatataccagctagaataatcttgcattgcttctcgctaccattttgcctggtgaatcagtatttgtatattatatttaatattttgcccatcttcatctctctgatgtttctgatgtgagaaagtttcacaaaactaaacagtaaatgtgtgaatcacaaatgccacaatttgagtattcatagtgcataatctttgtgttatgatatttttgcaaaaatgcttcacttataattttgttttctgtaggggcaccgagggccgcccagaccagcaattcaatgattatattagtctttccagtttttcgatgtttacaagactaaaattgagagcagttttgccggccaggcgtggtggctcatgcctgtaatcccagcactttgggaggccaaggcaggtggatcacgaggtcaggagtttgagaccagcctggccaacatggtgaaagcccctatctactaaaaatacgaaattagccaggcgtggtggcgcgtacctacaatcccagctactcaggaggctaagccagggaatcactcgaacccggaaggcagagcttgcagtaagctgagatggcaccattgcactccagcctgggcaacaagactgaaactccatctcaaaaaaaaaaaaaaaaaaaagactgggtgaggtggctcacacctgtaatcccagcactttgggaggctgaggcgggtggatcacgaggtcaggagttcaagaccagcctagccaagatggtgaaaccccgtctctactaaaaatacaaaaattagccagacgtggtggtgcgtggctgtaatcccagctacttgggaggctgaggcagagaactgctaaaactcaggaggcagaagatgcagtgagccaagatctcaccactgcactccagcctgggcgacagagactccattttgccttccaaaagttaagctataattttgccctgtaacttctggctagtgatggaacgactttcctgggctggtttccttactacgattgaagctcaggtccatgtaataaatgtgatacctcaatgttgctgttaaaataaatatcagttcatcctcctaaacagagtaatttcattatacactccccaatcatttgacctgggcagagtcagcaggagcccggggaacatctctccacacttccaggctagcctggctgtaacctttccttgacaatttgtgtatagttgtgttacaacttacatgttgtagaaaattttgtatggctgactcatcttgatctcaaattagggactatatttccgcaatttgagatcttgcagaccatgttttaaaaacatactaaaaagtataaatacattaatatataatgttaattaataataatactttaaaagcatcctgatgtatatcaaaattgtaacagaatttaggagtaggtagtaatgcattttctttgctctccacttttgttattacaggatgtatttgtaaataggtagattgatctctgggtcttaactggaccctaaatgaaggaatttatcacaactaccagagtgctgctacctttagcttggtgctttttttttttttttgagacagagtcttgctctttcgccaggctggagtgcagtggcacaatctcggctcactgcaatctccgattccctggttcaagcgattctcctgtctcagcctcccgagtagctgggactacaggcgcctgccaccacgcccatctaatttttgtatttttagtagagacggggtttcaccatgttggccaggatggtctcgatctcctgacctcgtgatctgccccacttggcctttcaaagtgctgggattacaggtgtgaaccaccgtgcccggactgcttggtgcccttttagggctgcatcaaagctgctgttgaaaatgtcctagcagggcagatgtgctggtggctgtgatttctttagaggtttttatccacatgggatcacacgcaactctttctgtgaaagatgattacaattttgggtaacagatgcactgatttttctcatgtttagggatcttggggtgcaggaggaccggcaggtcccacaggatatcctggagagccagggttagtggtaagtacagcactgctgatgtgatccctttaaaaaccagattctacatgaaaataaagaagcaacattgccattttgggtcagacacaggtgggccgtttgagagattataatcgatgaatcagtgaaaacccaccattatcagtgggactccatcttgaagcacaggtccctgcggatgagccactgacatcatcttcacagaaaacagcccatccatgatagaaactccatcactgcatgttttaaaattaagggtttcctaaataggaccctattttggggtaacaaaagaaggcacattctgatttctatgtctgatgattgatttgtgtttttttctcccttgatttagggacctccgggccaaccagggcgtccaggtttgaaggtaggcagtcatgagcaagatacatcaatagagccctgaacaatgaaatggttgaccactgatatttgtcagaatgatggctttcctcttatcagacttcccaaagtattccatgaactgcaatatattgtgtagccagaagtcttaattgcttttaattacttttttaaaattcaaaagcaattagattctttttcatttctttctcagggaaatcccggtgtgggagtaaaggggcaaatgggagacccggtaagaattccctcttgctctgaggagcagatggtgacgtgtgtgtgctgctcaggggtggaggctgttctgattatttgaacttgtactcattatctagtcactgcccaattttatggctgagaacttttctttgccgaattattatggcaccattacccttgactgtaaaatgaaagatctgacacaatttaacactactttcgggttaatttgtgcaacacatttcaccctagcaaacagattgaacatttttgacaatatattatgtccagagtaacagctttgtcaaatcacggatttgttttgcttaatttcacataaatcctaaactccacccttaaatatgcatataaatacaaatataaatgactggaaccaagagcactgagcaatacacaatctccaacccactccttttctatgcctgtcctccccgtctcctccccctgccactcacacccactgtccttttggccgacatgtaaaacttagtaagaataagctttagaaaagtgatttaagggctgagcacgatggctgatgcctgtaattccagcactttgggaggctgaggcgggtggatcatgaggtcaagagactgagaccatcctggccaacatggtgaaaccccgtctctactaaaaatacaaaaattagctgggcgtggtggtgcgtgcctgtagtcccaggtactcgggaggctgaagcaggagaattgcttgaacctgggaggtggagcttgcagtgagccaagattgtgccactgcactccagcctggtgacaaagcaagactctgtctcaaaaaaaaaaaaaaaaaaaagaaaagtgatttaagaaggcaactcacctggaaacaatctgaacatccagcagtaggtgagtggctctttcaacaactgagggcaagtcaatattaagcatctgctccatgccaagctaggactgacactgggtgtggggatttagcaagacagacctgatccctgctctcatggagttccagcgtgattgagtaagtcatggtacagtcatttaacagaacggcacaggagtcaaaaatatatataacaacttcatgatgtggggaagtgcctgtgatataatgctgaacagaaagtacaggttacaaaaatataaactcaactttgtaaaagcaacagcaacaagaaagacattaaaatatacacagagagggatttctcaacctcaggctgctgctatttcattgttgtggaggctgtcctgtgaattacaggatgtttagccacatccctggcctctccccactagatgtcagtagcatcccgtccctccaattgtgacaacttaaaatgtatcaaaacattgccaaatgtccctgtgggaaggggttgcctaactactttccccttcccccaaccttgagatctctggcttgtagaaatgactgaatgaaaatataccaaaacaatgtttttcaagtttgggaagccatggagctctggaatatgttcgtcgaagccacaggagcccgtgtgccattgcagaatccagcaagcattggcatcttagtgactttccgcgccagtccaatcagacacatttgcaaactcaggctgtggaataacttggaagtatttggctatgaggtggccattcaaatgatctcaaatgtgcttaccttaattcttttagattgtcaggtgaatgaacacataattttacaattttgggccaggcccagtggctcacgcctgtaatcccagtactttgggaggccgaggtgggtggatcacctcaggtcaggagttcgagaccagcctggcgaacatggcgaaaccccgtctctgctaaaaatacaaaaattagccgggcatggtggcgtgtgcctgtagtcccagctacttgggaggctgaggcaggagaattgcttgaacctgggaggtggcagttgcagtgagccaagattgtgccatttcactccagcctgggtgacagagtgagactacgtctcaaaaaatataaataaataaaataagataaaatattgatgcagaattctcagatgttctagagcatgtttgcccacctcattttaagaaacactgccctaaatggttgctatttatgcctacatgatataattatggaccttttacattttaattcttcatagttttccttctttgtacttttgactatgctgagtatatggtacttttacaatatgaaaaaaatagcagtatgaccaatattttgaagaagccggctgcttgtcagcttttaagggttttgttcaggtttatctcaattacaagaataagagtggctatctttaccaatacatgctatgcttttactcatgttttgttaatgtgcttgttcaatggtttattcacacagcagatatctttagggcaggtgctacaccaacactgtgttaggtgtgtagataaatcaaggaaaaaaaaacaaaacagacaatgtttctaatctggcttttcttcaatttcccaggtttaggtagaaattgaactcttttttttttttctatttaaacttgatattcttctaaaaattccacctatcaaaagcattagtagttttagtaatgatatattggggaatttactttgttaccctcaatacgggaagcattttatgtatattatctattcaatggaagaatagtttgaggtaggtaatattacaatctccatttcacagagaagaaaaatgaggtttcaaggaagtaaggaaatgaggactgagagaggttttaaggaacttgccccaagtgacagagccagtaagggcctggtttgcaaacatgggtgacctatgtatagcctgttcttaactatgacaaaaagaaagatcatactaagtgtagaataatagtaatacccagaaaagcacaaaatatttattttctaattaatggtgagaatttatgattgtggcaaaattcattcaagaaacattcttttcttcagtagaaaaacatctatcatggcataaataaaaattttggctattattttacagttttaaaatattattgaaaataaatagaaataatctaatctaaccagagtgagatggcttaatacatcacagtacattcttgtgatagattatttattggcactaaaaatcaggattgttacgtgaggccaggagtttgagaccagcctggccaacatggcgaaatcccatctctactgaaaatacaaaaattagctgggcacgatggtgcattatctgtaatcccaggtactcaggaggctgaggcacaagaatcacttgagcccgggaggcagaggttgcagtcagctgagattgcgccattgtgccccagcctgagtgacagagaacactctgtctcaaaaaaaaaaaaaaaaaaaaatcaggatcctgaagagattttagtataatagaaaaaggctcacaaaatattgtaagaaaaatataaaattatttaaaaatttaataaaatatgctgtatattttaaatcatgtttatatatttattatagtattctgattatattttcataaacataaaacaaattgtttattcacctatatacacatatatgtacatatatacacatatgtacacacaccaccaaaaattatatcaaagttttaataggccgggtgcggtggctcacgcttgtaatcccagcactttgggaggccgaggcgggcggatcacctgaggtccggagttcgagaccagcctgaccaacatggagaaacccccgtctctactaaaaatacaaaattagccgggcatggtggcgcatgcctgtaatcccagctactctggaggctgaggcaggagaatggcttgaacccgggaggcggaggttgctgtgagccgagatcgcgtcattgcactctggcctgggcaacaagagtgaaactccatctcaaaaaaaaaaaaaaaaaaagttttaatagagattacttctggatagtaggattttttatttatttatttatttattgagatggagtctcgctctgtcgcccaggctggagtgcagtggcacaatctctgctcactgcaagctccacctcccaggttcatgccattctcctgcctcagcctcccaagtagctgggactacaggcgcctgccaccacgcccggctaattttttttttttttttttgtatttttagtagagacggggtttcaccgtgttagccaggatggtctcgatctcctgacctcgtgatccacccacctcggcctcccaaagtgctcggattacaggcgtgagccaccgcgcctggccctggatagtagcattaagaatcattttcattttttaaatttatttttaacaataagtgtgtattaaatttttataagaaaataaatatccttttatattctatgatgtacttgccacaacttgtattttaaatccatgacacataggattggaagcattataccacaatacatgggtgaaaaccttcaaaacataaattaatatgaaattttcattatcttgcttttttttttaagggtgaggttggtcagcaaggttctcctggacccaccctgttggtagagccacctgacttttgtctctataaaggagaaaaggtaattcccaaatccatatgtcaccttggaaagtagcagtagaaaatattttttgacatggatctgtggcagcaaagtatagaggtctttctatgcatcactgcactagtttcaaacctactttaataagttggtactactgttggccccatcgtgcggcattgaaaatgaggcttggaaggttcccagtgttctcaagtttacccagctgctgagtggcagacctagctcaggctgctaaattatgacatgtgcttgttaatgttgttttgacgtgtggattgaaaagaccaccggaagcccagttgtcctttagatgttacagatgagtttgatgtcttgataattgagaaggtaacaaatgcatagaactgggccgtaatagattcttggcaaatattaattcctctgtcagctaccagtgctggtattattggtgccacatgaagattctattgttgcttttcaattgctgggttaaatttctttactttgctcaaaataagccactttttcaatggctgcattcccaaattgtatctgctgcctggttccgtggtccactgtggtatcccatatacctctcacatagagaactggctcaaatagtatctggtttataagtgtgctaattagaacaggtgaagagtaatctcttaagatttttttttttaaggtgaaacagattgtaaaaagagatgatttctgaaggagatggaattcagtatgttaaataataagaatagaccaaattatattcattgtaatttttagggtataaaaggaattcctggaatggttggactgccaggaccaccaggacgcaaggtagtttatttaagtacctttttttttttcatttgtgtgatgtactatcttaacttaaaatgttatttctcatggtctttatcattgctttaagtgctaatatatattaccagaatttttcactatcttatcataatactatagagcttctattctaaagtagttgttttctttaagctgctgacaataatttttgtttctcattttgttttttttccctattgctgaaatattgctttccctattgctgaaatattgttgcttgaacccctctaaatgttgtcatctcttaaagggagaatctggtattggggcaaaaggagaaaaaggtattcctggatttccagggcctcgggtaagcatcatttgctgttaacatcagtgaatttggagatatttctctttcatgtttttataaaaccaggtcagtagtcccacaagctcaaaagtgaagaatagctcatgtaagaacaaaacattttggacgagaattatggaatatctaaatatcccagagcatccttccattgacatcatttagataaaacaggcaagcaaaagatagaagaatttgggaaaagtgacaggattgtgccatctcttgtctggcacctcagtgccagtaggaaagtagcttggaatagttaatttaagtctatttgaggaaacaacatggtgatataggggcaggagctagaaaaaaagtacaatattaagctccaaacatcaccacatgtcactaatagaaagcccactcatagagtcaccatggaggccagaccgcagctggcatgggcattgagtttatttggttctagatttagtactgaatggggaaatattggtttccatggtcatttttattgctaatgatgcacagagcaactattaatttccaggcaaattatattgcagagattttaaagatatttggcccagtgcaagcactaagttaagtaaattaaatttggaaaagcaacgacaacaaaaatacattcttaattaaaacactggcaatgacatggattttttgaataagactgaggatcacttcaagtagcaaatgttataaagaaatggaatctattttatatttatttccttttattcagctagctttgcaaacaggaccaaatatccatggaacaatttgataaggtgaaaaatgatgcactgagctggttaatgcattctgatttaattctgtttatcctgatttttgtgaatttattagggggatcctggttcctatggatctccaggttttccaggattaaaggtaaatgtacctcattatagagataataaatacatttcattagtaaatgcaatttagtataattcagaagttgtactgttgcgtgcaaacacagtaattaggaaggcagacacattcattttatggattgcaggatttagctgtgggtgcaaaaattgaagcacaagattgtctgatgcaactgatgaacagtgttaagactttgcatggtctcagtgggcaatgtgttgcttaaattaaatgagaatgagataatttgtcacccagtcactttttttttttaaggcatgtttgtgcttgtttgtagggagaactaggactggttggagatcctgggctatttggattaattggcccaaaggtaaaaagtgagcctattttaatatatcctgataaaagtttatatccttaatattatctaatttatttttagaagtattgccaggaatcattcaagaatgtaatttttagaagagatacagttaattttttattcaattgttacattagtctgtttttcatgttgctgataaagacatatccaagactggacaatttacaaaagaaagaggttaaatggacttacagttccacgtggctggggaggcctcacaatcatggcagaaggcaagaaggagcaagtcacgtcttacatggatggcagcaggcaaagagagagtttgtacagggaaactcctattttttaaaaccattatcttgtgagactcattcactatcacaagaatagcacaggaaaggctgggcgtggtggctcaagcctgtaatcccagcactttgggaggccgaggcgggcagatcatgaggtcaggagatcgagaccatcctggctaacacagtgaaaccccgtctctactaaaaatacaaaaacaaaattagccaggcgtggtggtgggcgcctgtagtcccagctacttgggaggctgaggcaggagaatggcatgaacctgggaggtggagcttgcagtgagctgagatcacaccactgcactccatcctgggcaacagagtgagactccatctcaaaaaaaaaaaaaagaatagcgcaggaaagacccaccccccataattcaatcacctcccactgggttccttccacaacaggtgggaattgtaggagttaccattcaagatgagatttagctgggggcacagccaaaccatatcagttgtcccttgttatctgtgggagattagtttcagaacccctaggctaccaaaaccctcagatgctcaagtccctgatgtaaaatgatgtagtatttgcataatacttacacacgccatatcttatattttaaatcatctctaggttacttataatctctaatacaatgtaaatgctatgtaaacagttgtcatattctattgttttattatttttatcattggattgttattttttttaaaatattttttataagagtgctgactgtatagtactttaatgcatgctgtgtgttattatgcatgattatcatattatcatatcagtgtcatattaagcattattatgttctacatttgagaagtgatccttttgaaggtgaataatcatgagagtttaaaaaaattcataggctcattgagattagaaacagagggcatcttagagagttttctgcttttaacaccactgcattttttctttcctttttaacttttgtgacctcatctggcacttgctcagcatgtgcaagggaattgtgttcccttaaagccatggtggcattaaaggaacacaatttagagggacgctatttgttgctaaaataaaatgtagattcggaccttgttaggtgaataaactatttgtcatcgatgccaagttagacattaatgctcatggtatatctaagaaacttggtgacatcagaggtatccaatttataggcatagaataatttcactggagttaaatttcttttcctttgtagaagctttgtgacttgctatttacttccactacttgtagataagagattagatgcatctttgctgctcctaagactccatggatgcttcatttctctagtcagcctataatctctgcttcttatatgaatgtgcacatgatcgttctaatactggtttaatgccaggcaacatgagtaaaattaatattcctttaaaaagtgaatgaatgaatgatttcagggggatcctggaaatcgagggcacccaggaccaccaggtgttttggtgactccacctcttccactcaaaggtttgtgttcctattcagttcctccataaattatgcagaaataggagttgagtggccaggacagaagagtctggcccagtatttccatagcttgcacactaggcaggctgaatgcacgaactgtagcatgagtgtataattatacatgtgcatgaggtttttttcagtacatatactgtatgctgggatttttattgttatctttcagaaagtctatttttaatcgctaaaaattgtatgaaactattttactggctgggttcagtggctcacgcctgtaactctagtactttggaaggctgaggcaggcagatcacttgaggtcaggagttcgagaccagcctggccaacatggtgaaatcccatctctactaataatacaaaaattagctgggtgtggtggcacatgcttgtaatcccagctacgtgggaggctgaggcacgagaatcgcttgaacctgggaggtggaggttgcagtgagctgagatcatgcactcctgcctgggcgacagagggagactccgtctgaaaacaaaaacaaaaacaaaaacagaactatttgactaacacctatcaagatgctgccaccaaaaggagtagcctaaatcagtgacaaagaaccccattcaaagttcacgtgtctgaggaagaggcacagccaaggcggttcacatttaagatatttcgttttaaatgtaatgagaaactgcaaaaatgtctcctaattatactttactgagtctcacaaaaagtaattgttgtcttaattttaaaatgcacataccatttgtttattctcatgtaccattatctttggcaggcccaccaggggacccagggttccctggccgctatggagaaacaggggatgttggaccacctggtcccccaggtctcttgggcagaccaggggaagcctgtgcaggtacggatgccctgatgtgccctggcttttacaggtcagatttcctgcatcatcatcagcaccagtagctttcaactgtagctgatattggaatcaccttaggattgtgtaaaataataccgatgcctgtgcacaccccagaccaagaatgttagactcttgggagatgggcctggggatctgatactgtagaagcgctcctgtgtctgtaacatatagccaaggttaagaaccactgaactcaaaccaattaatcacttacttgggaggaatacaggtttctcagctgcaccccagaacattcaatcaatatcataggggtgttgtaaggaatatgtatgtataacaacaggcctcccacaaagttatcgcatgcagataaggcttggaaaccactgctaggattagtgtttccccatgttttcccaccctgctggaaggctctccctgttgacatctacttgtaaaatttagtacattcacctaatcccttgcttaaatctcctgcatgaaaggtggaagtaaaaattatgattaaaaaaactttcattcataattactttaaaaaagtcttcttccctcgcgtcaaaaacaaaaataagaaaatgatgggccacagtggcatttggtaaaaagcctgggaaagagtcctgttggcataaggactttgaactccttcaggtgctgcgctggttaatattcctagtaagattaggaattgaagtttagagggtatttgcagtctgtgaacccaggagaactgattaaacctgtgaggagaaaagtcttgagtaaacgtagttttacccagcctgtgtctcttgttatatttactgagaagaagtgagaaattttctgagatattcaactgctaactacaaaactcttgtttaatcttccatgaatctagctttcagtttgcaggattcaataaccacaaaggtggaaaagctttgtctagttcacttaacctttagatagcacagccttggcctaactgacccaggagtatataaataatatagagtattccgttggtcagaaagcactggactctggtcttagaattctccaatcaggcttgtttgtaatagaatagtgtctccagcatattaaaatgaagatctaatagtaagtaacaagtgtctctagtggattcaaacccaggaaacctcttaattcacaaggttttaaaaaataaattaacccaatagctttcaaatcttgactatgacccatagtaagaaatgcatttgattttacatttatatgaaaaacatatacatttatattacacaaacatgtatgtatccatatgtacaggtgattcagacaaaaatacacagaagtatacattttcggtatgtgacacactcttctatcccattcatttcttttataataaaaaaaatttaatgctgtcacaacttactctattgacttcatgctctacagttgggtggacaatactgcaagatgccacacactgtagcccattctccctgttggcaggtggttaagcattcttcttggcaatgggacaaggcagcaggcagcacccaggttcatccaatgactgattgtattgagtccacatcaggtcttagaaatggcatgaagacaagatggcagccaaatccacaggagctcattttcattttgttctaagcacaggagtgtatctagtcctattatatacttgtatatataatttgtagatatgatagatattattgttaatatctatggtatttactatatatacaacgtatagaatatcttgtagataatttggtaattatctacagtatttaccatgagataagcacagtttcagagtcagacacttgtaatcaaatcccaccttagcatttagtgaaagccatatagtataatgtggtacagtgaaatacttaatgcatttgcactatgaactagaaaagttccaatttctcctacttgcaagctgtgtgatcttggacatttattaaacctctctgtacatcagttttcttatctgtaaaacaagaccttggggttgaaagaaataatatgtatacagcctttagactgcagtctagtgtatagtaaagattcaatatattagctattattactacagatatttggcctaaactttgtgtgccttatctgtaaggtataaactttgcaggattgttcgaggagtgaatatgtttgtatgtctactgaagcccggcacatatggacacaataatgacagccattaatttaataaacatgctacattactgattactgacagggtttcagttatctcttgcggaaaaaatttcctaaaacctagtggtttgaaacaatagcaatcagtacagtacctctcactctttctgcagtttaagagttcaggaagggctgggcctgcctggacacctctctgatttctcttgtgtagcctcaggagcctccctgggtgggctctgtactaaggcttccttacaatatggtagcttcttatcattgcttatatggtagctcagaatttcagtctcaagtgttttggctcacaaggcagaagctgaatcatcttttctaatggcctcattcagagggaggcaacacacccaccttttgatagagaaatgtcaaagttcaacaagaggatgtaggacagagctcccgtgatggccatctgtcaaaaatgcagtcttccacagagaggatctggagccagacacgcttaggaaaaaagctgtgagaggtggtcactctcacagaggcttccggctatctttttttttgtttctttttgagatggagcttcgctcttgttgcctaggctagagtgcaagagtgcaatgacacgatcttggctcactgcaacctccgcctctcaggttcaagcgattctcctgcctcagcctcccaaatagctggcattacaggcacctgccaccatgcccaggtaatttttgtatttttagtagagatggggtttcaccattttggccaggctagtctcaaactcctgacctcaggtgatctgcctgcctcggcctcccaaagtattgggattacgggtgtgagccaccgggcctggccagctttcagctatctttaagccaaagacagcagcaaggggagcaggatgtcaaggggaagcaggatttcctgctgttgcattattcgttttgacctcatctgaacacactgaacattcactgagcatgtgctcttgctggatgttacactaagcttcttacatggattattttatttaatcctcataacaagcctctggaggtatatatacagaatgctcaataagttaaataaactgcttaaggtcccctgctacagagggaaaggccaagttgaaatctggtacctccatccttccccatcaacctgggctgctgtgataggtacaatattttatgttctacctagatgattacgtgagtctatatttttacccactaagtatgctaatatgtttatttggattatttttaccaagttatcaaggtagaaagattgaaaaactaatcatttaattaaatcaaatatgtttcttccccaataatcctaaagaatggggaaaaggtaagaaaatctgattctctaaacccatttctttccactgtgtgcttatttcaaaggaggcaagacattttaatggctgggatattgtctttatttttgagctatgttttttcttttaatgcagtttattcaaattattataactcctgctttacggctagtaatctgttctgtggaaaagcaaactttatacatcacttattttttttctacttctgaaagctgtcatctagagcattaggaaatagctttgtggagatatcactgacatataaaaattgtttatatttaagatacacagcttgatgttctgatatatgtatacattgtacaatgatcaccacattccagctaattaacctatttgtcacgtctacatagttatcatttgtggggggtggtgagaagatttattttagatctagcctcttagcaaaattcaaatataagatatagtattgttaactatcattttcacgctgtacagtagatctctggaacttatttatcttgcatgactaagactttgtaccctttgaccaacatcactccattcctctcttcccccagcccctgggaaccaccatcctactctctgcttttatgagtttgactatttcagattccacatataagtgagatcatgcagtatttctttctgtgtctggcttatttcacttagcataatgacctccagctccgtctctttccctttaaaaaattcgataacctaagcaagtgtgtaccaatcttgatttcttctacagagacgtttactctgagagtatatgtaattttcattcttgatttatcttgcaggcatgataggaccccctgggccacaaggatttcctggtcttcctgggcttccaggagaagctggtattcctgggagacctgattctgctccaggaaaaccagggaagccaggatcacctggcttgcctggagcaccaggcctgcagggcctcccaggatcaagtggtaaagtactccttattcatatccattagcatttatgctgcttttgatatttgcagtgccactaagaaagcatagtttttaaaatattttaaaagttatatgatgtttcatgagctaagttggttgtcttttacaaacaaataaactgaagttggactttcacatccattaaagtatgtgcaatcatttggttaggagtttcagtgtaaatgatagaacttggtaaaataataccaattttttttaaatgtagttttaattttcatcagagttatatatgggcttggtttgtgactgcccggtgggtttattttgcccactgcccagggagagccgatttgtcgagacaggggaattgcaatagagaaagcgtttaacatacatagagctggctaaatggaagactggagttttattattactaaaataataaatgaaataaaaataaaaataaaaaagcctctctgaaaatttggaggctagggttttttaaagatagtttggcaggcagggggctggggatgagatcatgggggtgtggaaaatggtcctaacgtgttgaatccacttctgggtgggtgccacgggacccttgagtcatgagtcttgggtctaggtggagccatccagtcatcagaaacgccaaagtctgaaaagacatctcaaaaggccaatcttaggttttataatagtgatatcatttataggagtaattggggagattgcaaatcttgtgacctctggaataataatgctgctaatcatttaagtatacctacatcttagcagaatacaggcccttcttgttttgttttgttttgttttgttttgtttacctggtggctttttattagcattatgaaggtagtttagttttggggagggctattattatttaaactataagtaaattctttcaaagttagcttggcccacgctcagaaatggccaagggcagtttagaggctaaagacaaggtgaagttatttaggtcatatctccttcactgtcacaattttttcactgtgagaatttttgcaagggcactttcaggtttaagagtcaaactgttctacaaggcatggtatggataactcaaatcccccacaactccttctcctaatccttcctctccaagggcaatcatttcaacacatgtggctggatattttgttatttgcctctatactgacattcaatgtacttgtattgctatttctcaatttttccaattcagcattatcttttgactttcctttacggaagatgaatttagctttctttcaccaacccctcacccgacatgtgcacattttctactcccacaaactacaatacaattattgtcataattttgcttccataaatattcagagtttacactgaatagttggttatataagggccattcaccagctgagccatataaagtataaattattgcttttccagaacatcttgtcaattgtcttgtttcctttgtctgtttgcttggttttcaatatacttataatttaacctcaaactgcccagaattatctaaatttcatcattatacactctaactcattaactattctattagtattagctctttgaataaatctctcctgcagctttttgagttgttcagattaggtcaggttgcattttttaatttgttgccagaatactgtcttgagatcttcctttaccaatatcctgagactttctttcctccatcctctctctttctctggggccctctatttcccatatattttttaatgctttactacctcattatatttcctgggaaaaagtgtaaataaaagggcaaagttgggagatcttgcttgtctgaaaatgccttaattctgctgtggactttgatttctagtttggctgagtataaaattttagttaggaaatctttctccctcaggattttgatggcattttctattgtttcctagcttccagtgttggctactgagaactcataacatttagatactttattttttggttttgaaatccattttcctttctggaagctcataggagctctttttttttgtttgtttttggggtcttaaattccacttgatttgccttagtgtgggtacatttgtactggcttgcacacagtcagtaagcagttttaatccagcatgtagctttcatgtcatgtcttttcttttcttttcttttcttttctttctttctttctttctttcttttttcttcctgagacagagtgttactcttgcccaggctggagtgcagtgatgcaatcttggttcactgcaacctctgcctccctggttcaagcgattcttctaccttagcctcctgagtagctgggatgacaggcacgtgccaccacacccagctaattttttgcattttttagtagagacagggtttcaccatgttggccaggctggtctcaaactcctgaccccaggtgatctgccccctttggcctcccaaagtgctgggattgtagatgtgagccaccgtgcctggccctatatccttcatttctgaaaatttttcttcaagtgtttctttgcattcaatcttagccaaaaggctgagaagagatcaagtgtcctttgaaaacgttgtctcctccattttttcccctcttttttctctttctgtactctatctatctgtcagaaaatcaatcctacatgtcttttttttttttttttaacctttactctattactctccagctgtttatttttctgtaacactttctgggagatttcctgaactctacattacaacccttcacctgaatttttaaatttctgctctcatgatctatttatatctatatctatatctatatctatatctatatctatatctatatctatatctgtttttcaattgctgtgttctcttttaatgtttccttttgtagcaggctgttcatgtttcagggatgcaatactctccctcatcttctgttttaattgtaaaataaattaaaatagcttgctgtgatgcgtgtttcttctaggtttttttggcggggatagtagggggtctattttctttccctgctgccaatttcaggaaggggatcttttggtctgtttttttagacaaatcatcctgttttggacctcactgttgttcttattccagaggtacagattcttgaaatttaggagacatttctggggtaaatcaggttctttctcagctttctaagcttcctgtttcaaattcagcttttttttttttttttaaggatctgccaagttcttttacttggttgttgctggttcctctccctttttccttgtcctgtgggtttatacttatttttatttatttatttattttatttatttacttatttatttattttgagatggagtctcattctgttgcccaggctggagtacagtggtgcgatctcagctcactgcaacctctgcctcccaggttcaagcgattctcctgccttggcctctcaagtagcggggattacaggcacgcaccaccgtggctggctaatttttgtgattttgcagagatggggggggttttaccatgttggccaggctggtctcaaactcctgacctcaagcaatccacccaccttggtctcccaaagtgctgggattacaggtgtgagccatcgcaccaggccagtttatgctttttttataatattcttttactctactgggatttggggaggatgccaaactgtttgcattttatctgtcgtctttaactgacatctctgaaattttatttctataagctctgcttttccattttcttcattagctaagaattgatcactgagtgggggaatatctttgccatacactgagtccatttttttgtttatttgttttgttttgttgtccattatcttgttttgcaacccattaatttaaggtagggctgagattagggttggctttatcaatggttatggtagcagaagcatgccataaccactgcatcatctatatgtgtgtatattcttatttcagacagaaagaatcctaggaaaacaagggcgcaaagaatggggttgggaaaggaagcacgtgggggaggatgtgagtgcaaaagtcacttattctatagaagacagtcagaaaaattatgtgattctctctgcccacccccttacctccttgacagtgatatactgtagtgttgggaaccccggaccacaaggaataaaaggcaaagttggtcccccaggaggaagaggcccaaaaggagaaaaaggcaagtaggcaccaaaggtagaatttctagaagacaactgtacatggatgatcgggggcatttctgagatgtgtaatgtggcatttcattcagatttgttactcaccttagtcacccactagagtactccattaagtgctatgtgattacaagtcactgaaaagtcaaagccttgtgtcttatatatttataaagccttgtgtcttatatattataaaagtcaaagccttgtgtcttatatatttatatatatgtatgtatatatatatatatatatatggaacatttgcctgccatgaattttgtctgcaaatggtgactttgctcacaaggtcctcttgattccttgagagtggcagtgataggacagtattgatgtttgatttttgtgggacctatatttcccagactcatcaattgcctgtctctctgcttctccactctaaattgtttggagccgttttgggcaactgagtcaggtgggtgtgacagcatcaacacagatgaggagtctgactaccctgaagacatttgtttaagacaaaaagtcctgataattggaaaatgcattgtggtgaattatcaattataatattcaatgcaatcaaaatccttcttcatgtattattttgtctccttaattgtttagggtttgtgcactcaccaattaattttttcagtttttttttcaggaggaaccaaaggatgggcttttaaacttttaaaaataaaaaagttgaattatttttaacgtttcttcagtagaattggatatcagcttttccctagaatttgtcaggataaatttattaaggaacgaaaccctccatttgtttagaaatggtatgcccaccctacatcccatgcctaggcaccccatgtagtgccccatgccacacccagcccccacagcacgtgctctcaattgtctgcaagaagtgcatatcggactctttgttcttcatttatgctattggttttgtacagtaaagcccttattggggattttattcaggaaatatgacaaatctgccattgatcctctgtctaggaaatgaaggactctgtgcctgtgagcctggacccatgggcccccctggccctccaggacttcctgggaggcaggggagtaagggagacttggggctccctggctggcttggaacaaaaggtgacccaggacctcctggtgctgaaggacctccagggctaccagtgagtacctcttaccagtcatctttccagttaaaagagacatggtattagtctgttttcacactaccataaagatactacccaagactaggtaatttattaaggaaagaggtttaattgactcgcagttctgtatgggtggggaggcctcaggaaacttacaatcatggcagaaggggaagccggcatgtcttacacgacagcaggtgacagagagcatgaacagggaagagccccttataaaaccatcagatctcatgagaactcactcactattgtgagaacagcatgggggaaaccctccccatgatccagtcaccttctaccaggtccctccctcaacacatggggattatggcgattacaattcgagatgagatttgggtggggtcacaaagccaaaccatatcagacacgtagagataaaaatcgaggtgcctctttctaatttattgtgtgatatatgatttatgttttgaacctacaaacattatgctaatgcctgcaaaaacagtttatttactcatccattcatccatcgtttacttattcaactaattggtattgttaagtgcctgctatgttctaggccttgtttcaggtgctggggatacagcagggaccagagcccagtctctgccctcctagagcttcagagaggacacagaccatctaacagatcagcaagtaaatatccagtatgtcatgtggtgataaacgccatcaccatcgattgtagctggagagaagagagagaggggcagagcaggaaatgaagtcaaggaactggcaggaggttaggaagggctgcagagcatggggctttacagatgggtgaggtctgagcctttactctagactacatgaaacagccaggggagagttttaagaagagtgagacaatagttttaaatggatcactcactctggttgctctgtggagcatagaccatatggataagggacattggctgggagatgagctgggaggctgctgtgtaatcctggtgagatatgacagccaatgccttaatgtggtggtgctgggtgtggtgcaaggtggtcagattctggatatattttgaagacagagccaacatgttggctgttagtttggacataggatataaggaaaagagaagtaagggacagaaccagggttttttgtttgagccactggaagaaggcagttgccatgtactgagatgggaaggcgatggaaggagtgggcattgggtgaggaaagaaagcagtactgtttgagacatttcaagtttgagatgcctattatacagtcaagtcaagaagtcaagtaggcagtaggatgatattcaacttaaggattcagatgagaggtttgggctggggatataaatactggctttgtcagagtttacgtgatatcatgccagagagtggatgagatttacctcaaggtggttctcatttggtgaaagttacagatgaagcaggttgaggcaaagcctctcagctgtctgattgctcataatgcaagcactgcccactggggtactcccctggagactggagagagccctctgtcccctccttattaacaaggctcaatcctgggatggcctggaacttgaccatcaagccccaaaggacttttttccattttccccagaaaatctcatgaaaataaggttccaacccgagggccttaagtgaagttaatgattaaggtgtcccagcagtacccttgtcacatgtacaaagcccactggccacctctgctcaataggaagctaggtccttaatgcatgtatgtgcataagcatggttgcaattgttaagtagtttgcattcaacattttaccatagtcatttttgtgtgtgttggtacttaatcttcttagtgaagattttaatggctctaaaatatttttgcggcttcctgttgagttgctacttagggctaacatctttgagtgaggactgcttgtttatctagggttatcatggctaaggtttacttaattcagttgctctatggggctttcctttgtaggctggccacgtttctgattgtgtatctggtctgttgtgtatatgattctgtccatatggcttctctgcattaaattcattacattgtggtcatagtcagggaccagggtcataccatggggcactagggaaggaaagggtagagaagggagggaagggggaggagaaggggaagagagagaagaaaaggaagggaaagaaagaaaggaaaggaaggagggaagaaaagaagggaaaggaggaagggaaggacagacagaagagcatgaaagacggtgcagactatggggtgctctcgctcttgggggctctccatcctccctacatctcctctctctggagatggtctgcttgtctctggccctagcagccacagattggtaggaaagaagaaaacagaaaactaggcttaagttctttgcaattgtttgtataattgaaccaagtctttgcattcattgccttagcctgacggcgctccctaggatgggatttccggccaggatgctctagtgcaaggcactagggcctaggagcaagtggaccagcttcagatcccatctccgacatttgggagctctgcagtcttctaagttttacttgcagcatttataaaatggatataagaacaccatcttagaggcttgttggtaagaattcaattgagtcatgtgttttgcacactgtataaggtacataccagtgaattaaagtccaggaggctgcagagcgaaccaaaggtcgcaaactgtcacaggctgataacgtttggatgtgtgccccctccaaatctcatgttgaaatgtaatccccagtgtttgaggtggggcctggtgggaggtgttttggtcatgggggtggatccctcacgaatggcttagctccatccctttggtgatgaatgagttcttagttcttgctcagttagttcacaggagatctggttgttcaaaggagtctgggacctcctgctttcctctcttgctccctctctcaccatgtgatacactggcttcccacttcaccttccgccatgattggaagcttcctgagggcttaccagaagctgagcagatgctggtgccaggcttgtacagtctgcagaaccatgagccccttttctttacaaattacccggcctcaggtatttctttatagcgaagcaaaagtggactaatatatgggctatttctgacctgctggaatgtttggttgtgtcctcatggtgtttgtttttgagttattaatgtgaggtttatggcttctcctgagatattagaagtttatgaacacaaggttattgcgttcccactgctgctgtggctgcgggttgattccccccatgcctacccacctgttccccttggactggacaggcgccacccctgtaggcatctgcagttgatgtcccttatctagactgaacaactaggatatgcctggcagagaggaagtgttttttttgtttcgttttgcttttgtttttttttttggtggaatttcactcttgtcgcccaggctggagtgcaatggtgcaatctcagctcaccgcaacatctgcctcccgggttcaggcgattctgctgcctcagcctctcgagtagctgagactacaggcatgtaccaccacacccagctaattttgtatttttagtagagacagggtttcacctttttggtcaggctggtcttgaactcctgacctcaggtgatcttcccacttcagcctcccaaagtgctgggattacaggcatgagccaccgtgcccagcccggagaggagtttttgttgctgctgggcttccgttgttagagtaacacaagtgtttggtgatctcaggtcttaagattgtaaaaagtagctctctgtctgaagctgctgagaacctttgccccaggaatcgcttaggttacacatttatttcactagttaactgctgtattctcagtactcagagtaatgcctggttctttgtagttttcaaagaaaactacagtaatggttttagtaatgtttagtaacatttactaaacaatggtttagtaatggttcagtaatgttttcagtaaatgtttctttaatgaagtccagtaatagttttccttactagctcaaataagtctatgatctactctagtacttaaaattcgacacctacagagcattagagcaattcgtcatacatttgaagtctccaatgtgctgagtaatacactgctcagactcctgggatgggttcattcttccaaggtaccaaagtcttatttattaagcattccacttttttctctttctggaaagaaatttgtccaaatgctatgtgaacagttttctgtcctgataatttattcttcagaagggcattttctttatccatttcttgggcaggataccatatgacatacactttggccaggccccactgctacttatgactagcatatatagtaaaaataagaataaaagaaaacccaacctacattagtactttatgatttctaattctttctaatatattgatttatactaagaaatttgttctacccacctttttgatggttcacagacattgctacaaacaggatgctatactagagtgatatcagagatattgagttatgtgtggacatactttttttctctgcatgaaatggcttccaaccctgttgtccatttgagtttttatgtctgttgtttgcatttttggcttcctcttcactgttactgcctgatgattgctgatgccactgtgcccatctccactggtaccctcctcccctctatagctctcagcttataaattagtacagccggttaaaaaaagatagttaagcttgcttgaacacattgttagattgtgtgaaaataagacaagaccaggtgtggtggcttactcctgtagcctcaacactttcagaggcagcaggatcccttaaggctaggagtttgagaccagcctgggcaatacagcaagaccccatctctacacacaaaaaagtaaaatccaattagccaggcatggtggcatgcacctgcagttctagctaactgagaggctgaggtaggaggattgcttgagcccagaggtttaaggctgcagtgagttatgattgtgccactgcactgcagcctgggggatgaagtgagaccccgtctcaaaaaaagaaaataaataaaaagaaaatacgacaaggtagtggcatctgtgtgagcaaagcaactggcttgctcagtcatttttacctccctccaatttctttgctgtggttttttgattattgatatcactaggtaagtaaccttgggctctgtatagtgtttctataatggtatttgaaatggtgcttggccaccctaatatactgacaataggttcatatatatatattttttgacacagagtcttgctctgtcacccaggctggagtacagtggcacgatctcagctcactgcaacctccacctcctgggttcaagtgattcttatgcctcagcctcccaagtagctatgactacaggtgtgcaccatcacatccagctaatttttgtatttttagtagggacggggtttcaccatgttggccaggctagtctcgaactcttggcctcaagtgatccgccttccttggcctctcaaaatgctgggattatagatgtgagccactgcacccagccaggttcccataattttgacatggtttgatattcagtaatatgtaacacttaaaaagtatgactcaaattattcagatttgagcaatgttgtggttaagagagcatgagcatgtcagccaaaattagctatttacctgttatacagaataaatatattagcttcagaaaaggttcttaattcctcttctcctgctcatcaactttccttagcaggacgtcacttccatgcctttttcatcacaaacttatccctaaatctctaccttcagctctggtggcagctcttgtagttatcccactctcttctttcctctccatttcacattacaaagcccatgataattacaaaaattagttataaattttaatttgaggtagttgactcacaagacgttgcacagtcataaagttcccatgtatgcttccccagcttccccagtgatacatacacataaccatatttacataaccacagtacactgtcaaaaccaggaaatggtcattgatacagtcctcttaactcaggtacagaccttattcagatttcaccagcttttacatttgacatgtagttcaagagccccagctttgcaagacaggactaccttggaaggcagggaagtggaagagaccaagaatgccaagctagaatctttaacaagagatttaggagggaagaagagagagattcaatatgtacagatgtaactgttgatccatcacaattaacctaatttgtttctcttatttttcaccaagggaaagcatggtgcctctggaccacctggcaacaaaggggcgaagggtgacatggttgtatcaagagttaaaggtgagcataatcaatcacttaactccctgccattttatgaatgatgtatggaccctcctcttgcagtaatttcccctgtgaccatagatcaattctatacaatttaggatggttgagattacttaaaaaaatacttcctgcccttcataaggttgtatgaatgttgagccaaatcccctgtctcttatttgaaaacataaatattcctttagccacacattcacatcttcattatagtgaacttgagtttggctcaagccctcctttggcttggctggtgtttattcaccacattacagtattctatattagtcaataatattttcattgtaaatgaaagaagcccagcttgaaatcgtttttttaagtaatttattgacctaaacaaaatgtgaaatattaaaaggtagtgttttttattagtaagagttccccagggacagaactaataggatatatgtgtatatgaaaaggagtttattaaggagaattgactcatatgatctcaaggtgaaaccccactacaggctgtctgcaagctgaggagcaaggaagccagtagtggctcagccccaaaagtagtggctttcctacttttgagtccaaaagcctcaaaagtagggaagccaacagtgtggccctcagtctgtggctgaaggcacaagagccctggcaaaccactgatgtaagtttaagagtccaaaggccgaagaacctggagactgatgtccaagggcaggaagcattcagcacaggagaaagatgaaagccagaagactcagcaagccagcttatcccaccttcttccacctgctttgttccagctgtgctggcagctaattggatggtgcccacccacattgggagtaggtcttcctgtcgcagtccactgactcaaatgttaatctcctctggcaacaccctcacagacacacccaacaacaaccctttaccagctatgtaggcatccttcattccaatcaagttgacacttaatattaaccatcacaggttggcattgggacaaccagatcccggcctccagtggcatcaagaggctctccctgcatctttcatctcacattgtaccatctatattttctcccatcagactgattttcatacccccaggcagctccaagttcttacatccagagatgaagagagccctgctttgtcagctccaaatagaaaaataatttcagaaaggactgattagcttagggcaagtacccaaccgcagaccattccccctttcccatggccagggatagagtgctgtgcttggcatcacaggtaggggaagattctgtgattggcaccttcacacaccagctccttgctggaatgggaaaaggagcttttcccaagtaaagagattcaatggttctagcaattgtcattctcccctctggctttggcatgttttatgtgacttgagcaattgagatacacaggaaactaccaacccagaatcaaggtcattttctttattttttgtcctctctatcctactttaccctctgctgataagagcttgaatatcttttgacctctatttccagggcacaaaggagaaagaggtcctgatgggcccccaggatttccagggcagccaggatcacatggtcgggatggacatgctggagaaaaaggggatccaggacctccagtatgtagaattcttctcttgctatagaatttcactttcttatatggtcatacaaacaactatttcccctttctctatttgccaagctgaaattcagtaaaatatcaacatactataaatcagagtcacttttggcaccctgacatggaaagatgattgttttaagaggtatagcatcattggacatggtctaaaatcctcttggcagttcagtcctagcaggactttcggtccttggtctttatatcattctcgtggtgttcattttcttctgagaaacttgtatcctagaagggccccactgattttaggtgtattcagttgactctgtggggtggaggatggagctcgggtcccgatgtttagcatcaattctgtttcctggagaagatgcacatgggggaagtagtgagcatgaaagggtgaactcgtgcaaacccacagagtcaaggcgttggctgatggaaaatctcactgataaaggatgttgctgcatttttcagacatgcgttgggtggataccatgtgtaggtaatggtaattaaggtcataaaagaagaggatgagatgatccgatgcttaggaacttaaaatatcttaaatatgtgcagtatttctgaatgcttacaatatcacagaaaccagactagatggtttcctcaaaacagtcttctgaaaagcaatacctttccaattttacagtaagaaaatggaggcttagcatctgatattcaaggctacccatctgtcaaataggcaaaataggagtgaaaacttgtctgtcttatttcaaagtgcatgctatttctaccaacctgtgctgcctgccatatataatgggaagccactgagagtgttgcaacagggaaagaccatgtcctgattctacaggaaacccttcagacagaatccaagtgaacaagagagagaagcctggaaattggcttagatggtgtttatagctttctgacctttctcctgatcacaagtatgtgaatgatctctgctttaggcttggtaatctctgcttaattcattcttcctctcaaggaactacttagaaatcactgtcactgagtggatattgtcataatgtactcatctaattgtgaaaaagcagcgtctatatagatcaaactaggagacgaatttcaacgttcgctgaggtcttcctagattcgttgaaacaatccagatccataagactgttgtagaccacatttgagaccaggccatgtagaaggataaaaggtcactcaaaatgccagcaggacagtgtcagatattccttgcatttgagagtgcttgcagctgttcagtcaggtggggtgcaagaagggatgagacccacatatggtgggcatggaggcagccctgacttgaaagcctcattccccatgggagctgttatccactgcacagcttttgagaaccccaccagggattgccagtgagggaatccttgatgcaggctccccacagttcttccagaccagatgcaaattttgcaactggggattgattttactataagcagtactgcctaggaaggtagttgacaatctaatttttatcagaggaacagaaccagacagttaaccaaaagtcaaattgtcatgcaagaggagaaaggacttgctaggcttttacccacaggggtggaggatgatggagtctagctatgtatcttgtcaagagaatacataagaatgtatttgatttgtaatcccaccacctcccttgatctacttatttctatattctatgacatatgatattagagaatggtttgacataaatctcttattctgtatttaaggcatatcacacacattgtttccagtatttgaggcttaacacacatgcttatattatatgtatgtatataaattgtaaaatgtgtatattggccaggcgcggtggctgacgcctgtaatccctgcactttgggaggctgaggcaggtggaggtcaggggtttgagaccagcctggccaacatggcgaaactcagtctctactaaaaatacaaaaattagccaggtgagctggtgggtgcctgtaatcccagctactcaggaggctgaggcaggagaatcgcttgaacctgggaggtggaggctgcagtgaaccgagatagcaccactgcacaccagcctgggtgacagagagagactccatttctatatatatatatttaaaatattaaaaagtatctaagttatttattttaaacttacatttgcttaagagtaactgtctcctgaaattatggacttttgcgtgtgtttctgtaacctacaatgactgctttgagttcatggacattcagtggttggtaattgactcatgacataacattcccagggggatcatgaagatgcgaccccaggtggtaaaggatttcctggacctctgggccccccaggcaaagcaggacctgtggggcccccaggactgggatttcctggtccaccaggagagcgaggccacccaggagttccaggccacccaggtgtgaggggccctgatggcttgaagggtcagaaaggtaattttaaaaaaattttatttatttcaatagctttggggtacaagtgtttatttttcttatgtggaagaattatatagtggtgaattctgagattttagtgtacctgtcacccgagtagtgtacattttacctaacgtgtagatttttgtatccctagacccctttcctccctcctccttctttttttttttctcagtattcaagtgtttttctttttctttttctttaattttactttaagttctgggatacatatgtagaatgagcaggtttgttacataggtatacatgtgccatggtggtttgctgcatctatcaacccatcatctaggttttaagccccacatgcattaaggtatttgtcctaatgctctccttccccttacccctgaccccctgacaggtctcgatattatgtgatgttcccctccctgtgtccatgtgttctcattgttcaactcccacttatgagcgagaacatgcggtgtttggttttctgttcctgtgttagtgtgctgagattgatagcttccagcttcatccacatccctacaaaagaaaatgttctcattctttttttatggctgcatagtataccatggtgtatatatgccacattttctttgtccagtctatcattgatgggcatttggtttggttccaagtctttgctatggtaaatagtactgcaataaacatatgtttacatgtgtctttatagtagaatgatttataatcctttgggtatatacctagtaatgggattgctgggtcaaatggtatttttgattctagatccttgaggaatcaccacactgtcttccatcatggttgaactaatttacactcccaccaacagtgtaaaagtgttcctatttctccatatcctctccagcatctgttgtttcctgactttttaataatctctactctaactgccgtgagatggtatctcattgtggttttgatttgcatttctctaatgaccactgatgaaaagctttttttcatgtttgttggccacataaatatcttcttttgagaagaaggatatctgttcatatccttcacccactttttgaaggggttggttttttcttgtaaatttgtttaagttccttgtatattctggatattagacttttgtcagatgggtagattgcataaattttctcccattctgtaggttgcttgttcactctgatgacagtttcttttgctgcacagaagctctttagtttgattagatcccatttgtcaatttggcttcttttgcaattgcttttggtattttaatcatgaagtctttgcccatgcctatgtcctgaatgatattgcctaggttttcttctagggtttttatggttttgggttttacatttaagtctttaatccatcttgggttaatttttgtataagatgtaaggaaggggtccagtttctgctttctgcatatggctagccagttttcccaacaccattaattaaatagggactcctttccccatagcttgtttttatcaggtttgtcaaaaagcagatggttgtagatgtgtagtgttatttctgaggtctctgttctgttccattggcctgtatatctgctttggtaccagtaccatgctgttttggttactgtagacttgtagtatagtttgaagtcaggtagcttgatccctccagctttgttctttttgcttaggatggtcttggctatatgggctcttttttggttccatgtgaaatttaaagtaatttttttttctaattctgtgaagaaagtcaatgatagcttgatgggaatagtactgaagctataaattactttgggcagtatggccattttcatgatattgattcttcctatccaagagtgtataatgtttttccatttgtttgtgtcctctcttatttctttgagcagtagtttgtagttctccttgaagaggtccttcatattccttgtaagttgtattcctaggtatttttttctctttgtagcaattgtgaatgggagttcactcatgatttggctctctgcttgcctattgttgatgtataggaatggttgtgaattttgcacattgattttgtatcctgagactttgctgaagttgcttagcttaaggagtttttgggctgagacgatgggattttctaaatatacaatcatgtcatctgcaaacagagacaatttgacttcctctcttcctgtttgaatgctctttatttctttctgttgcctgattgccttggccagaacttccaatactatgttgaataggagtggtgagagagggcatccttgtcttgtgctggttttcaaagggaatgcttccagcttttgcaaattcagtatgatattgcctatgggtttgtcataaatagctcttgttattttgagatatgttccatcaataactagtttattgagagttttttcatgaagagatattgaattttattgaaggccttttctgtctctgttaaaataatcatgtggtttttgtcagtggttctgtttatgtgatgaattatgtttattgatttgcatatgttgaaccagccttgcatcccagacttgatcgtggtggatatgctttttgatgtgctgctggattccgtttgccagtattttattgagggtttttgcattaaggttcatcagggatattagcttgaaaatttttgttgttgtgtctctgccaggttttggtatcaggatgatgctggcctcataaaatgagtaagggaggagttcttatttttctattgtttggaatagtttcagaagaaatggtaccagctcctctttgtagctctggtaaacttcggctgtgaatccatctggtcgtgggctttttttggttggtaggctcactacctcattggttactgcctcaatttcagaacttgttattggtctatttgaataaccaaataaaccagatttgaattcttcctggtttagtcttggggcatcctcccttttctgaatctctgaagtccattatatcactcttatgcctttgcatactcatcacttacctcccactcgtaagtgagaacatacagtttttggttttccactcctgtgttacttcatttataattatggcctccagctccatctaagttgctgcaaaagccattgttttgttccttttaatggctgagtagtattccatgttttttgtataccacattttctttatccactcattagtcaacaggcacttagattggtgccacatctttgcaattgtgaattgtgctgctataaacatacatgtgcaagtgtctttttcatataatgacttctcttcctttgggtagatacccagtagtgggattgctgggtcgcatggtggatctacttttatctctttagggaatctccacacttgttttctacagaggttgtactaatttacatttccatcagcattgtataagtgttcccttttctccacatccatgccaatatctattgttttttgtctttaaataatggccattttttgcaggagtaaggcaatatctcattgcagttttaattggcatttccctaatgattagtgatgttgagtattttttcacatgcttgttgtccatttgtttatcttactttgagaaatgtctattcatgtccttttcccactttttaatgggattatttgtttttttcttggtgttttgtttgagttctttgtagattccgcatactggccctttgtcggatgcatagtttgcaaatagcttctcccattctgtgggtttctgtttactctacttatttattttttttgttgtgcagaggccttttagtttaactgggtcccatttatgtatttagtttttgttgcatttgcttttggggtcttattcatgaattctttgctgaggccaatatctatatgagtttttccaatgttgtcttatagaattttgatagtttcaggtcttatatttaagtctttgaaccatcttcagttgatttttgtataaggtgagagataggaatccggttttattcttctaatacatgtagcttggcagttttcccagcatcatttattaaatagggtgtccaccccccaattttttgtttttgtatgctttgttaaagatcagttagctgtagatatttggctttgtttctggattctctgtgctgttccattggtgtatgtgcctacttttacaacagtaccatgctgttttggtaactaaagccttgtagtataatttgaagttcagtaatgtgatgtctccagatttgttcttttttgcttaggattgctttgtctattcaggctcttttttggttcaatacaaaattcaggattgttttttctaattctatgaaaaatgatgtgcatattttgatgggaattccactgaatctgtagattacttttgaagtgtggtcattttcacattatcaattatcccaatccataaacactggatgcatttccatttgtgtcatctatgatttctttcaacagtgttttgtagttctcctttttgagaactttcacctccttggttaagtatatttttagttattttattttagttttcacagctgttgtaaaaggaattgagttattaatttgattctcaacttgattgttgttggtgtatagcaatgctactgatttatgtacaatgattttgtaacctgagactttactgaatttgtttatcatatctaagagtatttttgaagaatccttaggattttgtaagtgtacaatcatattatcggcaaacagtgatagtttgacttcctcttttctaattttgatgctgtttatttatttctcttacctaattgctctggctagtacttccagaactatgttgaataggagtggtgaaagtgggcatccttctcttgttcctgttctcagggggaatgctttcaacttttttccattccatatgatgttatctgtgggtttgtcatacatagttattattatttgaggtaggtcccatctatgccttgtttgttgagattttttgtcataaaggaatgctggattttgtcgaatgctttttctgcatctattgatcatgtggtttttgtttttaattatgtttatgtgatggatcacatttattgacttgcatatattaaaccatccctacatccctgggatgaaaaccacttgatcatgatgaattctctttttgatatgctgttcaattcatttagtattttgttgaggatttttgcatctatgttcatcaaggaaattggtctgtagtttgtgtgtgtgtgtgtgtatcttttcctgtgttggtatcaggatgatactagcttaatagaatgatttagggaggatgccttctttatcaatcttttggaacagtttcagtaggatttgtaccaattcttttctctcagtgtctaagtagaatttagctgtgaatccatctgattctgggtttgttttcttgggaatttaaaaattactgattcaatctcactgcttgttattggtttgtttgaggtttctatttcttcctgatataatctagtagggttttatgtttccaggaatttgtccatttcctctagatttcctagtttgtgtacataaaggtatccatagtagtcttgaatggtcttttgtatttctgtggtgttggttgtaatgaccccagtttcggttctaattgagcttatttggatcttctctcttcttttcttgtttaatctagctaatggtctattgattttgtttattttttcaaggaaacggctttttaactagctttttattcattaatttttcatatttttttggtttgcatttcatttggttcagtctgatctttgttatttcttcttctagctctaagtttagtatgcttttgtttttctagttccttgaggtgtgactttaggttgtcaatgtgtgctttttcagactttttgatgtaggcagttagcactataagctttcctcttagcactgcttttgctgtattccagatgttttgaaaacttgtgtcaatattatcattcaattcaaataatttttaaatgtccatcctgatttcattgttaacccagatatcattcaggagcagattatttaatttccatgtatttgtataattttgagggttccttttggagttgatttctaattttattccactgtggtctgagaagatacttgatacaatttcagttttaaaaaatttattgagacttattttgtggcctgtcatatggtctatcttggagaatgttccatgcttctgagaagaatgtatatcctgcagatcttgggtagaatgttctgtaaatgtctgttaagttaatttgctctagtgtgtcacttacatccattgtttctctgttgacgttctgtcatgaagatctgtctagtgctgtcagtggtgtattgaagtctcccactattattgttttgctgtctatctcatttcttaggtctagtagtaattgttttttgaatctaaaagctccagtgtttggtgcatataaatttatgattgtagtatcttcttgttgatcgttttatcattacatagtgaccatctttgtctttttgttattactattgttattttgaagtttgttttttctgatacaagaatagctatccctgctgcctttggtttctatctgcatggaatacattttcctacccctttatcttgagtttatatgagtatttctgtgttagcctcttaaagacagcagatatttggattgtgttgtttttgtccattttgccatcccgtatctttgaagtggagcatttacactcaacatgaatattgagatgtgaggtattgttctcttcatcatgttaattgttacccagatagttgtcttttcattgtgttattgtattataggccgtgtgagttctaaagtttcaagaggttctattttggtgcatatcaggcttttgtttcaaggtttagaactccttttagcatttatttatttatttatttatttattattatactttaagttttagggtacatgtgcacaatgtgcaggttagttacatatgtatacatgtgacatgctgctgtgctgcacccactaactcgtcatctagcattaggtataactcctaatgctatcctcccccctcccccctccccccaccccacaacagtccccagagtgtgatgttccccttcctgtgtctatgtgttctcattgttcaattcccacctatgagtgagaatatgtggtgtttggttttttgttcttgcgatagtttactgagaatgatgatttccagtttcatccatgtccctacaaaggacatgcactcattgttttttatggctgcatagtattccatggtgtatatgtgccacattttcttaatccagtctatcattgttggacatttgggttggttccaagtctttgctattgtgaataatgccgcaataaacatacgtgtgcatgtgtctttaaagcagcatgatttataatcctttgggtatatacccagtaatgggatggctggttcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgattgccattctaactggtgtgagatggtatctcattgtggttttgatttgcatttctctgatggccagtgatggtgagcattttttcattgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctttttctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccgtcttgaattgatttttgtataaggtgtaaggaagggatctggtttcagctttctacgtatggctagccagttttcccagcaccatttattaaatagggaatcctttccctattgcttgtttttctcaggtttgtcaaagaccagatagttgtagatatgcggcgttatttctgagggctctgttctgttccattgatctatatctctgttttggtaccagtaccatgctgttttggttactgtagccttgtagtatagtttgaagtcaggtagtgtgatgcctccggctttgttcttttggcttaggattgacttggcgatgccggctcttttttggttccatatgaactttaaagtagtttttttccaattctgtgaagaaagtcattggtagcttgatggggatggcattgaatctgtaaattgccttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttacttatcagcttaaggagattttgggctgagacaatggggttttctagatatacaatcatgtcgtctgcaaacagggacaatttgacttcctcttttcccaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaagttgttgaattttgtcaaaggccttttctgcatctattgagataatcatgtggtttttgtctttggttctgtttatatgctggattacatttattgattcgcgtatattgaaccagccttgcatcccaggggtgaagcccacttgatcatggtggataagctttttgatgtgctgctggattcggtttgccagtattttttgaggatttttgcatcaatgttcatcaaggatattggtctaaaattctcttttttggttgtgtctctgcctggctttggtatcaggatgatgctgacctcataaaatgagttagggaggattccctctttttctattgattggaatagtttcagaaggaatggtaccagttcctccttgtacctctggtagaattcagctgtgaatccatctggtcctggaccctttttagttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttctttcagtcctgctctgattttagttatttcttgccttctgctagcttttgaatgtgtttgctcttgcttttctagttcttttaattgtgatgttagggtgtcaattttagatctttcctgctttctcttgagggcatttagtgctataaatttccctctacacactgctttgagtgcatcccagagattctggtatgttgtgtctttgttctcgttggtttcaaagaacatctttatctctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggaatgctttacttccaagtatgtggtcaattttggaataggtgtggtgtggtgcagaaaaaaatgtatattctgttgatttggggtggagagttctgtagatgtctattaggtctgcttggtgcagagctgagttcaattcctgtgtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattgagccctttcccattatgtaatggccttctttgtctcttttgatctttgttggtttaaagtctgttttatcagagactaggattgcaatccctgcctttttttgttttccatttgcttggtagatcttcctccatccttttattttgagcctatgtgtgtctctgcacgtgagatgggtttgctgaatacagcacactgatgggtcttgactctttatccaatttgccagtctgtgtcttttaattggagcatttagtccatttacatttaaagttaatattgttatgtttgaatttgatcctgtcatgatgatgttagctggttattttgctcattagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagagtttctgccgaaagatccactgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagatgtagatttggtcttttcacatagtcccatatttcttggaggctttgctcatttctttttattcttttttctctaaacttcccttctcgcttcatttcatcttccatcgctgataccctttgttccagttgatcgcatcggctcctgaggcttctgcattcttcacgtagttctcgaggcttggttttcagctccatcagctcctttaagcacttctctatattggttattatagttatacattcttctaaattcttttcaaagttttcaacttctttgcctttggtttgaatgttcccccgtagctcggagtaatttgatcgtctgaagccttcttctctcagctcgtcaaagtgattctccgtccagctttgttccattgctggcgaggaacttcgttcctttggaagaggagaggtgctctggtttttagagtttccagtttttctgctctgttttttccccatctttgtggttttatctacttttggtctttgatgatggtgatgtagagatgggtttttggtgtagatgtcctttctgtttgttagttttccttctaacagtaccctcagctgcaggtctgttggagtactgggccctgtgaggtgtcagtctgcccctgctggggggtgcctcccagttaggctgctcgggggtcaggggtcagggacccacttgaggaggcagtctgcctgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttctgggctgctttgtttacctaatcaagcctgggcaatggcgggcgcccctcccccagcctcgctgccgccttgcagtttgatctcagactgctgtgctagcaatcagcctggcgtaggaccctccgagccaggtgcgggatgtgatctcctggtgcgccgttttttaagcccgtcggaaaagcgcagtattcgggtgggagtggcccgattttccaggtgccctctgtcacccctttctttgactaggaaagggaactccctgaccccttgcacttcccaagtgaggcaatgcctcgccctgcttcggctcgtgcacggtgcgcgcacccactgacctgcacccactgtctggcactccctagtgagatgaacccggtacctcagatggaaatgcagaaatcacccgtcttctgcgtcgcgcgcgctgggagctgtagactggagctgttcctattcggccatcttcccttttagcatttcttgtagtgcatgttttgtagtgaaaaatttcctcagcatttgcttgtctgaaaatgactttatttctccttcatttatgaaatttagttttgtggaatacgaaattcttggccgacagttgttctgtttaaggaggttgaagataggatgccaatcccttttggcttgtaaggtttctgctgagaagtctgctataagtctgataggttttcatttataagttacctgatgcatttgtctcactgctcttagaattcttgccttcattttgaatttagatagtctgataactatatggcttggtgaaggtctttttgcaatgaatttcccaggagttctttaagcttcttggctttggatatctagatctgtagccaggccatggaagttttcctcaataactgcctcaaattagttcttttttcttttccctcaggaatgccaattagtcttaggtttggctgttttactaataccatatgtcttagagtctttgttcatttttttcttatttttgtctgattgggttaattcaaaagccttgtctttgagctctgaaattctttttgttctagtctattgttaaaactttccactgcattttgtaattccctcagtatgtttttcatttgtcaaagttcggattagtttttcttgatgatatctgtctagagaatttttttgttcatatcctgaattgctttttaaatttatttatgatgttttcacccagaaaggtaattttgaatatttctgtggcagaatgtcacataaaatcatggaagctaaaatgagtctcttctgggcaaaattattatagctatggcataatagctacataaaatttgatccaggcactgttcaaaccttgtaccttgttaaacaaataaaagcattacaacacaatatttaaagtaaatccttaagatgctaaaatatctttgttgttttatttgacataccaaaattgcttttccttcatttctcagtatgaactcatacaatctgactatattaaaattacatatatgtatatatattatatacacatactcaaagtatagaattatttttatagtcttttgagataatactatatattttaatttttaaaaactagtatctcatttaaactatcattgtccatgaaaaaccatttgttggcattctagtgagaaaaaagaaggtattttaaatatattttacagttatgtgaatttcaaacaataaaatgactttcaggattatagctgaaaactcttaagaaggtggcaaaaaaggtttaagtttttttcttttgtaacatgtattatatatatatcttgaactacattgctagttgtgaagttttagaacaaagtaatatcctttgttcttgttttgataacagaaaggcaagcaagtatcttggtatttgataaggtataaattcatggtctagaacccaacaaaatctgatgtcatttttattcatctgatatatcttagatctgagagcatataaagaaatgcactatgaggtattattcctaatataaaagagaaaaattccattttaggatacaggaactgagagggaactgagaggctcaaacttgggtgttttattggtgatatctatctctctagaaaatttttcattcagaccctcaactgcttattaactttctttaaacatttctttaacatgggggatgatgctactagattgtgaagtcattagaaaaatgagacaatatacttgaagcaccaaccctcaataagtggtagctattcacatttagcccagcctcttcatttgcacaatttctccatgttcatagtaagagtcagattttctgaactcagcattggacacctgctgctattttatgatttatcgagacttctcattctattgtgttagatatgcatgtaatagatctccattacattattattattatctactacccatgtagttcatctccattacatttttatcatctacattgcttttatagattattgaaacttatactttttataatcaatatatttcttttcttacgtttataactcttctgacagttgaaattcagatttcaggaaaaatctaaaaattctgtatgaaagcagcttaagtgatctaatgatacttgggagtcttctttttctttgacttctgcatatactatacagaaaaatatcttgaggaagttgtcattgagacagactcacattgcactgggctatcagttatgtgaatgccgcttttcttttctcattgcaggtgacacaatttcttgcaacgtaacctaccctgggaggcatggccctccaggttttgatggacctccaggtattatcaatgagaagttactgtcttatatacttcccagagtaaaaaaaaaaaaaccagccagacagataaaccaagagtgaatcctcagactagttaggacatttctgaagttttgagggaccatggataggggaaaacagcatttgtagtaatttgtagttgggcctctagtctgctggtttgagaacactccagatgggcttttcaaatctttgtacaataaaatttaccttgatttgctcacatatcagttaaaatgtctgtcccttgaaagttttttttttttttttgagacggagtctcactttgtctcccgggctggagtgtagtggtgtgatctcagctcactgcaacctctgcttcccaggttcaatgattcttccgcctcagtcttccaagtagctgggactacaggtacccgccaccgtgcccggctaatttttgtgtttttagtagagacagggtttcaccatattggttaggctggtcttgaactcctgaccttgtgatccgcccacctcggcctcccaaagtgctgggattacaggtgtgagccaccgcacccagcctgaaagttttaaaactgtatcttctttcctttcctgtgcctcaagagtgaatcatgatcacttgtttattgattgtaagttttactttccaagagaaccaacatttgatcagaaacatttgaaaaaaatgcccaaatatctctgtccttgtttgcacattcatgcaacagcttcatttgaatcaatcacttatttttagatgaattaaatccaaaatctatctaagatattttgcctaactcttctttgtttctttagagttccctacccgttcattactagtatgaataatgactgactgttactctctctaccatcaaattttatgacaataatgtgtaaataatctcaaaatctcagtgggctacagcaaacacttattttctatcttatgggtctgcaggttggttgggtttagctgatctaagatggtctctgttggcttagagtgtagctccaagttaggtttggggttgcaacatgcatctcattgcaaggccaggcttttctcatgtgattgcagaaatgcaagagggccagctcagctcacaggctccctccacacctctgattggatcatgggcattcatttcctattgcccaaaacaagtcacatgaccaagccctgggtaaaagggcagggaattacactccgcccaccacaaggcaatggcaagagtgcggaaatataattccgtatcagcagagtggagaattgcaggttgacggattgaacgttcatttttacttttactggtcatgggtggataaaaaaaagtttgatttctttcagcagctgtaacttcgagagaagtgaatactcacattttaatttgacagttgtgcctccattgaagtttatgatttataagttattttagctgagataactccttgtagaaaatcacagaaggtttaaaatagattctctaggccgggtgcggtggctcatgcctgtaatctcagcactttgggaggccgaggtgggtggatcacgaggtcaggagatgagaccatcctggctaacacggtgaaaccctgtctctactaaaaacataaaaaattagccaggcgtggtggcgggcgcctgcaatcccagccacttgggaggctgaggcaggagaatggcgtgaacccaggaggcagagcttgcagtgagccgagactgcgtcactgcactccagccttggtgacaaagcaagactctgtctcaaaaaaaaaaaaaaaaaaaattctctattactttttgcaagtgctttttgcctatacttcatttaagggcaaattcagtaagatgcagggaaatagattttggtctttaatctgatcctttcttgtcaaggtagacactggccaccacctctttacccctacaagggcagacaatggttgcatagtcgtgtttcagacctagcatgggaagataccaaaaaaagtcacctgaatggtggtacaagttccaaaggctttcaggaagaatccttcacaggatggcttctgagaaagtgccttaacaaaatcactcctagaaaacatttatttggagcatatgacttacaatatatttttgtaaatcgggataggcaacatccttacttccataaagtagaaatattctaaaaggacttaacatagacttaaagaaaatcatctcattttgttcacattagattttgttttattgagtctgtgttttgtttttattattgtttaggtccgaagggatttccaggtccccaaggtgcccctgggctgagtggttcagatgggcataaaggcagacctggcacaccaggaacagcggaaataccaggtccacctggtcagtgaggttttttttttttttttttttttttctgctttgggaatatctatcaggaactttttaacatttctaccgatggataatttcattgaggaaatggtccagggatccctagataatagggaaatggtgtttcttgatagacccttagctatattgtgataactttcagattataattttataagttgccaaggctccttacaccttgaagcataagttgtgggctattatttgtctattatgttgttgaaactactcagtccagccagaatgtttgccagagaaggaaagcaattagggaaacatcattggcttataggaaacacaaagttgcagtttctctctctacaaaaggtggcaaaacaacattactgttaaactgctcttaattttagtaagtacccctgtgtttttaagaaaagtatttttatcaaagtaagtcttatatgtattggttctatacttgcacatgttatcattaaaaatttttttttgttgttaaataggttttcgtggtgacatgggagatccgggttttggaggtgaaaaggggtcctcccctgttgggcccccaggccctcccggctcaccaggagtgaatggtcagaaaggaatcccgggagaccctgcatttggtcacctgggacccccgggaaagaggggtctttcaggagtgccagggataaaaggacccagaggtgatccgggatgtccaggggctgaaggtatgagggctttgctgtccttttggtgcatagagctggctcagttttggaacaggtcactgaagaacgtttagattattttgctttaggcatgtagaatataaacagtttacccaagtgttttccctcatttggggtgctggttacatttcaaataacctgaatctctagccttgcctttgcactttattgattgttttcaaatgcagggcagctcactgtggttcattcaactcaatttgattccgcagctagtatgttggtgctgcaaaggccaagagcagggactgtgtaacctgtctggggctgttgccaggtggaaggtaggcaggcctgattgtgagaggaagagtggcttagaggctggagctgtgagctggcatctgggaacactctatgggagagccgggtatgagctgagcctagaggacaagctgtcttcgcacaagagacagggtagagggaccttcattccatttggggtggcaggagggcatcaaacgcaagagaggaagatggcctggacactgattcatatccttttctgaaatcagtaaggatccttcaggatccccagtggagtttttcaggttttaatgtacttaaaaataaccaagtgggggtggggcagctcattaaaattattgtcttcaggaccccagtctgaggaattctgattcattatttctggggtggggccccacattctgaacttcagtgggcctcttgggtgatggtgatcaagatgtgaaccacagatcagatgtttacaaagaacattctggttcttttctaaaagtcggtgggccagtgtttattaggcatccactagagtacattagcacaggacacgtggaggagaggaggagaattagcaccctcaaggagcttgcatggaagtttgtaaataaaaagattcatattgaaagaaacaattaattggaaagtaacaggtgaaacataatgtaagtcaataaaaataatgacccagtaatccgactatctcacttgtgaaaatatatctaagggaagtgttcaatggaagaaggttatagatatgaaaatgcccttgtagtattatccacagcagaggaataattggaaagaacaaagacagacacacacacacacatacacacacactctatctctcaaaggaataccatccagccattagcaatttaaatcatatttgtaaagactgcaacaaactggaaaacatttgcagattaatatgcaatctgaagcgctccaacaactgaatttgcactgattactatttttaaatgtaaacatatgaaccaaaatgtaaagaaaacataggaaaacaaagtagatttttgggttagggtgtggaattatgggggatgttctttcctgaagattatgaccctgtctttctagtgagtagaaatttgagaatacaagtgatgaaatctctcataaaatgcaaattcatacagtgcaaactgggtttgtaaatattgtagagatttgatgtaaagcctgatgcaaagttagaggttaattaaaattaggaagaaccaagtggtttcttatttgcataggcaactgcagtccacataaccttatcaagtaactcacttagcaatgcgttgtttctctgttcataaggaactcattacatctatgataagaaaatccactcaaagacttaacccatttgaacactgattcaggatgaaaatgttcacctccagtattgatatgcgtgaacaattcatcatgggccatctgtatagttttttgtcatgaatgtcatggatgtattgtatcatttcagggccagctggcattcctggattcctaggtctcaaaggtcccaaaggcagagagggacatgctgggtttccaggtgtcccaggtccacctggccattcctgtgaaagaggtgctccagggataccagggcaaccgggactccctgggtatccaggtagcccaggtaagtgtcaagaactgtgaagggtctggggcttaccctacttacaattaaataagctccccttttactcttttatggatgctgccagaagcaagagtcctgagtcagagacaaaggacttcgttactcatgagtttcatgttggtttgcatcacttcccccatgtcacccaagtcttatggggcaatgtagtgggctagttggccacacacacagtgggttgcattacatgagaggagccctgagccaaggaaccactgctttatagcaacctgtgagaaagcctgcttttcctattgaggaaagtgctatatcatttatcaagggtgcttgctgcaaacacaagcttgagaagtttcccaggtaaagagcattaggatcttgcattcttggcatacccaggaagacgtaggaacacaagagacccctggagtgtctcctaatacaaggtgcagggaggctgccttagtccattcgcactgctctaccaaataccttaaactaggcaatttataaacaacagaaatttatttcttatggctcaggaggctgggaagtccaagatcaagctgccagcagatttggtgtgccttccttgtgtcctcacaggcagatggggcaaacagctcttttgcacctctttaataaggtcaccaatcttattcatgagggctctgcccttatgacttaatcacctccccaagtgttcaccttttaatactatcacattggtgattaactttcaacatatgaattttggagggacacattcagaacatagcaggggctattttcaatatgatcttcatttcactattcacattgtttactctgtcatttaaatcccattgcttttatccaaatgcagtaatatacgcacttgaaaaattaaaaccagattgaggcaaaactttccgctacagccatatttctagcaccaataatgttagacaccggctctgacttcttctcggctgtagagcttcaggaaaaacctggaaagttttcttctattagtttccctccaccaagaggaaatacaaatacatgtttgttttttctttttgttttctgttaaaaatattttttataatctacattcatccctactgggaaacatttactcaaatgatctgcccttctatttatggcatctagaaaaatatattcttagattgatggaaagttgctactgttattttagccaacaaatattgctttactgttgtttaacgcattgtttaagctactgtatatttttcctgctgtgtgtgaagccagtgttcagccttcacacactgtggtcactgtggtttgtcttaggtgctccaggtgggaaaggacagccgggagatgtggggcctcccgggccagctggaatgaaaggcctccccggactcccaggacggcctggggcacatggtcccccaggcctcccaggaatcccaggtccctttggagatgatgggctacctggtcctccaggtccaaagggtaggtagtgctttttccatgatgtcctcccatcttagaaacatgaaatccactgccaagtgaagactggacagatgaccacacaaaaagagttaactgttagtctggctttgtccttcccttaatgatgcctcccttgctcttgtcctctgtatcgttatttccagtggcgaaatgtttctgtaccggtcaatgggaaaaggggtttgtaggtgttagggccacagaattcatgaagactgggtagcacggtaaactcctagggtcgggaagggtgcattttcattttggagggggtccccactctcatccctaccccctgttaggggattaggactcagacacatcagggcccacacttcaggtctgtaggtaggaaactgaggatggggcggcagagcatggaatttttattttatttttttattttattattattattttttttaggagacagaggcttgctctgtagcccaggctagagggcagtggcaggatcatagctcactgcagccttgaactcctgggctcaagtgatcctcctacctcagcctcctgagaggcatgtgccaccacgcctaattttttttttttttaggagacaggatctcgctattttagccaggctgatcttgaaatcctggcctcaaagatcctcctgccttggtctccctagtgccaggattgcaggtctgagtcaccgtgcccaactgagcccagctactaagtgcagtgaggttggcaattgtttactttgaatacaaactcagcgttaggcaggagtttgcatctgtagatgaactacgaggaacacaatatataagaatcatactagcctgtaaaatgttttcctagggccaggcacagtggctcacacctataatcccagcactttgggaggctgaggcgggtggatcacttgaggctaggagtttgagaccagcctggccaacatggtgaaactccgtctctactaaaaatacaaaaattagccaagggcggtggctcccgcctgtaatcccagctactcgggaggctgaggaaggagaattgcttgaacttgggaggcagaggttgcaatgagccgagatcgtgccactgcacttcagcctgggtgacagagtgagactctgtccacctcccacccctgaaaaaataaataacaaataaaatattttcctaaaactttatgctctcatttcaccaggaccccgggggctgcctggtttcccaggttttcccggagaaagaggaaagcctggtgcagagggatgtcctggcgcaaagggagaacctggagagaagggcatgtctggccttcctggagaccggggactgagaggggccaaaggtaaataaaatacagccatgcaacatgcatttgtttctggtatttgatccaaacctagaaatgtgatctctgaaaaataaaataggacttgtctgaagcttggattcctcctccttttagttctatggtatttgttttagaattttaaacaaaattcattttctttacctcttaatcttattacatatagatggcaaatgaattgctctattaattgaaaaagaattaacaagtggttcttaatgcactgatttatagcttctaggtttcaaagaactttctcaccttttgggaaagggggctcttgttctccaacctctgtttcagttagaacagaagttggtaagctcttcctgtaaaaagcctgataataacaatttcaggctttgcagaccatctggtctctgtcacaacgactcaagtctgcttttgtagcatgaaagcagacatagacaacacagaaacaaacataaaatacaattttcagtaagatggtatttatggatactaaggtttgaatttcatataattttcacaccatgaaatattaccttgtttttgagttttacccctcaaccatttcacagtgtaaaaatcattcgcatctcatgtgctgtacagaaactggcagcaggaaggatttggcccatgggctgcagtttgccaacttctcaactaccatgagtccactttcatctgggccacgagtagagtttccccaagcttcatttgaaaaaaaaagttttctggccaggtgtggtggctcacgcctgtaatcccagcactttgggaggccgagacgggcagatcatgaggtcaggagatcgagaccatcctggtaacacggcgaaaccctgtctctactaaaactacaaaaaattagccaggtgtggtggtgggcacctgtagtcccagctactcgggaggctgaggcaggagaatggtgtgaacctgggaggtggagcttgcagtgagcagagatcatgccactgcactccagcctgggtgacagagtgagattctgtctccaaaaaaaaaaaaaaaaaaaaagaaaaagaaaaaaatgttttctttactatgaaaaataagttttgagaccaatggtttaaatattatgtccccatccctgttaaatatttactcctactccttagtcctgtggctctaatgggtgaaggtagtatttcctttccagtgttgagaaaaaatgcttgacaattttcagacccaaggatttttgcccttaaggccttttgggcaagtagcctcatattgaattaaaattaccttttcttcttagttgattgattctaccacaattttttgttttactagcttgtaaattatttatgtggaatcaaagaatcaaagagtcactctttgctagcttagataagtgatgtttgctgtgctattatgctactatacaattatcccactaaaaattaaaatttggactaacgccagtgatgggctagtaaactagttctttgaaattaaaaaaaaaaagcaccgtggtttatagtgtttgctgagtgtcatggcataaatactcctgccacggctgatttaaagttagcaatggtttaacaactggcttgcagggttcttgaattgtggtaactggcactcgtcaagctggtaggagcccacgcctgcacattgctacagctggccagtgtttgcaaaatcaggcagaagtacggtatgcccttcctacctttcagaagtcagtgtgaggggtaccacattgagataagtgtctgttcttttaatataaggaaagtaagagaggatggctaggaggagatatggaactggaaatatgagatgggcaaatccaaattttatagaacaaagcgacatttttttagactggaacttttcaaatctgtcttaacctcagtgaagaccccgaccagtttggttgaatttggcaaacattcagtgagcactcctggcacaccagactctgtggctggacaaatggggtcaggaacgtaaaagatgactgaccttcctttaggaaatcagccaacaatggtgacattttgtgatctacataaatagagcttcgtaggttaagtgggaatttgcgatttgggagtgaaatgtagtaatggataaattatgtgtgtgatgttcctgttcattttgttcttgcataattaatatccataggagccataggacctcccggagatgaaggagaaatggctatcatttcacaaaagggaacacctggggaacctggacctcctggagatgatggattcccaggagaaagaggtaaacacttaagagtttttaaccatatcaaataagttgacatttttacagatcacatttgttaggcaactttccccaataacactgagattagaaaagacttttttttttttgagatggagttttgctcttgtcgcccaggctggagtgcagtggcaccatctcagctcactgcaacctctgcctcccgggttcaagcgattctcctgcctcagcctcccgagtagctggaattacaggcgcatgccaccacgcctggctaatttttgtatttttagtaaagatgggggtttcaccatgttggccaggctggtctcaaactcctgacctcaggtgatccacccgcctcggcctcccaaaatgctggattacaggcgtgaaccactgtgagaaaaggccattttttttagatataaataaacacaaataaaccttgtggtacattttttgcttctccatgctaaaatttagctgaagttcctgtgtactcctagatttggatattctaaactgggatcaacctgagctatacataaaatactggtttcaggtttggtagttggttttaaagtgaatagcgcaatgactgttcaagtcattgtgaccagtgcctctcaaacttcagagcacattaatcacctggagagcttgttaaaatgcagattctgattcagcagctctggggcagccaggtatcctgcctttctaacagacaccccaatgcccatgctaatggtccacagaaacattgcagagcgaggatttttgacaaccccatttgtgtgctcctccaaggtcagacttagtctgcatgaggtgctcatcttggcttctctcagctagttgttagagggcaaatattttaacttttctgggtaagtgcttcttcatttgtaaaataagcagcggaggcaaataatcctgtgtgctccttcccacctctgatagtccttagatattcccaggcagcttctttcatcaatgaggtcactgaagccagaaatgatcaggaagcggcttgggacagcaatcagaatcctcaatacctttggctttatctcctaaaagtaggaccaggtccctcagcttaactattacctagctcaaaatttcagcagagacctgtaacacttccaacttcatcaggtgataaaggaactcccgggatgcaagggagaagaggagagccgggaagatacggaccacctggatttcacagaggggaacctggtgagaaaggtcagccagggcctcctggacccccaggccctccaggctcaactggtctaagagggttcattggttttccaggacttccaggtgaccaggtaaggggctactgctttgtgggggaagagacaataaaacctttctgttcttaggatgtccgtaaggagctataatttgccagcgtatataccattgccctttcactggcttttagaatgtaaggtgtagctcaaggagaaaatagagccttctagaaggccacgatgaaactgacatttctgaccagtgctcctgcctggttcccctaacatagagtcatataatcgctatctcccagcctggtttaaaccacccatgaagacttgcctcatgaccactggtttactggaatgaaagtcgtcctgaaaaatcacccaaatcctgtctttaaagtcttccagtttcagatatcacagattttgctttcaatatatttcgtcttcacaaccatgagtaaaataccctttcagaatccaggaggtacaatacatgtagttgccaacattatacttctggaaaacacgtaactcactatccatcttttggaatgaaatggatttgtaaagtctttcatatgctgtgatttataatactattttatttagtatcaacttgtttatttgtaatttaaaattcaaattagtaacacaattactgtttcacaaccaagtgtagagaatgggatgctaccagttgcgactgagaactctaattctggagaagctatatcaactttgaaaaactagatacatgtagtgggaggcttgcatgcatttaaactttcgttaccactgcagattacaaaaaccaaattagttacagaaaattacaactggatcgtgttgtgcatgtgccatttgtatttgaaatctgattaaggccttttgtttcattaaactgtcagggtgagccaggttctccaggtccccctggattttcaggaattgatggagcaagaggacctaaaggtatggtttggagatacagaagccatctgtcaaatgcatagtcccgaatgtttataacattgtaaacaagtgccttttacatgataagcaaagtgtatcaaagaaactgcaacacccaaggggctcttgttagacagtcaaacactcaagatccaaatattctacagttgtcactcagatccaagggtatcagatagaaaacagcatgcctgcaggctcttcgtgtcttcctcctctgtgagagtcccagcagcagtccatggagtgactgcagcccctcaagtaacagctcagttgcaaggagaacagatccatgtcagtgggccgtgcccactttggcttagaaaccctatgtcccgcaggagccagtatcttttctaaggacttcataagtacagcttttagagtcccagttaggacatagaggctaaagccatgactttccagcaggtgctaagagttcacttaagaagtcccaagatagatgtaatttacaattgggttttttattattattattatttttttactatagcaaaatatttttttcctaaagggccagatcataacaattttcagcttgttgggccatatggtctcagtcacaactattcaactgtgttgttatagtgtgaaagcagccataggctatatgtaaacaaaggagtgtggctgttttccaatagaactttatttgcaaaattggctgcaggctagatttggccccacgggccttagtttaccttgtgtcaaaaacagtgctgcattgtaacacacctaacattctagtgaaagagaggcttcattaaccctttattcagacaaacaagtaaacaaacaaagagcaggatatcttagttgcaatgtttgcataaaacctttaatagttttactatcttggtataccattgggttaatatttttctttaaatctactttaaaatgatttacctttttaaccttagccttagcgtaactagctgtaaattcacaggttaacatgcagttatcctttattttgatataagttaaaagaaatttaaaatataaaatactaattaatgaatgacctacaatcctctgccttactactttgagagacactctataaataatatactaaatgctataacaaacatgacctgtgtgggcttatttcttcagaaagaataatatagatcccttcttgggaaatggttacaaatggaaaaagttttatatttgattttgatattttataactttggggttcagaagtcactccttttctgcttacctatacatttattagtctctttaccattctttcacagtaaaaacctacctcttctcacttccttcatgcttgtattgggccatgcttaaaaggaattgaaatgcactcaaaatacctggagtcaaagatgtctcatggatcccacagataggagacatagttctgccaaagctaaaggaaccctagcccttagtcaatccatggtttctcactttttcccatggtctattttttcacttacctgtctaccaactggcttcatctctgtctacacagtatcttttctggatatttctggatatgttgggttgtactccaatatgttctacatcaggacagctcatgataatgcttttggtttctgccccagtagccaaggacttcaaattctcactttcttattccatcttctcaaggaaagacttgtttgacctggaatgggccagaatcccacccctcaagcaattggccattattatgagtaaaatcagataggagaaagacttccacaaggtgctggtggaactcctttagaaaggagtgtaaatgggcagttactataagatacatctaacttacctctgtaattctcttgaaaccccatctattttcttgcctttcctcccactccattttgagtcctccacttcaaactggctcccaaccataatgtaggtccttgtgtctggaagcattatggagtgaccagtagctttgtgggactgtgggagtcatggcctacagtggcttttgaatgtgccatctcttgtcatcaatgcagtatgcctttgtgattttctttttgcaaggacactgagttgagctgccttataaaagagcttgaaatatgattgcagcagtgaaaacagttacaatttttgattttggtttctaaaacataaggatatagccactcaatgccaaataatttcttaaatagaaacctaaagttgaaaattttttcaggacttaaaaactcaaacttatcaatacctggagatccttatgattgtgatgtattctaaaaccgtgtgtgtgtgtgtgtgtgtgtgtgtgtgtggtatgtaaattgcatcttgcatctatatttctatttgttcttatttagaataaaagtatttaaaaacactctcctaaaatatctgaagataagctatacaaataccataaacgttactgtcacctgtatgagaccaaattaaattgtctaaagtaatgtcacatgcattttatccctttcaggaaacaaaggtgaccctgccagtcactttggtccacctggtccaaagggtgagccaggtagccctggatgtccaggtatagctgcatatttttcttactaaaacaaaaaaagtagtttagtttgaaaagcagaacaattacttctagctggcaatgatcgtatcaatattttcttacccctttgtgcattaaggtatagataaaacgggttatatataaacacttccatagcatttcttgcctggcctagaagaacaccagggttacatactagggattcacaatcatttttccatcatggctcatgtgaccgatgatgttgacacaataataaactccccaggcatgcccatattttggcaaactcaaaaatgaatattgcaaacaattaaaatctggaccattttgcaccctctatcatttaaaatgatgcattcgcaataaccactcacaatgactacagctgcaggttgtcattccagctctttctttctactgagaaaagcacatgccagtgtaagtggtgcgccattgttgagccatcattgaatctattttaatttactaaaaatcaaaccaaatcaagcaaacataaacctcatcaccaacaagaaatctaagtcattttaaacagtattttgcttctcaataataatttaacatggaatccttcagaatggattgtgatgcaccattgagttcttgtgacagttgaggccacaactggctacattagatgacccacagcagaaggggggtgccagtgttatgcacagctccatgctttacagggaaagggaaaccatttgagttcaagccgacagaacaggacccctagaggggaaagcagccttaggacagaatgttctattggtttaactcatatatgtttacatttcagaaaatgttgcagatattaattggtactccctttctggaccctatagaaatgcaccaatatttaaaatatgcatatcgcttgacttaggaattctcttaggaatttatctggagtcagtaatcagacaagtgtacaaagatgcatgcccaggaatatgcgttgtttgaatggaacaaatgtccattcacagatgcctggttaaataagttatatcccagggcactcagccaatagtggtcaggttagaaaccaggtttgtgtttagatgggtaccttgtaaattaaaacacctcatatcaataattttgtgcattatcttaaaattccatctggcaatagctgtgtttcatttcatacaacagaaagaatattagatattttctgagcagaactatatgagaaattttattttctttgtttttatactgtaagattgctaaaatggaagtctaacaaaaacaagttaatacagtggcacaaactacctttcccaccttctttgctatgggtctttcacctctgacatgaacaaatatatttagatatatatatatgtacatatatatctaaatatatatatgtatatatgtttagatagtatatatgtatatatgtatacatatatacatatatactatctaaatatatctaaatatctaaatatatacatatacacatataaatatatacatatatacatatatacatatatacatatatacatatacatatacatacatatatatactatctaaatatatatacatatatatgtatatatatgtgtatatatatatgtgtatatatatatgtgtgtatatatatatatgtgtatatatatatatatgtgtatatatatatatatgtattttttttttttgagatggagtcttgctgtttcacccaggctggagtggagtggcacaatcttggctcactgcaacctccaccttctgggttcaagcaattctcccaccttagcctcccaagtagctgggactacaggtgtgcaccaccacaccagctgatttttgtatttttggtagagacagagttttgtcatgttggctaggctggtctcaaactcctggcctcaagtgatctgcctgccttggcttcccaaactgcttggattacaggtgtgaggcactgtgcccggcctagacatagtataatattttaactgaactgtataactgaagtatacatttgatagggaaaatagttttgaggtcagcattatgggagttcatgacaaatatcaaagtgagaagcctcagaagggaaaaatcggtggctcaaagtcaacctccattattacttcacctgtggtcttgggtaagctgagagtatcttctctgagcgtagttgcctcacctgtaaactggccctatgcatactgcaggattgtcctgaggatcaaatgaaagaaactgaaactgaaaataactatacaaaataaaatgcaatgatcatcattgtcatcatcaccatcatcagtcagcaaaacatgaagacattttcccatacttactggtatttttatgtaaaccccaaagataggaagatttcataagctcagggtagtccaaaatgggggcctgtgatgttacctagtattttaacttaaaaatcataaacctgagtgattttacacttaggctgactttttcagaaagtttgccttggccaaatttgcctgttctcctgtggttaccaccatttaaattggcccctttcccatatgccatggcctcagcttagaaattttaaattgtattatatgttattcactagcacagagtttacttaatacactatttccattgactggagaaggcttcattgaacttgaatgagcatcatgagaaggcatgaatctgcagctggtcttgggattatatgtgattatcctgggttcagtcctacctactctgcactctattcagagagaaaatatagtgcaaattaactcagaagttctgttcttaacacaaccccacaaaattcaggagacaagtttttatttttaatatttcagtgttttcatttgtagatgagaataatgctactttactgtaggaatgttttcaggataaataagataatacatagtgagactaatagatgttaaattcaatcagggaacaggtacagactaacaaaagcttgtttcctgtgtgctataataaatgatgactatagcccccccagcatggtttgtaaatacagagacatatattttatgtgcagattcaaccagtgattttcagcacacactattggtttatcccataaacgtgcattaaactcatacattgtaaataaacacacggggaaatagtcatcctctttagtaatcaaagaaatgtaatttcaagtgtctgaaatatcattttatctttaataaattagcaagaaaagaggccaaaaaactaaaatgtcctcagtaagaacacggcatgctcttggagctgtgggtgggttccatatggtggtgtgagtcagtgcagcacttactccaaactactggcaacctgtatcaagaaccaaatgttgaatggtctgttctagaaaactagagaagaactgaattgtgctctgcagcaagtcactgtcataagaaaaggactgctttaaatttttagaaattgaagagacctatccattagatgttatgggtgattctgggatggaacgtggtgtggagaaaccaactgtgaaggacattaaggggataattggggggattcaagtatgggatgagtgtttgagggtattaagaattgctattaattttcttggctgcgaaatgttattttggcaatgtagaaaaacgttcttatttttcagacttcttacctcctgaagtatttagggatggaattacactacggtgtgatgtactttaaaatacttcagcatttaaaatgcatttgaaaataccaaaatatcatgctatttatccagaaattctactcctaggaatttttcctaaggaaacaatttaataggagaaacaaaattgacaagagatataaagagcattatggataacggcagagttagagataacttaaatggccaatagtaaaataaattgaattagttaatttaattaagattgactcaaaaagctactggccattcatttaaaaatgataattaggaaaaccaatataaacttggaaaattacttatgatacaacactaattttaaaaaccagaatataaaattgtgggtattatctgtacatgtatgtacatatgaagaattgtgttaagctggtgggattatgggcattttgttatcagtttttccttaacgttattttcctttccaatagaaactatttaaaactaaaaaagtaaggatagaaaagaatagggtgggctgaacttggtgattttaaagattcactgtctcaaacggcaactctgatgtttgatctttccttctttagggcattttggagcatccggagagcagggcttgcctggtattcaagggcccagaggatcacctggaaggccagggccacctggctcctctggaccaccagggtgcccaggtaccttgaaaggaaatctggagacttcctgagcactcttgtgtctcagagtgtttcagaaaccaccagtctttaattagacctaaattcagatatggctctgccatttcccagacctgtgactttggataggtcacttaagctcacctatgcctcacctataagctagtgggtttcactgagtgacttggagtagattaagacagcacctgtaaagtgcctagcatggcaccagacacaaaggaatggtcagacagatagcaactcctttctttttagtttttattcttttagagagagagggcctcactctattaacaaggctggagtgtggtggcacaatcatagctcactgtagcctcaaactcccgacctcagggaggctgtctcagcctcccaaagtgccgggattacaggcatgagccactgtgtctggcccagatagcagctcctttctagccctttgcatttctcctgccattcaggatgctgttttgtttgtttgtttgtttgttttcccctcctttagacctaaggcagatgtcacacttacagcacagtgttttaatggatactattcctgccaattcagaaaaaaagagaaagtttcaaactatagttggcaacttcatttatttggaaatgtattttctcctcctgaatttaaatgtatttttctccctagagttaagatgtataggaagaaaaagtaattagacagtgttctccgttacccatatattaagaacatagatgacttttgcagtgaatgtaattcatttattatctggccatctgcaaaacttccctgtcatcctcaggtgatcacgggatgcctgggctgaggggacagccaggagaaatgggagaccctgggccaagaggcctccagggggatccagggataccaggtcctccgggaataaaaggtaagtcaaaatgaagcccatcccacaagaaagatgcagcccaatgagggcaaattgatggtgtttttttcctgtaccagtgagtgaccctgctcttggttataccactcttttccgtaggtgccattagcatcttcctactcttccttagccagggctgcaggtagtgcccatccagtcagctgacctgccttctaccagggagaatggtagtgctaccattttctttctttctttctttctttctttctttctttctttctttctttctttctttctttctttctttctttctttctctttctttctttctttctttctttctttctttctttctttcttcctttctttctttctttcccttccttccttccttccttccttccttccttccttccttccttccttccttccttccttccttcctcctcccttccttccttctctctctctctctctgtctttctttcttttttccttttctttccttttcttttttctttttttttgatggtgtcttgctctgtcacccaggctggagtacagtgacgcgttctcagctcactgcaacctccacctcccaggttcaagcaattctcctgcctcagcctcctaagtagctgggattacaggtgcacatcaccatgcctggctaatttttgtattttttagtggagacggggtttcaccatgttggccaggctggtctcaaactcctgacctcaaatgatccacccgcctcggcctcctgaagtgctaggatgtgagcgcccggttgctaccatcttatttctgaaggcatttagccaaatgatttttatgatgttcaggcccattattcatgtattcccttcacctatggttaagctcctactatcctagattctgtgctagatgctgggtgtacagttttgaagaaaatagacctgcttcctgccctcatggagctgacagtatggcaggagagaaagacattaataatatatgtggaaatgaatatatatttactgatcatgataagtggaagagaaaacaataaggtgctacagatatagaataattagtgttcatcatcttttttcgatcaagaataattttttctgggttgaatttcttggtctgtaaaggcaatagtggactggttataaaagtctggttataatataatataatacaatacaatataatataaaatacttgtcattaataaatctttatgccctcacattcatccatggtatcaacccctcttcagtccatttcttccactttagaaaaagtacttttttggccgggtggctcacacctgtaatcccagagttttgggaggctgacgtgggcggatcacttgaggtcagtagttcgagaccagcctggccaacatggtgaaacgccatctctactaaaaatataaaagttagctctgtggtggtgcatgcctgtaatcccatctactctggaggctgaggcaggagaattgcttgaacctggaaggtggaggttgcagtgagccaatatcgtgccactgcgctccagcctaggcaacagagtaagactccatctcaaaaaaaaaaaaaaagaaaaagtattttttctatgggtatttttgaacatatctttagcataacacttacgttgtatcacatttgtttggaggtttttctcatcaaacagagtatgattttttaaaaagcaaggacatttcatatacccttgagacccagtcaataacaagtatattggttggtggtatgaatgaatggacaaataggagaatgaatatctgagctagtagatatgaggttgcagtccttatctgaaccaacagctgatggttccagcttacttggtagagtcttgtaaccaggtttcctctatttcttcttcctttctccttccacctgcctttgctcattgactcatacgtatacgaaatcctggtaaaataaaaagtccctcctttcagaaggtactgagttggaaaccccttcttctgggattaatccttttactgttttgaaaattcaaatacgattttcccacactttgccctcttcactcattggatagctttgaaataattctaattttccagaagtggtagtgtggtaggtattacttggtgcaagtctgtggagacaggagccatttatgttgaagagttggtatactcatgtattttcacacaatcacataacttgataggaaaagttcccttcacaagacatctttgtactgttctccgtcttcattgacacttttagtaatatgaattccagcaattcatgataaatttaggatttcaggcaaatgatcattctgttattttgaaagtttctgtggtgattgtggccatttcctgtctctgaccatctctacagccttcatggcgtattctttgacacttttttgtgtccggaagacagttggtaaagaaccaaaagaaaacatttgtcatcattaaccactcccactttttcctaccctccacttcttcctaccctcccagtttagtaacacagcaaggatttttaagtgtcttggtggcttaaaaacatacacccaatttggtcaaaatggcagggctcatgccactgttgttgatctttctttcccttgaatttgtttgcatttatcacataacttcagtatggcatgctattacaaaactaatagctggccgacgtggtggctaatgcctgtaatcacagcactgtgggaggctgaggcaggcggatcagctgaggtcaggagttcgagaccagcctggccaacatatagcgaaaccccatctgtactaaaaaaatacaaaaattaggtgagcgtgatggcgggtgcctgtagtcccagctacttgggaagctgaggcagaagaattgctagaacccaggaggtggaggttgcagtgaactgagattgcaccactgaactccagcctgggtgacagagcaagactctgtctcaagcaaaacaaaacaaaacaaaactaatagctaataaatttgatccataacaaaatcaccccaaaattaatctccaatcacatcataattccgtgctatgaaatagtgtgttaaaaagagaaggtgaggaaatgaacatattacttggcatgttcataccacctacagacagatgttgcagtggtgctccatcaccatatagtgacactgtttcacttcaaacagctcagagaacaactggtctttaaaaaccacaacacaaaacaaaacagtgaaatacattctgaaaagttaaaacatctgcagtataaattcattgttgcagcttatcatgctgatataaaaatgaaccacactccagcagaaacactttgaactgagaaactaaatatttgcagtatgttctaactaagtcaaggggactgattatcttgtttgaacaaaccagctgctgaactcaaagctgtttgctctgctagaacaggccatatggattttgcatcctgcttgtgttcaatcagatttaaactttaacttaaacatatgctaaaaatggcttgattccagctaccattgactttcttcacataattacaaaaaactactttaaatttcaaatggaaccaaaaaagagcctgtatagccaagacaatcctaaacaaaaagaataaagccagaggcatcaggctacctgatttcaaactatagtacaaggctacagtaaccataacagcatggtactggtaccaaaacagatatcttgaccaatggaacaaaacagagacctcagaaataactccacacatctacaaacatctgatcttccacaaacctgacaaaaacaagcaatggggaaagggttccctatttaataaatggtgttggaaaaactggctagccatattcagaatactgaaaccggaccccttccttacaccttatacaaaaattaactcaagacggattaaacacttaaacataagacctaaaactgtaaaaaccctagaagaaaacctagacagtaccattcaggacataggcatgggcaaagacttcatgcctaaaacacctaaagcagtggcaacaaaaggcaaaattgacaaatgggatctaattaaactaaagagcttctgcacagcaaagaaactatcatcagagtgaacaggcaacctacagaatgggagaaaatttttgcaatctatccatctgacaatctacaaggaattcaaacaaatttacaagaaagaaacaaccccatcaaaaagtgggcgaaggatataaacagacacttctcaaaaagacatttatgcggccaacaaacatatgaaaataaaagctcatcatcagtggtcattagagaaatgcaaatcaaaaccacaatgagataccatctcattgccagttagaatggagatcattaaaaagtcaggaaacaacagttgctggagaggatgtggagaaataggaatgcttttacactgttggtgggagtgtaaattagttcaactgttgtggaagacagtgtggcgattcctcaaggatctagaaccagaaattccatttgacccagtgatcccattactgggtttatacccaaatgattgtaaatcattctgctataaagacctatgcaaatgtatgtttattgcagcactattcacaatagcaaagacttggaaccaacccaaatgcccatcaatgatagactggataaagaaaatgtggcacatgtacaccatggaatactatgcagccataaaaaaaggatgagtgcatgtcctttgcagggacatggatgaagctgaaaaccatcattctcagcaaactaacacaggaacagaaaaccaaacaccacatgttctcactcataagtgggagctaaacaatgagaacacatggacatagggagaggaatatcacacactggggcctgtcagtgggtgagaggctaggggagggatagcattaggagaaatacctaatacagatgtcgggttgatgggtgcagcaaaccaccatggcacatgtatacctatgtaaaaaacctgcacattctgtacatgtatcccagaacttaaagtgtcatcatcatcatcataaaatggcttgattcctagactttaagtacaaatgccctttaaaaggagaacacccagttcctagttggaaagtaatataagattgaaataatgaaaacctaaagaatattacctgtagcatgacaagaactggaaagaatatggattttgtatccatatttactggtagcaagtaaaatgtttcataagaaaaaagaatctggaaatggctttcctcagaaaagagatgccatgtcccttagagctatgaacatcatggaaatattctccccccgctttttttactagattactctcctcctgcccttcccccacagcacttaccacactggatgtaattgcctgtttgttctgtcaagtcagggacagacttgtcccgcatcgtcttgacagcacctgccaggaggtacatttggggcagactctgtgcattaggaaaccatatcttacacccttagtgggcactcacatatttgctgatacaaaaaatatttaaatcttatttcagaatctttgttaataagaatcttccaggtttttcaaccattacttatagtcacaaagatctctcttcccatcagctttgaagttagggtgagcagctgtcccgttttgcctgggcctgagtgggtatttcaggatgtagaaatttcagtgctaaaaccaggaagaagtcgcaggcaaacagggacacgttggtcaccctatgtgttaaaagtatgagcccatataaaagctcttgggtgtgtcgagtaatgttttcaggctttagaacaaaatacagcctgagagtgggaatgcagtcataaagagttcgctggctaacaaagatgggagccacaattccagctggattggaggttacattcactgactagagaaagagcacccagcctgaaagtgcagtgtgctgcagccttaaatgatggttgtttagcaggaggatgaccagagaggtgaataaaaattcctcattacccagaaatgtgctttgttagcctaattgcctctcatctgcactgtatatattttatgcatgaacaactttctgatttagagatgggattgataaaaagctttcagtaaaaaggaaaaattacccttacaaccctactcagatgtagctgcattcaatttagaacgataacattgggtcagataagggtcggccagttcaacaatggcgagaggctgggaccgtgacaacctaggatctggatgtgttgatgtgacaatggagagctggcagaagcagagacattccaccccagccaagtccccaagccatcaatcttggtgactaaagctggagatcaaaacatgtggaaatagtgaagtggtccccccgaaaatttatcatttcagatagattgcaataaatacccagatttggcagataaagaaggtctgtgtgttcttttggtgcaaacttgaaacgttggctcataaaataggaaagaggattggagaataaactaagccagaactgtaaaaagtggttaggaataagagatttggggaaaataaagatgcattcccattttttttttttttttggtgcacgagaatatggctcatttgaaccaatctaaatcctagatcttaaaagaataatgactgtctgtttcaagtactgatgataaatagaatggaagcaactaactgtgccagcttctaataagaatacacagaggacttgcttaaaatgaatagacaataattagcacttgaattatttatatgcaaactgatacctctaacttctgtaaattatatttgtcctataaatctattaaagaaagatatggcatacaaataaaaattctaccctgctcctttttgtagctttctccctcatccaccttgttccatattttttcattcagtcactcaacaaacatttattgaacacatccataggacctagtcttgaactcctatttacccttgagcaggggagacagtcacccaaagacatgattgtttcacagtgtggggtggacatcaacaatcaagggggtcctatatcatgggggtaggtgaggggcaccttctgtgttcaaccttataagctgatggtatttttatcccaaatttgagagatgtgaccctacactaagtaaacaggctggctgtgcaccgagaggctctatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggtggggggagggaggagggatagcattgggagatatacctaatgctagatgacgagttagtgggtgcagcacaccagcatggcacatgtatacatatgtaactaacctgcacattgtgcacatgtaccctaaaacttaaagtataataaataaattaattaattaattaattaaaaaaaaaaaagaacagctactgggtggaagatctactgatgagataggaagttttccaggcttgaccagaggctgggaagaagcttcagtgctcgtagccatcagtgggacaggacttgtgagaaggcacccagcagatggctcagtgccctggagatgctcgataaatattccttacctgctttcttccttgcctctcctcctccaactttaccaagggccatcaagaagtgtcatttgaaaaggctctcgttcagacaacttcaacacaactcaacatacgttgataaaaaaccttaaaaaaaattttccactggaagtgtttagtgacaacttcagtcaagccaggctggtggacggctctttggagaactaaacagaaggttctgagagaaggcacaggcatcagtggggtaatgtctgtttacacagacgggagttttcagtgatcatcgcaaaataaacttaggttctgcagaaaggcatcagaatggttgtgaaagaagtgactgcaaagcaatagctggagccacactcgccatgcaggcctgagcatcgcagggcaagcatttgccagcatgccacaggcgccatgcgtcctctcgtctgactgcatctccatgagtagatcctgaagaaaccaggagcctgcagcccctaggagggtgcagtgaccccaagcctgggaggtgtgaggcctggatttgctcccatccgatctctttcctcatgtagggtgattttattgtcataaaatcaaaggtcacttcctatgccaagattcagtaattctagaccatatctggtcacgataggatcagaaaccaacagcagtactttaaaaccaaagaaatgtttgtgttaagctgtcttggcagaaaatctttaccggatgaatgtgttaaatagtcctgggcctgggtttccaccctgatgatgaagtccagacgctcagagctgtttgctggccccagcaacgcgccctctgctgggcagtgcctgcgtttgtggctagagtgagtaccggtggctggtcttcctttgggtcacaggcctgtggtgtttttcaggtccctccggatcacctggcctgaacggcttgcatggattgaaaggtcagaaaggaactaaaggtgcttcaggtaagcacctaatcgattcgtaacagactgagcttcagtccatggttcatgagagaaagtggtaccctccctggtatttctgcacttcatgagatttggaggcaaaactgaaaaaaactggcttaggttagagacacactattggagctatttttagtgctgaaaatgacatatgaaaaggacatttgagaaaaccctatttaagaaggaatggttggttaacagtgtcttttgttggtattgcttggaattttctgtccactaaaagtactctgaacaattgagccagatttcaaaatgttatcctaacaagtaaatagctggggattttagaatttttgtattaagtatagtaatgctatgtttgaccacatgggtcaaattagtactaatagcatccttttatggccactgctaaaacaaattacctacacaatttgctgttattttcataccgcaaacaggttaatctttgacaagtgtatcttgttctgttagtataatgcacatttgttgcgttactttctcagaaaaaccgcttatgatcagacaaagtagctgaaacctaacatgcaaatttgagtgaccctggggaagaggaattgtgctgctaggtttgaatttattgttggagagaggtgaaatctttctagtttggaagatccagtaatatagtcacttaagattcatttagtagatcctccaaatagattaaatgtgtgtgccttccaagaaaacactgatgtccttccttcccagtgtgaaattccacaatagttctaatcatgccagtttccacctcaaatttcaaagcaacttatgcataattacttattgtatctcatttgtttttactctctccattgtagaggtgggaggttggtattgcctctaagttgttgttttttaaaatctggaaaataactataaaagaaataaaacttatggctgaccagtgtgataggtcctaagagagaaatggtgcagacatttggatcaccactgcaaccagttgttggtgtctgcagaaccagccactcctctgccgctattgggaagtggttccttttcaggcactataacagggacaagaaaagagaagatatagtattaattctgttttccccattaaggtttgcatgatgtggggccacctggtccagtgggaatacctgggctaaaaggggagagaggagaccctgggagcccaggaatctctcctccaggtcctcgtggaaagaaaggtcccccaggacccccaggtaagctgtagcatgctttgcccttctttcaataactaaaccaaaaccttccaaatgcaatgaggataacatgtgaacatgtctcttcttagggagttcaggaccacctggtcctgcaggtgccacaggaagagctcctaaggacattcctgacccgggtccacctggagatcagggacctcctggtcctgatggcccaagaggtatgagagaatcatgacaaaggatggcagtgctccctttgttagatgctgccagctctggaggaatgtgggaccagagagtggcagaatagaagcactgaagcagccccccatcagcttggcaggtcgataagtgggacacagttagggtgggactttgggtagtggtgggctctcaggaccatatccaggaccaggacttggccctctcttcaatttcagctctgttagaccctcgtctcttcaggctagaaactgataagcaagcgtttcttatcaccagcttgatgctgaccaaatgtcttcagaagtgggtggcaagtgggaatcgcaccctccttgttggtctctagcaactgtcacataaaccactggcactagcccagagtgacaggatgcaggcttgtggcacacaagaaacagtctcttcatgtgctgctgacagtacatgttgtttctttcatcacttcacagggacaaactttggtaaggaaagatgttggaagtcattactaagctgaccaagtaggtttaggctagagctgggttgggagttgggagaagagtgtggctccgtgtgatatcttgctaaatgcaggcaattgcattcatacaagctcttagaactcttccataaagacacatgcccatcatctttgaatctttaggattttagggatcatacactgaaaataataaagctctcaaaagtgcgctaagaagtacagaagctaagtaggaatataattggggtcaatttattcctatttgtgggaacttgttttccattaggattataaatttaatcgagtgaacattcctttcccaccagacatatttcctcaaatgcctgtctatctgtccatcagtctatccatccatccatccatccatccatccatctgtccatccaaccatctatccacatatccatccatccatccatcttatctatccatccaaccgtctatccacctatccatccatccatccatccatccatccatccatccatccatccatccatcttattaaagcagtaagatggcaatgcaaacaaaaacccaaaatgatattttcaacaggaatgactttgaagggaaggaaggttttgcttgggttcattttgtctaacagttaccaacccattatctacaccatttctcaacttggtattatgattcattctatttcatttctgttatcattgactttcttattcttctaattctctttattccttgcttgcaagtcattgaattgtttttcttcggaagctgtcaagcagccagtatacacattcgtctttgactaaaagaatatttttgtctcttctctgtggtcaggagcacctgggcctccaggcctccctgggagtgttgaccttctgagaggggagccaggtgactgtggtctaccagggccaccaggtccccctggcccaccaggccctccaggatacaaaggctttccaggatgtgatggaaaagatggccagaaaggtatgaatgttgttccgttaagtaatatgtgaataacttggttatcttacccttgagggtctggggtactgtgccgccatttctatttcctatgcaaacaaagtgactaccttccaaaatgtccttatttccccaaagagtcctgaagtttgggtcaaagttggacaagtaaaaggaagaaacacaagttcatctttagcccctaataatactcttgataatcttccaggccagaattgaacagtagaaatgtaatgcaagccacatgtgcaatttaaaaatatagtagacacattttagcaagtaaaaacaagtgaactttcatactttatgtgatttaacataatatatttaaatatttttattttaacatatagttaatatacatttatcaatgagataattgagctgattgtgcaaacctaattccttttgcaaataagccactccttcttcctgcttttgaaatcccttgtgtgttccacactgacagcacagctcaggttggactggccacatttcaagtgctaactagccatgtatggttagtagcttctgtattggacagcttagttttagactgctgactttgcttttttatattcctgcaaagatcccgaatcactgaatttccccagtatttgaggttaaaatatttattttaatcaatttttatccaactgctaatatttggggagatcagtttttggtcaccagaatttcagagaatttttaggttcaaagaagctttttgttgaaaaaagatgactaatgagtatccattttaacttccctatttcataaataaggaagctggatatcagaaaagcaacagttgaaatttgcaaaaagagcccagtaacgagcaccttgcctgagttctgaaccaagtgtgaaataaggcaaaagattaggtcacagataaaaatcactgtgaggccgccatgactatagtgcaaatggcatctgtggaattgtgcagtgcacagcctgtagaacagtatggagcaagcctgttcatctgtattagcaatgaaatcaattttagagaatgtggctcaaatctatgggtaagtaggcttccaatgattgaacttcagaattggactgacgtgctaacactctagtcaccaagaggaaggaggaaggggctggctaacactcctcctccttagttactctagggaataaatctctacctggacatgaagttcaggactgaggaaataaaacaccatatgaataccagtgatctacataaggatacacagggagttagaaatattggtggaaccgctaatcatgcttcttgactcccagtccagagaatataaaggccaaacagtgcttcactataaagagagtgagtttcctcagttaccttttatgacttacacagtgacaaatatctcttaggcacctgcaggaatatagcagtgaacaaatttaagtagagtttctaatctcataaggacagagtttccgcttgactcagtggttcatgcctataatcccaacactttgggaggccaaggcgtgaggatccctggaggccagtatagttcaagaccagcctgggcaacacagtgagacccccatctctacaaaaaaattaaaaaattatctgggcatggtggtgtgtgcctgtagtcccagctactcgggaggctgaggtgagaggatcgctggaacccaagagttggaggctgcagtgagcaatgattgtgccactacactccagcctgggtaatggagcaaataataataataataataataataataataataataataaatttcttttataaagagcatagtttcatggaagacagacatgcacatgaaaggatatgtcagtttaaatccagttaagtgtcctgaatgaagagcttatcaaaaagcaactaaacttcagttgggattccagggaaggcttccctgagaaaatgaaactgggtcttatctctaaaaaatgaggaagacatcatggatgtggaagaagtaaaggaacatcacgtatgaggaactgaactgttgtgcctaaaactaagagagtgaggaggagagtggttgaactcgcctggggaggcacgttgttcccggatattgaaagctctttcctgatttttccttcagttccagtcctttgtctccagaggaagtttagggttataggacttcttttcattgtaatttggtcttgtcttgatcatggagccatttccttagttctttcggccgatcatgtgtttccttcagaggcaacccgtctaagcctcacagaagaaggcgaggctaatcttgactctcaggctagctatgccctgcattttgttggagtgaatctctgaattcagtctatcaaactgtcattgtttttatcttgtctcattccagtgccctcatttttatgttttgtttttttttaaggaccagtgggattcccgggaccgcagggaccacatggatttcctgggccacctggagagaagggtttacctggacctccagggagaaaagggcccactggtcttccgggtgagcttccaacctacatacagcattttgtttaaacatttactaaaatgatcatcgttcagaaagtagttaatattctgaattactagcacattcttattatttaagcccttttcttatattaagagtatatttctttcaggccgcactacaaagtctcatgtttggtaaagtaataatttattgtcaaaatgaaaaagtttgaaaattaggagttgatttttttttactttattttttaatttttttctatatatatatattttttattatactttaagttctagtgtacatgtgcacaacgtgcaggtttgttacatatgtatacatgtgccatgttggtgtgctgcacccattaactcgtcatttacattaggtatatctcctaatgctatccctcccccctcccccctcctcccactccacaacaggccccagtgtgtgatgttccccttcttgtgtccaagtgttctcattgttcagttcccacctatgagtgagaacatgcggtgtttggttttttgtccttgtgatagtttgctgagaatgatggtttccagcttcatccatgtccctacaaaggacatgaactcaaaaaaaaaaaaggagttcattttatatacacatttttttttctattttttttttttttgagacagtcttgctctgtcatccaggctggagtgcagtggtgtgatctcagctcactgcagcctccgcctcctgggttcaagtgatccacctgactcaaactcaagtatctaggattataggcgtgtgccactgcgcctagctaatttttgtattttaatagagacagagtttcaccatgttggcaaggctggtctcaaactcctgacctcaggtgatcagcccacctcagcctcccaaagtgctgggattacaggcatgagccactgtgcttggcccacatagactgtttctaagggaaataaatatgtgttccttcatgcaagaggcaaagactgatttgattattatttgttaggatcgtatattcaattccgatccctgaattttcattgattttcctagatgttttatttaattttttttctgtaaattccattcgttcctaggaagggagaaagctattcagtttaactctataggcaacactttttaaccatagggtcaaattacgacaaggaagagttggggagagaaggggcaaacagacatgtgtatttgagatgggcagaagtaatatctttcaagatcctaaatcaatattacggtaatgtggcgtcagttcagaatatttcgcagtatcctaaattagcactctagtccaaagaataaataaatagcactgctttatgatgtatcataggacaggaggaacaagggcttatatgttgattctttttttttttttttttgagacggagtctcgctttgtcacccaggctggagtgcagtggtgcgatctcggctcactgcaagctccacctcccgggttcacgcccgttctcctgcctcagcctccggagtagctgggactacaggcgcccgccacctcacgcagctaatttttttgtatttttagtagagacggggtttcaccgtgttagccaggatggtctcgatctcctgacctcgtgatccacccgccttggcctcccaaagtgctgggattacaggtgtgagccactgagcctggcctatatgttgtttcttttcatatttcctttctatgcataccctatacttggcaaattaatatgaaattttcagaagcttttaaatggatagaattcctacatgcattaaattagaggatatttgccagaagaaatcaactagaattttatattgctcaagagagtttcaagtcattctagagatgaaaactccgttactaaatcatagctgctcctgtcagtcacattgatgtggacattttatgtaaataaggtgctgccattctgcttgtcattgatgctgcctcaaattattatgtatgttcttaatctatttcatttttgtcctaatccacaaatttaaaatctctttccaccctgtgaaaatcatggactggcctcgtttgttgtctttggatccctctaggtcccagaggtaagctttgctataaaattggtaatttcccctcactctggtttctagtcatttctgtacttgtcctttttcctctgtatgtgtgagctaaactttgttacatttttatagatggggtgctgtaaggatattaagctgcagtgttttgcttcctcgttacagatatagtaacctcatattagagcatcctaacattcagcctcattataggttgtcaaggcagtgtagagcctttgcttatatagtttcaatttgggcatgaagtatgtgggctttctctgtcaaaggctatatagtacataaccaatgtaagttccttttttaaattctacaatataaatacctagagcatccctaaaataaatggtatatacaacattaaaaaatggggcctcacctcccagtaaggggctgtgacaagcctttcctatcacaccctcaagtccattttcaaggagcacatttctttgtgtgttaaaaggaaaatgttcacttaatgctctgcagtgcaaaaacaatgtgttattttgtgcctggcattttcaaagaaaatcaaaagcatttctcagaagagaaaaagaaaaattgtgaatgcctgcatttgttctttccaggcctctgttattagtcctaatgaaaattgctgtgaatatagacaccatgtattatttttaaggtctttagaagacaggcctcagctccccctttttatttttcagtttctgacttattaaaaagtaaagaaaagcaaaatcaaaaatgtaaaaagtcctggtattttcaatgtttatatttaaaaattaaactgtatttgatgttttcatttcaatcctgtctctctgtgattgtatgtataaagtcatttcaagagagcatcaaaattctaaataggaagcaccaaacacatgctcccactttctgaactccgttcccactgggaagggccagacattactcatggaaaatagaagatgcctctatgcatctctctcaagtcacccatagtagaaaagccaagttttacattaaactgtacttattataaaaatacatttggccctgtgtggcttgtggttttataccatattttacacagagttaaattccaaatagctcataagaattccaggtcattttacacaggcccagtaagtattaggagactaaaactttgttgttatgccacattttgttaaggattttcttagtgctttatgattgatgttcctgaaattatttcacacttttgcatacatttgaagaacaccatagctaatcagatgatatcttttatttttatttaatttttttggagacagagtcttgctctgctgcccaggctggcgattccaccactgcactcccaggttcaagcagttttcctacctcagcctcccaggtagctgggattacaggcatgtgccaccacacctggctaatttcttgtaattttagtagagatggggcttcgccctgttgcccaggctggtcttgaactcccaaactcaggcagtccacccgcctcggcctcccaaagtgctgggattacaggcgtgaaacaccatgcccggccagatgataccttttaaaatatgtttcatttcttagaatttgttacccagatattgagagttcctgatgcagtctgatgaggtggttaagaacatgggtttggagccagaatgccctggattgcaatccagactctgctgtgtgtaagctgtgtcaccacagaagtgtcacttatttgcctgagcctgagtggttttttttgtttgttttttgttttttttttttgagacagagtcttgctctgtcaccaggctggagtttaatggtgtgatcttggctcactgcaatctccgcctcccgggttcaagcgattctcctccctcagcctcctgagtagctgggactgtgcaccaccacacccggctaatttttgtatttttagtagagacagggtttcaccatgttggctaggatggtctcaatctcttgacctcgtgatctgtccatcttggcctcccaaagtgctggaattacaggcatgagccaccgcgcctggcgaagcctgagtgttcttgttcatacccttctcataacagtagcacatacacagtcttctcgggaggatttaatagtaaaagcattcagcacagggcctgatacatgataaagcattcagtgagccttagctgttgtcattattgttcagtgttattatttcttatccctctgtgatgtttgcaggatgactgaatgaagctttagaaaagatgtcttaatgatgtgaaagtaaaagaaaaaaatctcacatctttagtatagtggttttcttttttcttttttttttttttgagatggaatcttgctctgtcacccaggctggagtgcagtggcacgatctcagctcatgcaacctctgtctcctgggttccagggattctcctgcctcagcctcctgagtagctggaactacaggcacttgccactacacccagctatttttttttttttttaagtagagatggggtttcaccatgttggccaggctggtctcaaactcctgatctcaagtgatccacccgcctcggcttcccaaagtgctgggattacaggtgtgagccaccgtgcccagcctgtgtttttcaaagtgagattcccagatcaacgccatcagcctccctgggaacatgttagagatgtacatggccccctcttcagaccttctgactcaggaactctggtttctaacaaactagcgacacaattctgatgtgctacagtcagaattatagctttccaactgtgctttcagccctaatggacactggaatcatcgtgggagttaaacaaacaaacaaaccaaaaactactgacacccgggtcccacccccagaaattcctatttaattagtctagatggggccccagtattcatgagtacttttgaaaagctcaccagctgagtttattatgcagccaatgatgaggacactgctcaggccacatcctattatcaagtaaatcagtatttctgggagtgggacccaggcatcagtatatttccatgactcccctggataagtccaatgttcactcaaggttgaaagtcactgcttctgagcctctagcaatcctgaaattctatgttagtgactgacactatggaaacccacgtggctgcagtgtagagtaaggactcagggacacatgaagctgagctttaggaacccaccagtccctcttgcaatgctacctgtggctgctactccagtaaaaaatggcccagagattgggcaatcctgtgagggtcatcacgttgctgcatcatccgaccttcactgtttcatacttctgcatcctctgatactccattcactcattcggtcagcccgacattctggaattttttcatgtaccctccagggcataagacaaatttctgccttcatggaacttacattggattgttgaatctttacaaacatttatactgaattttatactgaatttgtactaaatttcagtatagtgtcagaagtccaactttaaccagagactgtagaaggagcttgttcataagcacgtgcatccattacacaagcggtgattccaatttcaggtgaaccggggccacctgcagatgtggatgactgtccccgaatcccaggccttcctggggcgccaggcatgagaggaccagaaggagccatggggctccctggaatgagaggcccctcaggaccaggtatgagccgcatgctgattgttcattattttcatgatatattgctgaaatgaaattctagatcttttattttgtagctttttatatggagcctaaactactgaggagaaagcatgtctttccctttgcaatttgtttctaccttgatccaaagtacatcaatcatgggctaactggatccacacatcccttctattattttattttattttattttatttttgagatggagtcttgctctgttgcccaggctggagtgcagtggcaccatcttggctcactgcaagctccgcctcccaggttcacgccattctcctgcctcagcctcccgagtagctgggactacaggcgcccaccaccacgctcagctaattttttgtatttttagtggagatggggtttcaccgagttagccaggatggtctccatctcctgacctcgtgatccgcctgcctcagcctcccaaagtgctgggattacaggcatgagccactgcacctggcccatcctttctatttttatgtggaactcctacttaaatctttcattcttggccagcttttggatgtagagttttcaaacctcttagcacaacatggtagatgctccatgaacagtcattaatagctgcctacttgattttgagttaaaaacaattgaattggggcttggtggagcggaaacagagcctgcaagaaggaagtaggagctgttagaggagggatggggaaaaatagggtcttgctgtacgttttggcagttactacatggttaatcactggagcattgttcagtaactgccggggtggcaggatccttattcaagtatttaagcgaaaccattcttttaaaaagtgttctccatttaaaaagtgttctccagccaggcgcagtggctcacgcctgtaatcccagcactgtgggaggccgaggtgggtggatcacctgaggtcaggagtttgagaccaacctggccaacatggtgagaccttgtctcttactaaaagtacaaaaattagcagggcttggtggcgggcacctgtaatcccagccacctgggaggctgagacaggagaatcgcttgaacggtggaggcagaggttgcagtgagctgcactccagtctgggcaacaagagcgaaactccatctcaaaaaaaaaaaaaaaagaaaaaagtgttctccgaatggtttgttttctttccacatatccccactgcattgggtaatttacaaagatattagggagcccagggctgggcatctagaagtcactgttctctttagatccattgatagtagctatgagtctagaaaactcatgggcaaattctttgaaaaggaggaaccaggatgttctctctcctttcaccccccctcactgccccactatgatttggactttttttggttcagggacacaggaattggaagcagaactgaattttgtaccacttgtttttcttgtggttccccaaaaccaagaagttaagtgcccaagagatgttcctctcaacaggagtcagactcgttcttaggtggtgaccaaaacagccctggagccttcctcaaattaatttgggttttcgttgtgtgtgtttattgcattgcatctgtgtttgtgcaccaggttaattgggtgttggttgtagcaactttttttaacggcccgtgagaactgggaattgggccagtctttatttaactcatctttcttgatactccttgcatgcataaagttctgtcagtcggtattactagtcatcaacctcattttaaaaccaagctgccttgtgtatatatttgcaatatccagagctgggtccctccaacttaaaaaaataacttccaacttgaagacgtgacctataactgggttctgcaaattcaattcagtaagtacttccagactccctctactctttgtaaagtatgctactaggtggtatgggtgagtaagatgagtaagatgtgttttccccctccagggtctcataatcccatgaaagaaatagccagcagaatataaataacttaaagtaatggtagattattacacaattcatgttaaaaaggagttgcaagttgggtgttgtggctcacgcctgtaatcccagcactctgggaggccaaggtgggcagatcacctgaggtcaggagtttgagactagcctggccaacatggtaaaaccccgtctctacttaaaatacaaaattagctgagcgtggtggcagatgcctgtaatcccagctacttaggaggctgaggcaggagaatcgcttgaacccaggaggcagaggttgcagtgagctgagatcgcaccactgcactctagcctgggcaacaagagtgaaactccgtctaaaacaaaacgaaacaaaacaaagagttgcaagtcaagggtattgggagaatgggatggtgagaggttaattccagtgtggagaactacaggactgctaggaccccagtaagagctggtatttgactagagccttaacgaaaggttgggctttgaggagccagaattgttcaacagggagatggcgggagcacagactgggctggttggcctaataaccaggcatctaggagttagcaacatccttgctactgtaactgtggtcctggtccaggaactagcagcaactttggtcccgccccagacctacagaatcagaatctgcattttaacaaggtccccaaaatagttgcatacatattcaaatttgagacgccctgttatatgaatgcactccttaaagattcagctaagagtagaacgtttcttagcaaggcagtcctagctgcaggttaaaatcacctggaggatcttgaaagaatattggtacctcggcctaatctcagaccaatagaatgtggaaggtggcagagcctgaatgttaacatttttcaatgccccccaggtgactgtagcaggcagccaaggttgaaatgcactgctccacctcaacatcaaaattgaggccagagggatggttggggtcacccactgtggtggctttaaaaaaataaccaaagaaagtaactaggaagagaaaaatatgtgaatgggtcaattctttacacttgaacatgatagttatctttgacatgaacaagaacaagattctctctccatagactatgagcttctgaaagatggtctagtgcttatgtggcccaggtgtgcttgcctgtaatctctaattcccctgacttagggtttcatgggctcatctgctgcacgtggccacaggagggccttccctgggttcctgtgccctctctttattggagccactgaccctgcctgctggaagtggggacactccaaggccacctctctaacacctacatgattatgatgttttttaaaaagtgccccgtcgttctggtgaagcatcgccttctcttcctatgttctcaccatgtggcccagcttccctggggctcctttttgtcctgtgcacccactcccaagcccttgctttcttctggggcccctcttctctgataggagcctctgggttcctgttacaaaggacctctcttctccgccatgtattcctcggccttgtctatgcctgctgggcacactggctgtattgctcatcccgtccagttactaaagagtgacaggtatattctaagggcctaatgccaaaccctggctgacctgggccatctgtaggccatgttgctcattctctagcatttcctgaaggtattttttcagcagggtgtgaggggccatatacaccactccagcctgggcaagaagagcgaaactccatctaaaacaaaacaaaacaaaacaaaagagttgcaagtcaagggtactgggagaggttaattccagtgtggagaactgcaggacagctaggaccccagcaagaggtggtatttgagcagagccttaaggaaaggttgggcttatataccaccaccacatataccaccctcaagattgggtgctgaaaagaaatggctgccactagaaagaacaatgttcacttaaaatgatgttgttggtatcttcctgttttcccttcagaatcttctcttttctgctcctctacctcctcctcccctccagcctcaagtagacaaaaaagataactactgagtactgggcttaattcctgggtgatgaaataatcatcagtacaacaaacctccatgacatgagtttacctatgtaacaaacttcacacgtacccctgaacctaaaataaaaggtaaaaaaaaaattaaaaaatcttttctttcattgctaagctgattttgtaaccatgtgctacagctgagacttacctaaaaatgaacaaacttctggctctttcctgcccaatatgggtggatgacagccacacgaagtgggtcgattagtccaccacaggaggcctaatgctcttctacacacagatctctttgatctacaacttttccttccagggcggccctcaaaggctgaagcttcctacagtgaactcaaaagtgttttccattttgttttgaactgttcctgcctaatggatgtacccacaccctgttagggttgtgtttctcttcaaggcaacacttgccctctcaggaggtcatccatctaacactggagggtttgttttgatgtttagttttattccttaaaactaattccaagtagggaacaagtccgtaaggtggaaagctctgaacatagagctcaggttaataagaagagccttccttcctgtttctcaggaaatgtcttccgcctgacaatttctctttgcctcaccctaaagggagtaaagcccacgtgataacgtctggtgtgaggactctttttcccagatctatagtgatctcaccatgagtctatacatcaggaggaatccctgctgctgcctgttcagtggaagggagaaactcctaacccataagcactaaggcagccctttctagaatatattgcatgttggaatcatcttgttgggtgagacagagaaaggaatgctctgagctcactgttggggccccatgttccttccaagataactgatactctcttggaaggtggtggagttccagattccaccaggagtgccaccccggggagaggtttctgcccagtcaccaggaagggcagggctcctctcacccagatggggaggcggggatgtttcctttctcacctactgaatggtaaccacatacagcatgcagtccaggacactctgaaataattcgtttctaatcctgggagcacaaaagcataacaggagcatatcggacactgggatgtctgcactgagtgtagctcaaccagcacagggcatggaggggagagactggctggtcgtagggatgtaagaagaaggggacactctcaggcaggcaatatgaggacgtgactttacaatcagtggggcgtgtggaaccgagggcaggcaagtgagacatctacctcattacctgaacacttcaatcccctgcttcagctttggagccagatgatctttgctgcgaccactcaaccctgttgctgcagcatagctgtagataacacgtaaatgaatgcctgtgttccactgtaactggggttactaaaatgggcagtaaatggcccacaggctgtaatttgccaaccactgttatagagaccgtaagaagcttgagggcaggatattgtcttattcagtgtgatatccatacacaggcctgggtcatggagggtgtttggtaaacatttggtgaatgaacacgtgactcctggatgtagcctactgtgtggagcggtttctcaacctcagtgctgctgacatttggggcccgatcgttctttatcctggagggctgtttggtggattctaggatgttaagcagcatctcttgcccctatcctgctagatgccagtaatgacctcttcctccatgtgaggacccaaaatgcctccagacattgccaagtgtctgctggggtgaggggtggggtggggcggtgcagaaccacctaatgttgaagaccatttatgtagggaaggatgtggtaggagatgggagatgtacctttagcctatgggggaggcatttggtgaaggggaagaaaaaaactttattacaaaagaaaaaaaaaggtaacttaaaactaaacacacttttaaaagacacaattgcctgtatatttttccagttttatttctgcacgatcatcctaggcatacttgttggcaaactgttcttaacataaccttacttctatgtcattgcgtattttcctacaatattatctgtagtagctgaggaatattgccttatctgattgtgccataatttatttaaccactaccttcaccaattattgattggtttgctgccagctgctctgctagaaagaagttaatccaacaaggccctgctttttggagccacaggctagcagaaaatgaagacattgagcaagtcagtttggacatgttgagtgttaataaggggtaatgtgggaatttctaacaggggagctgaacctgggggtagggagggggcgtcacaaggaacatttaaggctttggttctcgagcttcatgaaccatcagaatccctgaggagcttgttaaaacacagctcgctgaggtcccccccagacctgatttgttaggtaaggagagggctctgagagtctttatttctaacatattcccaggtgctgccgctgctgctgctggtccagtaactactctgatttaaggagtttccactttctcactacgataagcaactggtaatgatatcttacttatacgcatccctgattatcatgaagaaatagtgtaatggataagaacagaggttctggaaataagggctgggtgtggtggctcacacctgtaatcccagcactatgggaggctgaggtaggcagataacctgaggtcagcagtttgagaccagcctggccaacatggtgaaaccctgtctctactaaaaatacaaaaaaattagctgggcttggtggcgtgcacctgtagtcccagctactcaggaggctgaggcaggagaatcacttgaacctgagaggcggaggttgcagtgagctgaggtcatgccattgcactccagcatggccaacagagaaagactccatctcagaaaaaaaaaaaaaaaaaaaaaagccaggcatggtggcccgtgcctgtagtcccagctactcgggaggcagtacctttagcccttgcaggaggcaggagaatctcttgaactgggaggtggaggctgcagtgagccgagattgtgccactccactccagccagggtgatacagcgagactccatctggaaaaacaaacaaaacacaaaagaaataaaagagcagagattctggaagtagatgacatatgttcataactctggctctaccacataagccatgactcagtttcctgatctgtaagaagggctgattgtgaggattatgtggattcactaacataaaaagcacttagaacacagcctgacacagaataaacagtacttgtgtttgctattattgttgtttctttaaactaaattccctgagtagaatttctggttttaagaataggcagaaatataggattttcaaaatatgccgccaaggtcatcaccggaaagagttttaaagttaaatcatctagagcactggttctcaacgtgtggttcctgggactggcagcatcagcatcacctggggacttctagaaatgcagattctcatgccccaccccgccctaccaaggcagatgctgatttctaccaaagtgtgagccagtgttccagaatgtcattggggttctgttctcaggagcagtaggaccgtgtcattgcactgtttagccctgtgtttcctattgatgttgctcaggtgggttggaggaggaagattgagtccagggttgctctaggcaagttagctactctactacttgtggacgcacagtcggggcctcacctggggccgcagaggggcagggaggggcctgcgtgggaaatcttcgattcttgctagcttgcaacatcaagtcaaacctccttaaacctccatgcatccttttcatgacagggttgctgctttaagggtagagggtttcggtcagcgtctgtgttaacacactcatttaatggttatcaggcaaggctggtccctcagtagggtgggggagggaggctccatgaattcctgggttgactggcatcctcagctttatcatcatcccccagtcactggagggtgaaggcaagaagcaacagtgaaagccacttaagcaagcccctttgatttaatgtttgattttaggctacgtgttggtctgctcgggccgccacaacaaagtatcactgacacagtggcttaaacaacagacaatttttcacagttcgggatgcagaagtccaagatcaaggagccacaacagggctggtttctcccaaggcctccctccgtggcttgcggatgccaccatcttcctgtgtcctcacgtggcctctcctctgtgccattccagggacatgcatccctggggtccgtttctgtgtccaaattttctccttgcataaggaggccagtcagcctggattagggcccagcctaagaggctcattttaacagaatcacctccttaaaggtcttatctccaaatacagtcacattctgagatacggggactaggacttcaacatatgaaatttgggggtacacaaatcagcccataccaggctactctgtggcagagagagagagacagagagagaaagagagaaagagaatagaaaacaagtagagactggaaacctggagaaggctagtaattcaggaaattaggtataatagcaataaactccctcaaagacaatgattgtgtctgctcccctgaccgaagggagatggtggctaattatttgaggccttgacaaaaaagtaactgcatacttaaagaaccccttaaggattaacgcaattgctgccaagtcccccaggttatatccagagctctgcagcttgtcaggcgcagggtctggtggttgatggcctctgcacttggctcccttgggcctaagtttcctctccacatgtgactgctctgtgacttttatgagccccagtctcttcactggtataactggcatgtatgagtacctagtcatatggctgctgagaagactgaattggacaatccacgtaaagggattagcatggtacctagcacattgtaaacactcagtaaaaagctattttaaaaaattgctgcacctatcatgctccagatttaacgtgaccccaaatgaaaccgattaagtttcattcatttctccatctaggctttgaaacaatcattattaaggaaaatatttattataaatgccatacatgttcagtagtttttttttttttttttgaagtcaaatatatgaagactatgaagaaaatgtgaaaacctgtctctcaacacctccctggtctggcttcaaatcctggcctagccctttatgggatcactgactttaattaagcaaattatttgacctctcggggccccagttacgccaactgcaagtggagatagtaaaatcccaacttcatgtcattgcaaagactaaatgagctgatgcattcagtcaaagtgggaaggaagcctggggctggcacacggctggcatacggtataagcacggtaaatgctagcaggtgtcatggttgctttcaccaccagcatcataaacttttgtgcagggtgcaaaggagagcctgggctggatggcaggaggggtgtggatggcgtccctgggtctcctgggcctcccggacgtaaaggtgacacaggagaagacggctaccctggaggaccaggtagagtttcagtcactcctcttttctctgacactgtaaaccttagagttgtatacaaaatctctgatctctcaagtggctttccaaactggatcctattcagatcatttgccttagatgctgactcaccaggtatcagagacagaaacaatgagaacagagtgggatgcatctcttatgttctaactgatgttaaaccatcataaaacctagacaaggccctgcatcctattcagtattttcccaaactgctatacatcatcatcaaagtcttggccatttctgcagttcacttttcaaggtcatgaagggacggtcagcctggtggctgtgggatcacccttaagaggctgtgatgaagacctcagggacggtgtgtgtgttctcaccctctccaagtggccaaatcgcctggtttcctgagttcacttcatcttatcatatagccattagtacactgatgtagaaaacagggctctttcttaaaagaaaaaaaatgggaagtggtgttgggaaaggggacataggactcttcagaatagaagtgtgaaacaatgcaccatgtagctcgttaggcgcatggatccaaagagcctgagacacaatcccatctccagagagtccctggccagggatgcaaactcctgtaccaggttagtagtgagtagaaacgaatgaggagggctgggtgaggtctgtagcaaaatggagctttggctaaaagctgcagcgcagctccagccaattatagtctacagaaatgtgggcctacactctacactctcttcgttcaaaatatcaacttgtaaaatccttacaggtcaaaacacacgagcaggcctgattcagtccacaggctaccactttgtcgtctctggttgacagtgtagatggggagagcctgccagtcttgcagaaccaagggtagaacacaaaaaataccttttggtttcaatgtctaacttcaccttttgctcttggcaattagaaacagctcctggccttctgcaatagttcagccccttagaggtgccgaaggatacagaccctgctcacgttctctagaactgttgatttcccatctgccaacaagaatgctagaacaaggccttccttccatttccctctcttctcgaagaggagagccaaacttgtagatgtggatcccaagcctttggctttctcagaatggaactgataatatgctggaaccagggaagaggtctgggaggtgtaagaaagaccgactttggggagcacttgctcagcagttcagtctggggagtccacacttggggtgtgtcattacactgtccttgttcttttcttcccagcgtatttcataacttaactttttgttatgcttattgtttcttatttctctctcttcctcaagtgtaatgcaagctctatgagggcagggattttcctctgttttttgtctttatgctaatgtagcccaggcatctaggagttgcttggaacaaatacttgatgaatgagttgttctatgtactgcagctgtgtagctgtgtacgttccagaaggcgaggaggggctgagtcatgctcccctctgctccctgagtgcttagcacagtgccagaacagaggtgcttaacatatttgttaaaccaaaccccctaacctgccttcaatttttttcctttgttcctccagggcctcctggtcccattggggatcctgggcccaaagggtttggccctggatacctcggtggcttcctcctggttctccacagtcagacggaccaggagcccacctgccccctgggcatgcccaggctctggactgggtatagtctgttatacctggaagggcaagagaaagctcacaatcaagaccttggtatggatacaggatcgcccatctccattgcctgaagagtaaaatttggggttaattttactgattcatcagcaccttaaatgatcactaaccttatatgggattattcttacttttaaaacaaaaacactagcatggtcattctcagctaatcctttaaacttatgatcctatgaagtgtcaaagaagctcattctggctataattattatctggctataataagtatattattattatctggctaataataagtatattattagttttataaaaatgattcttcctcagtaagttaaatgtaactctgttatgaaatgtactttttgcttccaaatgtaaattaaccagaatgtggtcagttcctgtacttacatgtaaaatggtgcagccacagcacgctgatggttgtgttacggcacttgccagcatcaactccctaccctactccaatttaaattacagaactttattttgagggtcatcttttggtgctccttgtcacttctccgctctccgctcttcccctcccctaccttcccctcccctcccctcttctcttctctcttctcttctcttttctcttctcttctcttttcctctttttttttttttgagatggagtcttgctctgttgcccaggctggagtgcagtggcacaaccttggctcactgcaacctccacctccagggttcgagcgattctcctgcctcagcctcctgagtagctgagactacagacttgtgccaccatgcctggataatttttgtatttttagtagagctggggtcttgcggccaggtaggtctcgaatatctgacctcaggtgatcttcccgccttggcctcccatagtgctgggattacaggtgtgagccaccgtgcccagcccttgccaattttcaatagtagatttgcaagctgcgggactgatttcaagtcaaaggcttaagtacctggctgccgggaaacactgtctttccaagaaaatcatggttagaatggaaggtgcaggaaggatatgctgacggggacagttgacggtgaggtgcttgccattgctctcactaggcagtgaccccagctgttaaaaagggtagtcaaagagtgcaagcctgggctggcaactacttgtacatcccctgcatttctcccttgggtttggccatggcctttcccatcacaaggggctagtttctttgagcacaggagaaaggaggaagtgatgtttaatatcctgaatctgtttccttctctccttctctccctctgccatcaatttctttcctgcctggtctttgtaccatcatccgtcttgcttctcccaccttggtctaaccagagcacacatcttaaaactctgcagaactcttgggataaagtccaaactccttaacgagattgacaaaggccacatccaatggtctgatttatcactggacactcctgagacagacagtgcagacaccctctcctcatagtccctgcactgaacatgtctgagttctctgagctccacgatcccttatctccaaccccctctgacggtatatctcttttgagtagtcactaccaccatctccaagcctggctaaatcctcttcatatttcaagtcctaacttaaaatcacatattccagttatccttccttgaggtcccggatccccacacttctcattcttagggcttgttgtgctgtattttcattgcttgtttgctcatccagttccctgctaggccatgagcttcctgaacacagagatgtgcttggtgcccacctccagcacctggccccctgcttggctcgagtgagggatgaggggatgagggctggcccacaggaccagggaggtgtcagaaatggcttcctcaccacagaagcaggctttggcgagggcctccagatttcagaacacgtatctgcaaaggccagatggaggaaggaagggtctgggaacacctacatggggtgcttggacaccagctgtctcttcttcccttcccaaggtctggcagggtcttgccttcccgtatttagcacgctgccctttgcctactgcaacatccaccaggtgtgccactatgcccagagaaacgacagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctggatcgggtattcattcctgatggtgagtcccgtgcccttgaaaaccctggctcattcaccatttcctaacaccttctcccgccatttctctctggattggacagtaattctgagcactctgcgcttaggacataaggttacggggactgttgcaaaccatagcctgttgggatgcagggccattatcttttaaaaacacttgtgattgattttgatcacattggtagaatttagaagatgagtttgcttcagccatcggtgaaactggagccaatttgtgtgcatacttaccatgctgagtacgactccttttcagcgcttgtattttgttctttatggaataatctaaggaaaaatgttaagatcagacccaaacctgggtgtgtccctgattgggtctggggttgtctgtgtgtgtctgagccctaattctctcttgttttctgggtagcacacaggagctggggaccaaggaggagggcaggcccttatgtcacctggcagctgcctggaagatttcagagcagcaccattccttgaatgccagggccggcagggaacttgccactttttcgcaaataagtatagcttctggctcacaacggtgaaagcagacttgcagttttcctctgctccagcaccagacaccttaaaagaaagccaggcccaacgccagaaaatcagccggtgccaggtctgcgtgaagtatagctagagaatgcgaaattcaccaacacgtggccaagagaaacttcctagggggctaagacttcctagactgtgctaagagatgtcatggtgctcattttggactccctttcagtggttccttctgttttgtcgtggttattcccagagtcctctggttccttacacattaagcaaatgctgcacagatggatttgtttggacctcccaatctagggagcctagatactcttattttactgaggatgatcgaagaactggctttacttaaaaatatgctaattctcagaaaggcaagtagatgataaaggccagattacaaattacattactgaaaacttcattcttgggttaacagtatctcaaacaattgaagtcaattactctataatacagtgggcttctggatggattttataggaaaaaataaacaggtcaatgaatgaaactagaaagcagagattttcaacatttcaaaatgatttcctctgtaatctatttttccatatactttaaataatggtaaaaccatgacgcaaagagagatttttttttaaagaagaaaaaaaaaaattcacactgccagcgttaacagttcctttcaaaggagaatgaatcatgatggcaggaaggcccacagtcgccgtattccagagatgcgacattagcataaacacatcacagatgaatataaaacattatgttctcttctgcatttttcagagaatagaaatgcctactttggcaacccttttgaaaagtagcaattatggaaaaaaaatattcaataagagattaggagcctaaaagctattagtgaatattaaggtagttattcacaaaaattgactccccattgcagtgaacttccagacagactgcttttccccagtcggggtccggcgtgtcacaggtgcgtgcgtgctaatgggactgacgctacatggggctcactcaggcaggcacgcgcttcatacaaagcatctcactcccctccccaggagagcctgcacagcttcttgcactcacaacggacactttgctccacacacataatggcagctcacacagggacgtgacagagctatcattatgcacttgggagaaaattaagggccgatttaattaaacttaggtaagaagattcatttaagtcagggttaccccatcaggaggacatggcactatctttaaacgaaacaaagacaatttataatttgaattttatgctcccgtggttggctgttacaggagcatcccattttgccaattttaaagacattcttatatttcatatcagtcttgtaccaaggcaacagtttgacatttggcattagtattttctaaaaaagtttagaatgtgtgtcaatttataatgattatttttttctgtaaagcaaaagatccctttttctgttttgctaggaatttggtgatctaatcctaaatttaaaagatttgttggaaaaaatttttaggaaactcaccttcctcatctaaaagaaaaaggcattttagagaaaactaaagaaatttctcatgagcgtgacactcattttagtgctttgtttccgtgcacttaaaaataattgagaagaaaaactcaattaaaattttgtttataagaaatgttttccttgccaaaccttgatttgtaatgagctcttatatgcagaacacatttcaaatgagttttgctatgggctgcccccagggtggcaatttattttaagagtattttctggtaaaaagaaaaatgtgtattttaagatgaaatattttcttgatgtagcagaatatttcctagttcatttgacccatttgatattttttaaaccatgctctggcatgttgaatatttttgtgcacctaaaacttaagccaatttcaatcttatttgtgattacctttctccttcccaaaaagctttatctattaccaaaagtcaaccctcctaaaagttcaacctgttcatcttgaacttggcctgagaacattttctgggaagaggtaagggtgacaaatggaacatcagaaacgtatcttgcttgctaattattttaaacactttaatgttggtattagaatattatcttcataagttaataaataagtaaaaaaaaaaaacccacacaaagacaggctaaattatgtagacagtttactccacagtgagcttgggaaggtatcagactgttcaaaatgttagtattacaagagctgtctctaaatgcagcattaacactgccctctaattttacaaaagtattttaaaggatcaaaagggcggaaaaataacttcttggaatagaagatcctgttaccttaaaccattattttcttcacctggttatatatcaatgtgccttcaattaccctttctctgtggaggtgatgaacaaagcttttaagttgttctcctaacccattattggagatgatccttatcaaacccttctctccctgcctccccaccaaccttgtagactggaacgtgcctagattgccctaatgggaactgttctgttctgtgcccgtgctggaaatctgggatgcttccttctgggttctgattctcagtgagtggagcccattcatccaggcaggtttccatgctatgagtggccctttcgttctgctctcacactccccacattgaaagctgagtcatcgctgctttggatggctacctcctctttagccccgtgcccgtctcacacagcctttgttttccacctccacccttgcagtaggcatctcccagttggtgccttagtttcaaatcccagttgccatctaagatccacccaaacttgattttgtcaccctctggattagaatccttctgtgactccgctgcccatgaagtccaaatgacttcctatggggtgaaaggtccagtggggactgttcgagggttccctctaggagtatttcctgtcatgatgaactgtgtgcagctctgcagacactcccagcacctcttcgactttgctcctgcttcaccagtgatgtcctccctggggtcagtttaccctgcgtgggaggtgaattccctgggggaaacttaggctcccttctgctgctcttgtgcagtgcacggggctgtcctcattttctccgttccccattgcttctttaatgtctcagtgcacttccttcattccattgccaaaatgcaagccccttgagggcagggaccatgcttgactcgtttttgtatgcctaatgcctagcacagagttgaacacattactgccaattcatttttttcaatgacaattccataaacatcattaggcattaggtgttcagctctgcatataaggtcttcatcagcaagacggttacaagtataaaccatttcctatttcagaatattttaatattcaacatatttgtatacccacattctcttgttacaattattgccagaaagccaattgataagctttcaaaatgggcttatcacacccctccaaaaatagatttttgttttttctataaacagaaatttcagaaatgagatttgagagatccgactgagaagacccttcagtaaaatgtgacatgacttaccttatgctgtaatctgtattccctcaggatttaagagcttcctagcataaaatctttgctaaacgtttgtgtacatgttattggtgctccgaaaaatagtcaatggaatggtgcactacaattgggctttatcatcttattttgaacctcgtgtagattacagtaaagcaaaccattcagtgtgttccaggaaattatattagatctgtgtttctatcagctcactggaataatctgataattgttacttttacttggtatggctgcaagaatagtggaaagaagaggacttgagagttggtcgaacccaggtttgaaatctggcttagtcatttttcagctgttatcctgggtgagttttgccaactttcttagcttcatttccctcattaatacggtgggacataacagctactcttgcattgaaaattaagttagattacctgtctagcatacccatcatcatacacttactatggtcacattttgtatttaaaataaactaatacgaaaaatatttctttttttttacacagaattatgattctcacagggtatataaattactgattagaattatttatatgtggccaattcttaatgtcattgggaatgctgtttcatttcaatcctcaaagttactgtagcacagaaaatatcacaatttcctgcagggacattatcagtaagttctgcagggaacaaacaattgacattaaaaatcagtactctgcaattgtcactgttatcatctgctagaaactctgcataatgcattttaaaccaccaaggctggctgccacatccatgtgaaatgcttgaattttatggtgcttaaatatttaatgattcatgggaaaaatgtgaaatgtgtctaataaattgcatccctttctctaacctctggttgtaaagttaaagactttcagcatgtaacttttgcaagatgcctggtctgccattggcacttaaatatttgttgtattacgatttataatatggttcattatatataaaattctgtgatgacttccaaaaacaa

SEQ ID NO: 21 - DNA, 106096 bp, Homo sapiens
  source 1..106096: mol_type = genomic DNA
ggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggtgagtggagcccgccgctccccggcgccgccccctgccccacacccggtcacctcctcctatcccgccctcaccccgcgtgctgggagtgcgggaccccgtgttctgcccacctgttgctcgccgtcttcggtatgaccgacttgcttgtggaaagcactcttttccataacctattactcagctttgtcatataggtacctatgtatattaaatattgtacatatctatcaatgttaactaactcacttcaagatttcacccctttctttttctactccgccggtccgcgcccctcactggtgcggacttaatttgaaggttcagggagtctataaacaccttgagatgctatgcagaatttttggtgtgtacgatctttttctgggagaaggagcccttcaattttattagatttgttaaataattaatgacccccataaatatcttggggaaaaaaaccgacagcactggcgctcctacaacctataaattgggattgtgctgtcttatgcaagtacttcggggcgctccaccctgtgtgggaggcgagtggtggatctagggagtgaagaaaagtagttaggaggctttggtccagggaacaaacacgccgaggaggaggtaggggactttggccctgccggcaacagccgtgcccgcctagctgcgcttcctacccccaccagtgcgggcgtgatgcaagtctgatccctccaaaaaattaaacccgaaggtgaaaggggtgtaagcacacacatgcacactatgttcatgattgatagacgggggaggtggaagggaaagaagatggcaagccacttgtgaaaattagagatcatgatgtatccttttctcccctgctgaagtcaggtgatgggatcaactcagtgacccttgttttacttcttgttgctgtgtatgtgagtttgcattataaaagcactatgttggcttatagcaaaaagaagaggaaagaaattgagcaattaagttggaatatctgtttcctgcaacgttcagttgtttctgtatgaagtaacttgggcattggcgaatgtaggctaacccattctagtttctattaggaaaacagaaaaattctaacaggccagaccagagatttcaaacagcagagtctgggaggctgtactgtgtgtgtaaaagaatcctaaaggatgacgtagtcaatattaacatacttgaaaggtaaagagaagatgttcaatgatcgtagttaatataactgagtgcatactatgtgccaagaattgggcgatgtggtttgcattcatttgagatatatatatatatatgtatttaaaaacttgtgagttaggtattttcatcctcattttacagatgaggaaactaagcagttaagtaacactgaagctctaatagatggtaagtggcagagctggtatttaaactcccaaacctgaattttaaacttatcagttttatcattaagttttaaaatgattaatacaaagtgggatttgttagatgctaagcctctccgtggccccctcccatttttctttaaataaaattgaggaagttctgaaaggctggggaggtctagaaaacacagaactgctgcaatacatggagggaaagaccttatatttatttagacttaggggtctgactaaagactgcgggatgagtgaggccagtctttgaaaagtggagccattacacccattcattctctgtgcccataggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatattcttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagtgacccaaaagaatggctaatatattatggagtttagaagtgtaaattggctgggcgcagtgactcatgcctgtaattgcagcactttgggaggccgaggcgggaggatcacctgaggtcgggagtttgagaccagcctgaccaacatggtaaaatcccatctctactaaaaatacaaaattagccgggcgtggtggcacatgccggtaatcccagctactcagctactcggaaggctgaggcaggagaatcgcttgaacccgggaggtagaagttgcagtgagcggagatctcgccattgcactccagcctgagcaacaagagcgaaacgccatctcaaaaaaaaaaaaaaaaaaaaaaaaagtaagttactcctggtggcaggaaattttgaaaagcttcctggaggtagatctcaaaaattcagtaggactggacatagggaggtgactggagaaagatcattctaggagggaacagaatgaatatttcacagttcacagagttgatatggtagaacaaagggcactatcttggtccttctgctataatgcttgggtcaactacttgactggctgttccaactaaggaacaaagcgtttgaaatattttgattgcaacagcagctttccagtaagctgaaatacactctgcagcctacacagaagtacaaatcagacagagagataaggcagcaaacaacacctacttactttaaagcctcagctttctaagactcaaaaaggaaatcagcttcaaaggaatttaacattagcatgccatgaaacaattaccaggggtggttcgtatgtattgtttaattaaacttctttgaaaaggtctgggggctcgtggtggttctgagtataatttttattatttccatgttactatcctgtctctcaagttgaaacagacaagcaattgttgaaacagtgctggtctggaaaaaatcctgtatcaacacaagaaattccaggaagaaaagaccctgatgttaactgctattagctccagggccctggagaattctgagttgttgacaaacctgtaaggttgagacagcggataacctgctgaaagcagagatgagataaatgtggctgatttgttgataagtatcttgcaagagtctttaaccctttgtcttctttccaatgccttagtatagctgggtggttttcattgtaaatcactcagtgacttttggtgttatttttaactgtgctgaacattttaaagttggctgtaactctttgggaaggggccttcagaggtgtatagcagcattgtgaagtaagtctgtattgtagctaatagttaaaatatttttctaaaatagaagacatttaagaattgcaagtattggcaaagggaaaaattaaaagcatccatatcctatttattacacttgccttaaaagtactacttgctacacagttctccccccccccccgcccccaccccaggtatctgagtggagagaaaattgtgttttaaattgtatttactacttataaaggacagtgaacaatctcctaatgcaattatatttacaacctctttggaaatccaccacaaaacttgaggcacactattatcttaggtgatttccttggtgaagctgcttttcaatatctgtgatcaaagtgaattctgggctgggcgcagtgactcatgcctgtagtctcaccattttaggaggccgagacgggtggattacctgaggtcaggagtttgagatcagcctggccaacatggtgaaaccctgtgtctactaaaaataaaaaacaaattagccaggtgtggtggtgcatacctgtaatcccagctactagggagcctgaggcaggagaattgcttgaacctgggagtcagaggtttcagtgagccaagatcatgccactgcctccagcctgggcgatggagtgagactccatctcaaaaaaaaaaaaaaaagtgaattctggagagagaattgaaaattggctcagggtagcaaaagaaaggtagttactaggcgctactgttaaaaaaaagttagacattgttcaaattctgcataaattcttcctttgacaaaaaggaatcccaggaatgaagcaattctggggagcaaggtgactaatcgttcagaaagtaggagggatcaggaaagggaaaaaaaagagtgagatggcgggtggcagggtcatggccctctgctctgaatgtgaggtgtcagtagcacactggattaaatgcacctctgtgtctgtgtaatatggcctgtgagccactttttgtccagggccaagcagattgagttcggtaagtccaaaaataattaaagaaatccttctgattatagtaagtgaaatagaatgttaacaaaatggtagttaacaacaacaacaaaaaaaacttcacacccctggaaatgttgagaacacatctcttaggggtgaagttttgtgtgagggtaaagtaaggatgcttcagaatccgtggaactgtaagaaaccacaagtagacccagagtagcagggtttgattatgaaagtacattgttctatatgtgacagataagacgcaggaaattaccttaaaggaaggaagactgttcatttaggcttttaaaagactgttgttatctgtatgccctgtgctaagagttccacagtcatgggaacagagggtagcttttgtattaaatattctaggtatttgtagttcacatttcctcaaagttttagatagcaactttacagttttttctcatttattaaaataagcctatacatagttacattattttatcttcacattttaacattgattttaccctacaattgaattcctagtctgatcaatacaaattattaaaagttttgattttttttctctgagagaacaagcatattattggcaaactatgatagtaatgaaatataataaatatgatgctaaaacctctggagtttataaatcagatgattaatatggcctataagatgatttatttccatctcagatgacattcaacaagtttaaattatacaattctgagacaaatgttggacttcaggtatcttgtgcatgtctacaaatatatgaagataaataccctacttctcctgaggaagtaaattagcagtaaaaggcagcaatgcaagtgggaatagacaataaattaggagaaaactttatttttctattagagtgagccacctggctcccctgactagtagagtaagactactaaacaaactatcaagtgctctcataataaaaacattaaaaacctgttgtgtgtcttttcttttcttttttttttttttttgtttcgctcttgttgcccaggctggagtgcggtggtacgatctcggctcactgcaacctctgcctcccgagttcaagcgattttcctgcctcagcctcccgagtagctgggattacaggcacccgccaccaagcccagctaattttttgtatttttagtagagacagggtttcaccatgttggccaggatggtctcgaactcctgacctcaggtgatccgcccacctctgcctcccaaagtgctgggatctcaggcgtgagccaccgcacccggcctgtgtatcttttctataatgccatttctggtaattggatattggacataaaaacagttgtaatgttcttaaagtgtttaaagacaaaagcttgagagctcaatatgtagatttaaataaaaatggacagttggaaaaaaagaaacttaagcatttgaaaacacaacctgccattactattaaaataattcacatatttatattcttggaataatcagctttagacttaataacattcgttaacctaagcagtcataatcaaagttctgcaattccttgatttccagaatttgtggatgaaaaccttcattagaagcttaatggattattttttctgaatctctcagtaagctatttatggggtgggtgtgggtgagcatcaagcttattggatcttgattactctttttcattgaagaatgaaaacaaatgggaacttttcttgacagataatatgaatttataggccaccaaaatattacagataaatacacaagccatacagataaaagaatgatagtaaacatatattattcaaatatagaaacaaccttgccaaaatgaacaaagtcagcttttctttttttttttttttttttttttgagatggagtctcgctctatgcccaggctggagtgcggtggcacaatctcggctcactgcaacctccgtctcctcgggttcaagcgattctcctgcctcagcctctcaagtaagtgggattacaggtgtgtgccaccacacccggctaatttttgtatttttagtagagatggagtttcaccatgttagccaggatggtctcgatctcctgaccgatccacccgcctcggcctcccaaagtgctgggattacaggcatgagccactgcacctggcccaaagtctgcttttctaataaaagtctgcctacattctggggaagcaactttccttcctctccgtatacccagaatgacagagaacagtcgaaactatttgagcaccttccatctaccccaagacaaaagcatgtatgtgactatcatactcacattttagttccattctggtgagccacagaatacatacctgcctgaatgattaagcgcaaactgaatttgtgtaactaggatatttctaatgtacaggtaatctgactaatcaacaattaacttgtcaagtactgatacaagactgtgctagaagtggtagtgtaagatacagttctttctgtcaaaatctctttggaagagaaaataacctctttgttttaacgtggccccactccaatccattctccacacagctgctagagtgaactttctaaaatctcattgcatcatttcccagtttaaattccttcagtttcttactgttatctgcaagagtaaaattattgaacacagcattccaagttcttcgtgatctaatgcctgcaacttctcaaacttcatccctggggccactacccttgctccccaccaaacacacacaggcagtttatcttgcttggtatttctacccctccttgtctccctcccttccttctcttgcccagttaacttagttcagttgtgtcccttataggcagcctccttcacccctctcctctgatcttgaatgcaagttaaagaatttgataattgtgagtcacagatatttccacagggaagaaacatgaaaagtgcaggagttttgtgaaaatacatttgacagatttggtggatttaaagtaggaacagacctagcatggtggctctttcctgtaatcccagcactttgagaggccgagacaggagaatcgcctgaggccaggagttcaaggctgcagtgagctctgaatgcaccactgcacgccagcctgggcaacagagtgaccctgtctcaaaaaaaaaaaaaaaagaggccgggcgcagtggctcacgcctgtaatcccagcactttgggaggctgaggcgggtggatcatctgaggtcgggagtttgagactagcctgatcaacatggagaaaccctgtctctactaaaagtacagaaaaaataagctgggcgtggtggcgcatgcctgtaatcccagctacttgggaggctgaggcaggagaatcacttgaacccgggaagtggaggttgcggtgagccgagatcgtgccattgcactccagcctgggcaacaagagtgaaaatctgtctcaaaaaaaaaaaaagaaaaagaaaagttgggttagcagttatgaatcagttgggaggggttaaccctggcacgtgagaggcaggggaaatataatgacttgaaagtcattacaaagaaaacctgtagtaagtattttaaagcaaaaaataatttgtgagttctataaattcacctttttttatattattgggagtataatgtgatatttgccatggaagttataaagtcttacaagtcttaaagtctcatgagatatctcagcaaataattggcaggaatgccaaagtaaagacacagttacagaaatgaacagtgtattcattcattcattcatgagacagcgtctgtctctgttgcccaggctggagtgcatcttggctcactgcaacctctgccccccgggctcaagccattctctcacctcagcctcctgagtagttgggactacaggtgtacgccaccacacccagctaatttttgtattttttttgtacagatggggttttgcctttttgcccaggctggtctcaaattcctggactcaagtgatctgcccaccttgacctcccaaagtgctgggattacaggcatgagccaccgtgcctggctgagaaatgaacagatttagatacttccaggatatttctatttaatacttcaccaggatgctaaattaccagtttataataacaaattctacaattacatattctaatacctcaaacaaaatatgacatgaacacctgtgatataaaagggccatttaatggctcacgcctaaagcgctggcactttgggagcccgaggcgggtagaactcttgaggccaggagtttgaggccagcctggccaacatggcaaaaccccatctctactaaaaatacaaaaattagtcagcatggtggcacacacctgtagtccagctactcggaaggctgaggcacaagaatcgcttgatcctgagaggaagaggtttcagtgagccaagatcgcaccgctgcacttcagcctgggcgacagagcaagactccatctcaataaaaaaagtgggagggggacatttaaaatgtgtttttgtcattacctagagcagtgatttgaggattgccccccaaatgtcataaattggtatatcagaagatagctcttgaattgcttagggggctcctgaaaaataaggactctagtggctggtatatcgtgtgagtgataacagcaatggattagtcagtcgcacactggcatgtggtatgtgtggcccactcttgcaggagagctgttctgtccctggcatattcaacgttttaagaactcatagccagtactttctagcatatacctgatacaccaagttgtttctcatggttgattatgtgagctaactggtcacaaaatatagcactgtacaactattggttaaattttcaatagtataaaactttattagactttcatctgctttgaaacaatttttcaccatagtgttccctttttttttttcctttttgagacagagtcttgctttctgtcacccagcctggagtgcagtggcccaacctcagctaactgcaacttctgtctccagggctcaagcaatccacccacctcagcttcccaagtagctgggactacaggcccatgccaccatgcccagctaatttttaaatttttaaaattttgtagagacgagatctcactatattgcccaggctggtctcaaactcttggactcgagtgatccacccacctcagcctccccaagtgctaggattgctagtgtgagccaccctgcccagccaactatagttttctaaaccaacaaattctacttattttccagcctaagcaaatgcttacttgggctgttgtgatttccatcaatatctggttgttcttcttggaaagtaagaatagaagataaaatatagttttaaaaaatatgtaagtccaaggaaatgaatcgtatgttttatgccaacacagacagacaaaaaacaaaaaaaattccttcaccaactcaggagtgcggacatacgtatggtctttgatgagtctcagtatattttctgctttcttttaagctcctactattgctagtaaatgactttaaggatccattcaaatatgaattgctatacaaattcctctgaataagtggcaagatcccatgtcttacctggaataacatgtcctcaactttactgtaatgggagaagttaaatcttttaagatttgtggagaacgagagctgttgcaagccagagattactgtagaaagaccaaataacagtaagatgataagcttttagactttcaggctctttccttctaaaagaccatcgtgaatccacactgtgaggacaactgctcacggttgttagcccaattacctgcagcatttaaatcaatactaatagcgaacacctgctgatttctgtggttacatttaaccacacctgtttttgtgggcacctctacatgtatcttcatctccagaaatcctccttttagagctcagtgtgaaccaaatcactttttttaaaccacactcagtgctagaagattgaaagaaaagacgcttttctgaatgtgagtgcacctctcttctctctaatagaagcaggctatataaagatcttgcttgtttagcagttctctgtcatttgcttactataaaagaaactgtagttggttttttataaatatgcccagaaacaggtaatggaaccacaatagagacttgtcaatttgatttcataaatacattcaatctaaccaattacataataaaattgttcacaaaactgtgattatgaaaatcaacttagttttttttttgggggggggacggaatcttgctctgttgcccaggctggagtgcagtggcacagtctcacctcaccgcaacctctgcctcctgggttcaagcccggcccccaagtagctggaattacaggtgcccaacagcacacctagctaatttttgtattttagagacagggtttgtattttatgttttagagacaggctttccccgtgttggccaggctggtctcaaactcctgacctcaagtgatctgcccaccttggcctcccaaagtgctgggattacaggcgtgagccactatgcctggccttattgactattttaaccctgacaataattcattatttcgagcaatgtttgtattggtgaccaaacacaaagcttctttttccataacagctgcttaggaatcatatcattccaatgaacactcagattgggaaagggagaaaattacattgtcctgtgacggcttcacctctgcaattttctgaggaatttagaatcctaccaccatccaaacagacctccttcaccattacccgcccccgcaattggtttgacctgaattgcttgttatttgagaagagtggagtttaaagttgctctgcaactacctactttattttccttaaaatgggctccataaaatgtgcatggtatttttagaaaaaagtataggtaatgttgcctgagcccatgttaatttgaaatatttcctagtaaatcatccccttctttaggaaacatcgaaagcacattatgcactgtgcaggtgaaatgaatggctggaaaacacagtaatatcatcgtgctcctcagtgacgggtcaatcagaagtcaccagaaaaagtccaattcaagaccagtggtaaacttagcagaaaaaaaaaaaaaactgctctacaacacagtgtaaaccatgcacactagtttatccctgttattagaatagactaattcatgaaaaaatgtgaaaatcaaatttttatgactcaaattctatttagaaaccttatctcatttttgcatattgcttgtgtagaggagaaaagttttcttttcttacccgtcaccaggtttatgcctgagacccctataacaaaagacagattaaaaagagaaaagcataacaaatttgtttaatataagttttatgtggcatgggagtcttcagaaatgaagacccaaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtacttgggattacaggtgcctgccaccacgcccggctaatttttgtcattttagtagagacgggatttcaccatgctggccaggctggtcttgaactgctgacctcaggcgatctgcccacttggacctcccaaagtgctaggattacaggcgtaagccaccttgcctggcagaagactgtatttttatagacagtcatgcagaagtctgatgagacaaaggtgggcctgatctaatggtaataaactgagggaatttagcaaggcttctttgttcaaattcttccctttatgacattcctttcctccaggtatagggaggatccttctggaatgagtctttgacctaattcaaaggaaggtcagcttgattttatatggtctgcttcaagggagaaggggtgagaggaaggcgtaaggatacacttcctgcgcctgctgcttcctcaaatgccaagtgccatattttgggatgacacgtcctgaaacccatcacttcacaattttgaaagcgtttgagtctatgctttctcaggtaaaccctctctctcagcagtcctattagtagctggaattacgggaaacaggcatctaactgatttgtccagacacatacaaagcggtagaataggggttccagatgaagcctacggatttcttcaatgtagggaagatgcctacttctttttcgaaataaacaaatcctttgaaatagaatcacacctcaattttcagtgtaagaaaatctggattttcatgttggatttgtttaaagctggatgcacctttgtgtatgtttttgtttgctttcttctattttcagaaaaggacatggctgagttattttatatgttcaacggtcatcacgatatcatcttattctctgaacagaaaatgacttattttaaagaaattcatttccatccttattagtatttactttaaaaaaattttactcagtccaaaatttctttaaaatcttagaacacagctattaattcatctttaatccagcatactgatctcaaactcatgactgcctaggcaaattagtctgcagtatttgttgtttgagattggctatttatccagaaaaaccatcgattgtgccaacttgcaggctgaatatctggagtcacatctttcatgtgtattccacagggagagtgtctgtgatttaaaaattcaatcttatttttttccctgtttccaactactttgtagttatttggcgaaccattaaaacagcctcagttcattcatctgaaaactgaagaagcagctttcttctaagaacttatgttggcaaataaagaattaatatttacagagtatttggagttgcgtaagtgaaggttttagaggaaagaaaaataatttttttgtcctcagatcaaaactataataataatccctctaaggccttgataaatgacaatgtcatagtagccaccttgcagtcagacagcagagaccaggggaaaggaggaacccaggttgatttaataatcaaccctgactattaaatctctttgcaatttaaagcaggtaatttaagtttccctatttataaacagagatgatagtagctggctccgcatcacagaatattataaaggaacataaaataatttgagctccttaaaggaaaagtcacattgaaatgtaaggagttcacacaagttgctttaaaaaggcttaaaactcacagcaacaacttgaatgtttaatgtcagttaaacattttagttcaataaacctgattataaatctcactgattaattagctatttgataggagatactgtttcactgggtcctgtccaaagattcttacacatttagaaaacctttgcagggatctcagcttaaagatggaagaagcacgccattaactgttcctgaatatctacctactcctggaattagggcaagggtatattccaggtgatgatgggctaaaggggctgatttacagagtttttcttgaattcctaaaattgcctgctttcatcacctgccgttttattatagagtaacaggaattaatggttccagctacggtccataaatgaccattagtactttgccattctagattgtccctgactttcctaattcagttttcatgtggtctaaaggtttgaacatggatagccctaaactaatttttataaagacagtaaattggatttcttatgtatcagctaactaataatgttctgcctggctgtgggctttgtacaaaggcttgttttattgggggtggggatagtgtaagcactctccccagccacatccctctaccccgaacccttcccctttctgcatattcccagtgctgagggtactctggcccccggactcttcaggattagaacctttttatgttccctgtacctggcctgctagcctcctttcccacagcagcctggcccttgcaggcctacctccctagtggcctggggaggagagaaggagtgcagagtagaggataaagggttagcctaggcgcgagcctcagccaacataaaataataatatgaggccagacacggtggctcacagaggctgaggcaggagaattccttgaacccaggaggcagaggttgcagtgagccgagatcgtgccattgcactccagcctgggcaacaagagcgaaactccgtctgaaaaaataataataacaataataatatgagttgctttcaacttacttataataataaatgtcagcgtccttaaggatccaactgttaatgtgtccttgatttctctcttaaattggctgtcgggtcatggaaaagattgctttcaagtaagggaggctgaggcagaaggatcacttgagctcagaggttggagttcagcctgggcaacatagcgagactccatctctaataaaatttatagaaaaaaattttttttctttatttaaggtccaagttccagccgttctttgccatagagattaaaaattaagtggctgcctgaccttttgccagcccttgtggagaaatcaagcccctggaaacaggagatgcctggtttatctcaactgctcttgtctctagggtgacagttacaagcctgccactgcctcctcacaagactccttgaggcctgaaaattgtttatcaggcagattgtttggctataggaaataaggacacgtgtacaaacataatttaggatggatttagactttttagctctctggcaaaaataatttcaaattaccattctccctccccttgaatgtatcatcagtattttgaaattttgtctttataacagtttattggaaaagttatgttgatgtgttcccattgtactggaaaggagcaccctgtgttgttgtattctcaacatctttcatgagtctctgaagcctagaagagttaattgagtatattttccctctgatttctaaaaaatgctacatgacagaaaaaaatttcagttaaatgtaagaaagtagatattacttggcttttggagattgttgattattttgattagcctttttttaaggcagtaagagaaaactcaaaaaaagctgagagaaggataaaggaggcagaagagggacacaacatactgctttccaccactcccccctcctcagacaggagtatgtgaagatatatgagacaggcatcagttgaatccctgtaggcttcacagagctgagcacaaagggctggctgctgtctgtgttttcatgagagtgggctggctattagaccaccaaacaaaagaggggccaggtgattccacaaaagcagccatttggatggagcatagaggttgatttcctttcctgcctaactctcctgttgccaaatatctcaaccccagcattggcctgaagttgatccatgtttcccttgatcatgctgatctaccctgttgtttttcttgcttttgtttttgtttttttgagacaggagtcttgctctgtcgccctggctggagtgcagtggcgctatctcggctcactgcaacctctgcctcccgggttcaagcgattctcctgcctcagcctcccgagtagctgggattacaggcgcccaccaccacccccgactaatttttgtatttttaggagagaccggtttcaccatgttggccaggctggtctcaaactcctgacctcatgatccgcccacctcggcctcccaaagtgctgggattacaggtgtgagccaccacgcccggcctatcctgttgtttatacaagctgtcttatctagtagtgctgagtcaccattatatttattgcctacacctgcttattacaagaagcttccgaattcctgccttgggaacagagttctgtgactcgggaaactgaattttatagtctcgaccagctaaaccagacaatgagtcccaaatttttcagcactataacaaccaaacatttttagatttttgtgaatttcctctcccttctttttctttttttaaattcaactttcattttgaaaactttttttttttttttttgagacagagtttcactcttgttgctcaggctgtagtgcaatggcgcaatctcagcttcactgcaacctccacctcctgggttcaagcgattctcctgccacagcctcccgaatagttgggattacaggtgcctgccaccacgcacagctaattttttgtagttttagtagagaggggctttcaccatgttggccaggctgctcttgaatgcctgacctcgggtgatccacccacctctgcctctcaaagttctgggattacaggtgtaagccaccgtgcccagccaaaactttctttttgagacagagtttcacttttgttgcccaggctggagtgcaattgtgtgatcttggctcactgcaacctctgtctcccgagttcaagtgattctcctgcctcagcctcctgagtagctgggattacagatgcccgccactatgcccagctaatttttgtatgtttagtagagatgggtttcgccatgttggccaggctggtcttgaactcctgacctcaggtgatccacctgcctctgcctcccagagtgctgggataagaggcgtgcgccaccacacccagctgaaaaacttttgtagagaatgttttgataacctttgatcacttgccatatcccagggtggtgtgaaactagcatttaaaaacattaacgtacgtttaatacttgttcttggccttcattacttaaatttaaaagtttaatacatcattgttatacagtctgtaaatattaattagcctacttgtattctgagttattttaatatttgcttgattgcaggaaatcttcaccgaaccagcagtgttcctgagtatgtctacaacctacacttggttgaaaatgattttgttggaggccgttcccctgttcctaaaacctatgacatgctaaaggtaggatatcaaagaatgtaaccctagtgatcagattactaccatgaaaatattttcaaacttcctaagattatttttgagtgtttacttttcccaagtattatcatttcctaaatgagttttgagaaaattgatatttatgaggataccatggaaaactagggatgtgaaacattcttacatcctagtgcaaataaatatgactcaagtcaaccaagtcttattttcaaaaagcctttacccagaaaggggcaaacttctcgtcatctgattcagagaaacggacatgttgggtaatagtcccagagtaattagtcctcagcaaagttgaaatttgatttatgccccctttaaactttatttctctcatgtgcaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggtaagtcccctcctgactctgcagttcagtcattgccagcacattctgttcccacagccctgacagcatgagctggcacttctggggcttgagagaagggcttccagagataagtgattaaaataatgacttttcaggcagctgcctaattgacagatcagcctatttacctcagggacaggggccaagctacctgctcacatggcagctttgtatggaaatgtgacatttagtccatctgttccagattagatgctggctgaagggaccctacccctcagccatatgaaaatctgctctaaactccaaagtaggccaagaattggagaattgcatgcgtattttcttcatcatcccatgaaataaaaggaaaaaatgcttattcttagcacgaatgccatttggataactatgactgtaaaaagagctaaggaaagatggctgacttctagatgtcttttttcttcctttggtacttggtaccttttagatttctagtgtcagtgatttgaaggggtattcttttggcagtattaaattattaaaataactgaatttttaagtcattcctttccattcctatttactttatagcttgactaatttagtgtttggaacttaacccttattcaagtttaatgcctgatcacaaattttataaactgtgcacgttactaagagaaagattgagaaatggatggctgattagatcagtaactcctgcaataatgatctaacatcattaggctaaaacattagatatgttattgtcatttgattgctaaagttgtctaatgatagttgttacctctaaacatcccttcaagtgaaattgtacagcatgctcactgaccaggtagcatcattaataaactacttctcaaaatgatgagggctaatctaatcttaacacaggaaatattttttatgatgtaaaattcaccatgagatttctaacatttcttatagtaagcagaccttaggcaatatgagcatacttacaaagaggaaaaataagccgggagcagtggcccaggcctgtaatcccagcactttgggatgcccaggcgagcgaatcacttgagtttaggagttcaagaccagcctgggcaacatgatgaaaccccatatctacgagcaatacaaatattagctgggtgtggttgtgtgcacgtgtggtcctaactactcgagaggctgaggcgggaggattacttgagcccaggagatggaggttgcagtgagccaagatttgtgccactgcactccagcctggggaacacagtgagaccttgtctcaaaaaaaaaaagagaaagtgtatcaggtcattgtttatggaggaaaaagctgataaaggcttttaaacaggtaattcaaaatttatggaatgcctaccatagcctaggatttgtgatagccacagttttagcaaaatgattttaacagtaacaaaattattatctgacatcctccaacaactggcattctctccctccatctctgtgtcccttgcttcttgaaccaccctgtcacttcccagtctctcgtcaacccactgcaatatgatttcagtcccctccattccacctaaacagtctcctgacaaatgtagcaatgatggccttatctgctacatcctaagcagacactatattgagtaatataagcactgcttatattactcaacctgtgggtggtgtttgagacaccatgaaattctctcatcccttggttttcagggcaccagcttcccctggttttccactcacctctccagccattctttgttagtgttctctgcgtgctccctttctgcctgctcaaagaaggcatcttcagtaacccttctattccaagtcttgatgctcttccagagaggctctgtgtacctcacttttatccttatggttctcaaagttttgtctgcaattccatccttgatgccaaattctggacctatatgaaaatgtaacaacctcctggaaatttcacactcagtatatcctaaactaaactcatcatctccctatcctcaacttccacccatctcctcctgctgtagtctactattttcaaacctggaagtcattcttatcttctccctctgtagtcacctatcaccaagccatatttttccttctatgatgggtcttgaatttttacccttctttccatttccattacacagggctctctgcctctggtcttgctcagtcagaaccgttctctaggactgtcagaattatctttccacatgtgattgtttataacccttccataattccactaagtgttcatgcttttaggcatgacctacaagccccattgtgttttcagctctgcttatcacttcagcctcttctccttctactcttctctgccattcatcaccaccatccccaaacatacccacataccaatacccaaaccacctggaacctctttactttccttaatgcaagatatttatccatattcattctctctctctttccttcttttcccccactccacacctttacatatgcagctctacttttgtctgactacttataattctggatttagctcagataccacctattttctgaccacttccttcccagtctagcttaggtgccccagatagcagccttgtgtgagtgtctctatcagaaaaatatattgtggctattcatttgcttatctgttctccctctggactttgagatttttgtgaatgctcaatcatctttatattctcagcaccctaaaatggaagtaggcctatagtaggcactgtataaatatatgatgaggccagcacagtggctcacatctgtaatcctagcactttgggaggcccaggctggaggatcgcttgagcccaggagtttgagaccagcttgggcaaaatagggagaccccgagaccccacttctattaaagataaacaacttagcctggcgtgatagtgcccacctgtggtcccagctactccggaggctgaagtgggaggattgcttgagccagggaggttgaggctacagtgagctgtgattgtgccactgtaccccagcctgggcaacagaatgagatcttctttcaaaaaataagtatatggtgaaagagtgaaggaattaaaggaaggagaaatgaaatataaattttactttttgccatctaggttcttttgttgctcaaattctagaagtattagtcatactatttttggattattgttttaatagacagggtaaattgtattataatatttaatcatatttccaagagtagaaggaacacttggggtcaagaaatttaaaaataatgagtaagaaatctcttcctgagatttccccaaattctagagagtagaaatcatagaaatcaactttttttctctgattatgaaaggaaaatttggctctctgtgaaaaggagagggagccagacgtattttgtgtaatgaggaagatagatgcccaaggtggtgcctgtgcctgtctgacctccccctttcctctgctgggctccacgcctcatttcagttccccaggctgctccctgggacacctgccctgagaccacacactgtgttctctttggtcccgcattgtcaaactttgtccagcccttttttgggggggatttaagtttttatgcctagtgaaactcccacatgtaaaggagtattctttcatatatgttgaatattaactggacaaaaccataaacctgcataatgacttaaggtattaaacaatggacctggctttccaaaagaagaatggctggttaaacagttactaatgcagctaaaaactgagacttggagtgtgagagagacaaactgatgaaaccgatgttctaaatcaaactgatgaaaaaggtttttaagaatcaccacaaaaaaaattatagatgaatttttctaaaaccatgatttatgaccagttggaggctgatggttctgcaaatgagtagtaggatcttcataggtccttcccagtaagcatcacaaaagatgaaaatgggccggacgcggtggctcacgcctgtaatcccagcactttacgaggccgaggtgggcggatcacttgaggtcaggagtttgagaccagcctggccaacatggtgaaaacccgtctctactaaaaatacaaaagttagccaggcatggtggtggatgcctgttatcccagctactcaggaggctgaggcaggaaaattgcttgaacccaggaggcggaggttgcaatgagctggtatcgtgccattgcattccagcctgggcgaaggagcaagactcagtctccaaaataataattaaataaataaaagatgaaaattgagtgagatgtatgatggtctaggagaggagcagtgaaaaataggatatatcatcaagtgctaggttgtgtgatacatattagtgtctacagaaatttaaagaacacaagagcagggccgggcatggtggctcacacctgtaatcccagcactttgggaggctgaggctggcagattgctggagcccaggaatttgaaaccagcctgggcaacatggcaaaaccccacttctacaaagtacaagaattagctgggcatggtggtgcatgcctgtagccccaactactcaggaggctgaggcaacagaatcacttgagcctgggaggtccaggctgcagtcagccatgatcgtgacactgcactccagcctgggcaacagagtgagaccctgtctcaaagcaaaacaaacaaaacccacaagagcatcgtgctctgggattagttgagggagactaagcagagagggtggatcttctctaggattgacagtcaaatttgtgaccaagagcactgcagagcagaaaacagatcatattgacttccctccacgtcctcttaattactacctgctttagttctttaatttttcatctctttcaactctaccttttttttccatttccatttttaacagcccagttcaaggcttttttgcctcagctgaaccttttatagtgccctcaacgctgtctctctttcaagaaacacatatccattccagagtcatctttccaaagcattgctttcatcctactttaaaatatttgtggggatttgcatttactgagcgtctgacaatacttgtaggagctatccattcatcattttatgtttgctttgccttcagaggtgtagccatattctaatatcaggggaaccagcctgggcagggctgtgttgttagttggcaggaatgctggctacggggagattacacacgcacacaagttactgggttgttttgttttgtttttttttgagacagactttcactcttgttgcccaggctggagtgcaatggcacgatctcggctcactgcaacctccatctcccaggttcaagcaattctcctgcctcagcctcccaagtagctgggattacaggtgcccgccaccacgcccagctaattttttgtatttttagtagagacggggtttcaccatgttggccaggctggccttaaactcctgacctcaggtgcttcacccacctcagcctcccaaagtgctggaattacaggtatgagccaccaccgcccggccaagttactgggtttttttctccccctgtaatgtctcgtattctgaccagtggtagtttacactgctttctcttacatttttaaatttatactgatatcatttaaaaaattgttgaaatgacttacttctggagaatatgttcaggggtcagtggggctagggaacaacttctcttcctgatcctccagcccaggcccatcgccatctcccaagacacatttctgcagccttcaagaaatgttttataagtgagtggggagagagagaaggagggaggaagacagagaaaaggagttggaacgggggaatgctataggagaatagaggaaagaatagctctagctgttctaggggatggggtacagaaaagatttcacagaaatgaagatatttgagctgagacaggagaattgcttaagacaaggagttggagaccagcctgggcaatatagggaggcctcatctttacaaaaaatttaaaaatgtggctgggcacggtggcccacgcctgtaatcccagcactttgggaggctgaggtgggtggatcacgaggtcaggagttcgagaccagcctggccaacatggtgaaaccccatctctactacaaatagaaaaattagccgggcgtggtggtgggtgcttgtaatcccagctactctggaggctaaggcaggagaattgcttgaacctgggaggcagaggttgcagtgagccgagatcgtgccactgcactccagcctgggtgacagagcaagactccgtctcaaaaaaaataaaaaaaaaaaattagccgggtatggtggcgtgcacctgtagtcccagctattcagaaggctgaagtgggaggatcgcttgagcccaggaggttgaggttatggtgagctatgatcacatcactgcactctcacacctgaaacagaataggactgtctctctaaaaaaagaagaacaagaagaaatgaagatacttgaattgagtcttgaagaatgggtgagaattaggtagtatgataagcttcctggaaaagtcaaagaaggtggcttgtgaagaaggtggcagtgtttagagaaggattaaaagcctggtgtgattggaggggtgtagtagatccaaggagggggaggaaaagaggttgaggatgacaggaaatggagtcagacttgggccagaatgtatgccgtgttatggagttggacttgatagatagtcaaacagaaagttgaccccctgacagctgtagtaaaccttgctgaggaagtcttcacttagtttaggaatttttttagtgataaagtgaaatcgcattggattgcctaagtgtgaacacagagcttctatgtgaatcatgttcaggaaaataaaggattagagtagtggaattatttgtgggtgttagagatgggaaattcaaactttcctgagtcatgtatggcttatgaaatggattaatggctcaatctttttttaaaaaaaaagctgcataacagaaggctgttcttatgaatgatctttcatcagttaaaacaaccgtgatggctggcaaagactttgccattgagcttgagactagacttacagagttttgacttctctgtaaaggcctcagtccatgaatgtaaaatattcccatctcctttaaaaggtgtaatatcctctaatattagataaaaatattagataaaagtgactcaaattctagttttagtggtaatagcctgcattttttttttactaattataattgactcatgaggcacattaaaaatatgagatcattatataattctcagtatagatgccagagattttctgcttcacttttaataccctttatacttatgaggtaacccttctgtgtttgaacacgtgtttcagaagcagggggtattagtttttggtcatgaggcgcattactccttatcaccccacctgcaccgcccccacccacacacaggcacacccttcataaggctgtacacactaacacctgtacacatgtgcatgtattcatgggttagcctaatagaaaagagtatttactcactatgcttgctagtagatattggaaaactccttctcaggatgtctccagtgtctggaatgaatgtgtctggaatgttacctggaatgaatcaggtataaccctctttgaagccaaagaacactcctaaattacctttaaagcatgtctttagtcattattttgtttgtttgtttttgaaacagagtctcactctgttgctcagggtggagtgcagtggtgtgaccaaggctcattgcagccttgacctcccaagctcaagcgatcctcccacctcagccttccaagtagctgggtctacaggcacatgccaccacacccagctgattttgtttgtctgtttgttttttgtaaagacagggtctcactatgttgccagggctggtcttgaattcctggactcaggcaatcctcctgccttgccctcgcaaagtgctgggattacagatgtgagccaccgtgcccagcctagaaataatttttaatttctgtaaacagatttcttttggattcttttaaaagtcttattgtgcctttaaagttgcttttataagatgtaagaatcataggatacatatttatcttttttctttcttttttttttttttgagatgcagtctcgtttttcctcctagactggagtgaagtggcactatctctgctcactgaaatctccacctcctgggttcaagtgattctcctgcctcagcctcctgagtattacagtattacacctgagattacaggtgtataccaccacacccagctaattttttttatttttagtagagatagggtttcaccatgttggccaggctggtcttgaactcctgacctcaagtgatccgcccacctcagcctcatatttatttttaaaagttcagcttctttctttggtatatggtataattcaatcgaatgacatcgtccaatgtcttctatctgatcaaagctgaagaatttctatccagtagtccctctgccttgtgatcttgggtgctgatttttcttttggctgaagaaaagccaaggttcagatgttctagtgcttcccagtattcgctgagtcgtctctggaggaccaggttggtaggcaggaggagggaggtttggaatctggctgaatctgtgcctgtttgtctaggaatgcagacatggagatgactctggagcgagcagtgagtatgctcgaggcagaccacatgctgccatccaggatttctgctgcagctactttcatacagcacgagtgcttccagaaatctgaagctcggaagagggtgagtgtcatcttcagtccattgcaaagcgcaacacactttcacttctattatggtgactttgcacactgaaaccaataatttatttaaatttttaaaaattgggaccgtgcgtggtggttcacgcctatattcccagcactttgggaggccgaggcaggtggatcacaaggtcaagaatttgaggccaacctggccaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcgcgccactgcactccagcctgggtgacagaacaagactccatctcagaaaaaaaagaaaagaaaaaatcaaccgggtgcagtggctcacgcctgtaatcccagcactttgggaggccaaggtgggcagatcacttgaggcaaggagttcaagaccagcctggccaaatgatgaaaccccaactctactaaaaaaaaatacaaaaattagccatgtgtggtggcacatgcctgtaaccccagctacttgggaggctgaggcaggagaattgcttgaacccgggaggcagaggctgcagtgagccaagattgcaccactgcactccagcctgggcgacagagcgagactcatcctgaagaagaaaaaacaaacaaaaacttaattgaggtcttttactttaaaagaaaacagccactcattaccaaaaatatttcctgcaattcggaaatgtagaaagtaagtcactacacaaatttccctcttcttttcctgtctccccaacctctccatttagaaccatccccagaggcaagggttttgcaactttttttcattcagtgattccattaacatttgtaacaattgttcaatgaattgctttgtgcatatatgttttgacacttctgttcctgtaggacagatcctcagagatggaatcaatatgttattttatatttgtcttaaaaagtgatacatttgtgagggaggaggaatcacagctcaaaaaggtgttcagtgaaaagtaagtctcttctactccaaactccagcctatatattctctctgttctgtctctttcaatctctctcacacacaaacacatatatcaatttttttatctttccagagatattttatacacgaagaaacaattgttgaaacagttgattgagtttcctttttaaaacatgaaatcataaatgataacttactacttataatactttatttttttataccgtatcttggaaatcttcaatatgtattaatcttactcattcttttaagatgctgcatagatttctgttgtctaaatgtatcagttttgttggttgattttttaactaccttattgaggtacaatctgacatagttttgacaggtttgacactaaaaccatcatcacaatcaagataacaaatatatccattacctccagcgttttcttgtgcccctgtgtaatccatataatccctccagccctcaacctacgaacagcctcccaaaacaaccagtgatctgctttctttctatgttttgagacagggtctcactgtgtcgcttaggctggagagcagtggtgtgatcacagctcactgcagcctcaactttctgggctcaagcaatcctcccaccccagcctcctgggtagctgggaccataggcgcacacaaccatgcccagctaatttttgtattttttgtagagatgggggtctcactatgttacccaggctggtctggaacacctggctcaagcagtcctccttcctcggcctctcaaagttctggggttacaggcgtgagccaccatgctcagccatgatctggtttctgtcactatagattgaattttctcgaattttatataaatggaatcatatagaatataagatttttttggtttgaattattttactcagagtaagtcttttgagattcacccatttcgtgttaatcagaagttttggctattacaaataaagctaccgtgaacatttgtatacaagtcttcatgtagacatgtgcttttatttctcttcagtaaatacctaggagtaaatgcctggatggtatggtaggtgtatgtttgactttttaagaaactgctaaaccattttacaaagtagctgtgccatttcacattcccactcacaatttatgagagttccagttcctcctcatcttaacatttgatatagtgagccttaatgttagcctgtaagtttgtacaggtgttttactgtggttttaatttgcatttccccaatgacaaaggggttgaacttttttttttttttttttttttttttttttgagaaaggatctgcctctgttgcccaggctggagtgcagtggcacaattttggctcattgcaacctccacctctcgggctcaagtgatcttcccacctcagcctcccaagtagctgggcctaccggtgcactaccacaccttgctaatttttgtattttttgtagagatggggtttcaccatgttgcccaagctggtctccaactcccaagttcaaaggagccagctaccttggcctcccaaagtgatgggattacaggcatgagccaccacacccagccagaacatctctttatgtgtttatttgccacttacatatcttctttagtgaaatgtgtattcaattcttttgcccattttgttttgttttgttttcttattattgaattttgtaagttttttaatattttctgtatacaagaccttttctagatatataatatgaaaatattttctcccagttgtgctctgttttttcattctcctaataggttttcattttaatgggatttaatttattcagttttttccctttatggtttctgcttttcatgtgtatccaagaaatgtttctctattcaaaagttagaagataatctatattttatcctagaagttttgtaaatgttatatattttagttgttctatggtccatttgtggttaattttttatatattgtaagatgtggactgaagttcctttttttggtatatgtaaatttaattgttcaggtgtcatttgttgcaaagacttttatttcactgctaaattgtctttgtatctttgctgaaaaggaattgatcaaatatgtgagtctatttctggactgtgtattctgttctattgatctatttgtctttttttttttgagacggagtcactctgttccagacaggaatgcagtggcgcaatcttgcctcactgcagcctctgcctcccgggttcaagctattctcctgcctcagcctcccaagtagctgggattataggcatgtgtcaccatacatggctaatttttgtattttttttttagtggagtcgaggtttcatcatgttggccaggctggtcttgaacttcttgcctcaagtgatctgcccaccttggcctcccaaagtgctgggattacaggcataagccactgcacccagccgattttttttttttttttttttctgagatggagtcttgctctgtcactcatgctggagtgcagtggcatgatcttggctcactgcaacctccgccttctggcttcaagtgattctcctgcctcagccttctgaagagctgggattacaggcaactgccaccacacccggctaatttttgtatttttggtagagacaggatttcaccatgttggctaggctggtctccaactcctgacctcaagtgatccactcacctcagcctcccaaagtgctgggattacaggtgtgagccaccacacccagcctgtaagattatttttgaatgtttactattcccaagtattatttcctaaatgaattttgagaaaattgattttttgaggataccatggaaaactggggatgtgaaacattcttacgtcctagtgcaaataaatatgactcaagtcaaccacatcctactttcaaaaagccttcacccagaaaggggccaacttctcatcatctgattcagagaaacagacatgttagataataatcccagagtaattagtcttcagcaaagatgaagactatttgtctgtcttattcaaattccacagtcttgattactatcgttttataagtctcaaaagtaggtaatgttagtccatccattttattctttttcaaagttttgtctattctacaacttcagcagttccatttgaagtttagaatcagcttgtcaatttcttaaaaaataattgctgggattttgttagagattgcactgaatctgtagatcaatatggagagaattgacatcttaacaatattgagtcttgtgacccatgaccatggtacatgttaacatctatttaggtcttcagtttttctcagcagagttttatagtttttactgtagaggtctttcatgtcttttcttagatttatccctaagtttatcatatttccagatgctattataaatggtactttttaatttctatttttggttgttcattgctagtatatagaatagataatatatatataatatatatatttacgtgtgtatgtgtgtgtgtgtgtgtgtgtgtgtgtgtatgtgtatagtacttgctagaacctctcctacaatcttgaaaagaagtggtgagcgtgggcatattatcctgtttctgatcccagggcaaaagtattcagtctttctttcacccttaaatattatgctacctgtaggttttttataaatgaccatatcaagttgaagaacttcccttctactcctgctttaatggagtttttgaatcacgaatggatgttggatttagtcagatgctttttatgcatttattgaaatatttttatggtttttaattttaattttgccattatggtaaattaccttgattgattttaaaatggtattccattcataaaccccacctggttatgatgtactgtcactttgtaggttttatgactagatttgctaaaatcttgttaagaaattttacgtctgtgtaaaagacatgatctgtacttttagtgtctgtctgattttgagttgtgggtaatactagtctcatagaatgaactgggaagtattcccttcttttcagttttttgaaagagtttggttagaaatggtattatttcttccttaaatgtttggtagacttcagcagtgaagacgtctcagcctgaagatttttatgtgtgagaaggttcttagctgcaaattcagtttcttgaactgctgtggggctgtttagactatcagtggcttttttagtgagctttggtaatttgtgtctttcaagggagtctttcaagggatttgtccatttgatctaagttgctccagtgctctttatttgtttgtgtagatagtgtgatcctttacctttacctgaaaatttttattttgttttgttttttacgaatccacttttatttattattgtttcattagtttaaatccttgaggggtacagcatcactcggactctgtgtccaatagctctagcaggaagattgcttcggaatttggcacaaaccatgccactgtgttcatgcgcccaagttacctttccccagattactctggttttgtttggtttgctgccaggagtcaccgtgttgttctttgctttgtatacataaggacatctcttgcccaagtagaattctgtttcatctcgggcataaacacctttaattttaagaagagatgtgttcccttttgttctggagaccgcacttatagccagcaaaaatggcctcggactacagactgctttccagtcgtatttccatttagaacatttagaagtcccgttcctagccggtctccacaggatccaagatggcgaggcaagaatacttctttatttctttctttatttctttatgagacagagtctcactctgtcacccaggctggaatgcagtggcgcgatcttagctcactgcaacctccacctttcgtgttcatgcaattctcctgactcaacctcccgaatagctggaattacaggtgcccgccactatgcccggctaatttttgtatttttagtagaggtagggttttgccatgttggccagtctggtctttcactcctgacctcaagggatccacccgcctctcaaagtgatccacttgggtcctcctgaagtgatctacctcccaaagtgcagggattagaggtgtgagccaccgtgcccagatgatctgaagaattttcttttcttttcttttctttttgagacggagtttcgctcttgttgcccaggctggagtgcaatggcacgatcttggctcactgcaacctccacctcctgggttcaagcgattctcctgcgtcagcctcccgagtagctgggattacaggcatgcgccaccatgcccggctaatttgtatttttagtagagatggggtttctccatgttggtcaggctggtctcaaactcccgacttcaggtgatccacctgccttggcctcccaaagtgctgggattgcaggtgtgagccaccatgcctggcctacctgaagaattttttttaaatatttattttagttcatcaccagcaaacctgcattatttcagcttctgtatgtctgaaaaagaatttcatctttgcttttgaaaggtattttcactggctttagaattccaggttaacagtttctaaatattagtactgaaagttggccacggcgtggtggctcacgcctgtaatcccagccctttggaggactgaggcgggcagatcacttgaggccaggagttcaagaccggcctgggcaacatggtaaaaccctgtctctactaaaaatacaaaattagccaggtgtggtggcgggtgcctgtaatcccagctacttaggaggctgaggcaggagaattgcttgaacccaggaggcgaaggttgcagtaagctgagatcacaccactgcactccagcctgggcaacagagtgagactctctctctgtctcaaagaaagaaagaaagttgctccactgtcttctcacttgcatcacttgcattgttttagataagaaatctcctgtcatccttatctttcttcctccatacatgagtcttttcttcccacctctggctgcttttaagattttctctttcttactggtgttgatcagtttggtcacatgtgctttagtgtagtttctcttagttttttgtgcttgggagttcactgagcttcatagatttgtgaatttctactttgcatcaaaattagaaaattttcacagtttttctattcctcctttgggaactacaattacatacacgttaggcttctttagatctttcttttttagtcttctttctctgtgtttttagataagttcaattcctatgctttacatttgctaatctcttaatatgtgtttaatatgccattaatacattaatgtgtttaatatgccattaatcttactcagtgtattttttcttcatacattgtagttttcatctctaaaatttagatttcagtgtttttatgtcttctatgtttctatttaacatgttctatctttgctcaagatttttgaacatatggaagacagataaaattgctaccttaatgtccttgtctgctaattctaatatctgtgtctattctaggtagcttttgattgattggtttttctccatattatgggtcatatttttcttcttctttgcatgcctggcagtttttattggctcctaggcattgtgaattttatcttgttggatgctggatatttttgtaaatattcttgagctttgttctgggtgcagttaaggtgcttggaaacagtttgatcctttcaaattctgctttgtttgtttgtttgtttgtttgttttgagacagagtcttgctctgtcacccaggctggagtgcagtggtacaatctcagctcactgcaacctccacctcccgagttcaagtgattctcttgcctcagcctcccaagtagctgggattacaggcgcatgccaccatgcccggctaatttttgtatttttagtagagatggggtttcaccatgctggccaggctggtctcaaactcctgacctcgtgatctgtccaccttggcctcccaaagtgctgggactacaggcatgcaccaccgcgcccagaccaaattctactttttaaaaaaaattttacttgaagctttgggatacatgtgcagtgtgcatttgttatataggtatacatgtgccatggtggtttgctgcatctatcaacctgtcatctaggttttaagccccgcgtgcattaggtatttgtcctaatgctttccctctccttgccctcaaattctacttttaagatttgttaagtggaaccagagcagcatttattctagagataattaatccctgcttcttaaggcaagacacttctgagaactctatctaatgtagcaggaatttttgagatttttctggctggctgataagaatagtcattgttcctaggcctgtgtgaacatgaggagctgttcccttaaatccttttggatgattatttccctggcctcagacagtttcctcataccacatgtactaattaatactctactgaatactagcaggcaggtcctctgcacatctcaggagttctgtttctgttcagctcttttctctgtggtactcttttctgcaaaaattagctcctttggtcttctcaaactctgagctctgtgccctcaactctgttgagtttcacttaagttttctctcactgccccatagcctgggaactctcccaaggcagtgatatctaagggatcgctatccatcatttactcattttcagttattgaaaccattgtatgttttgtccaatttttgtttcaggcagtaagttgagttgttagttactatcgagtcatttttaattttgataaataactccccaataagtcctcccaaaaattgtacaaatttacactcccatcaacattttatcagagtgttcatttccatgtaccattactaccacaaggtattattcttttgtttgtttttgttaatctgataagcaaaaataggcatttcattatcatagaaattttcttatatttgaaatcaagactaatagttgtccaatcaaacagttattgagggccaggtatagtggctcatacctgtaatcccagaactttgggaggccaaggcaggcagatgacctgaggtcaagagttcaagaccagcctggccaccatggtgaaaccccatctgtgctaaaaatacaagaattaactggcatggtggcatgcacctgtagtcccagctactcagaaggcagaagcaggaggatagcttgaacccagggggcagaggttgcagtgagccaagatcatgccagtgtacttcagcctgggcaacagagagagactctgtcacacacacacacacaaaaaaaaaagttactgagaaaaatattttttaaaatgataaaataaacgcttttatagaatttatcatcatcttgcatgcataaactatgcccattataaatcatctgccatttttagtttaagtttaaagtggaatgagaacttaatggaactaattcatctgagttcaaatcctagtctcttacattaattctatccatcactaattacagagctctcttaagcttttcacctttatctagtctttccaaagcatcaaattaattttcagagaaataagtactctttctatacttatatttcatccatttatagaataggtaagtaaattacataattataacaaatacaattgacataaataccctgggaagcaaacctaaattactgttggtaaacatgtaactcaactggtagaaatagaagtgcaaaggctcaaatagagtaacctaccagctttgatagtactctgagaatcaaggaggtttcacagagggaaaagagaatgttgttggttagccttgcaggtcagtcaagtaaggatcacacaacagagcttctgctgatttttttttcacttgaattcattaattattcatgaagttgagcaccttttggtgtggtttttgactttgtatttcttcagtgaattgtcatttttaatccattgtgtattttttctactaagatatatctctttcttaatgacttacagttctttacctattacacatattaatttgttgttacatatgtggcaaatagtttctcctgctttatttttgttgttgtttttaactttgttttttgtatctttcatcatgcaggattttaaaattcttatgagatcaaactaaatatttttcatctcgatgtctatattttagatattgctttaaaagacctatccctacatctagactttgccgtttcaaaagttgtataattatggagcatttctcactgaccctttgcctatttgttccgtaggaagaatgaataaggattttagaagacatttagctagtgatgaacattctttatacatataggtgaagggaatggggctgaatattgatcctttaatagctagtcagagataaatctttaaatctttttttattcctggttttttggggcgttttgtttgtttgtttgagacagggtgttgttctgttgcccaggctggagtgcagtggtgtgatcatggctcactgcagccttgacctctgggggtcattcctcccaccggagcctcccaagtagctgggaccacaggcatggactcgcctggcttttatatatatttatatatatatatatataaatataaaatatatataaatatatatatatatatatatatatatatatatttttttttttttttttttttgtagagatggggtctccctgtgttcccagggctggtcacaaacccctgggctcaagcagtcttctcacctcagcctctcaaagtgctggcgttataggcgtgagccaccacaccagggcctattcccagtttttaaaaactgggcatcattacgtatgcttcgattttgtagtacaaattactggaatttttattctgtttcccaagttgggctagatttctactatctcttaaattactaatttgattaaaaatatcattttgcttatacataggattgaagttgtttgctggcttgactgtcactcagagataaaggtagaacaaagactggttttgagaatgatgaaacatgaaaattatatgcaaacctaaaaatgtatatgcttcatagaaaatctaagaagtataatatcacaacccaagaacatttgaaaaatccttcttaggttaaacatggtgctatagtttttaaatgtatgtataagagaaaattataatttggacatagagatcaaaattttaaatcataatacttttaaaaccagtagcagcttttcagtcctcattttgtttgattaggattcttggtatttgacgctgttgatctctctctctctctcttttttctttttttttgagacatgttctcactctgttgcccaggctggagtgcagtagcactatcatggctcactgcagcctcaaccttctgagctcaagcagtcctcctctctcagcctcccgagtagctgagactacaggtgcatgccactatgcccagctaatttttaaacattttttgtgcagatgggatctccctgcattgcccaggctggtctcaaactcctgggcttaagcagtcttcccaccttggcctcccaaagtgctaggattacagacatgagctgttgcgcctggcctgaacatattatcttcttttgcttttcttctctactctccaaccctccctctgtcctgttgggctgggaggcaggacattggtggtttaatcatggactctgaagagtcactgctagctgagtttgaatcccagcaccctaattacataggtgcccttgggcaagatattttacttctctgagcttcagctttcttacctataaagtagaaatagttctcctaccaagagttgtcctgagaatgcagtcagataatggtgcactgcctgccacaaggcaataactccgggcaaattgttccctgtcagtgaacggtaggagggtggttcacccaggtaatttcacaccaaaacgtgaacactctttgaatcttcttttttttttttttaattatactttaagttctagggtacatgtgcacaacgtgcaggtttgttacatatgtatacatatgccatgttagtgtgctgcacccattaactcgtcatttacattaggtatatctcctaatgctatccctcccctttcccccttccccatgacaggccccagtgtgtgatgttccccgtcctgtgtccatgtgttctcattgttcagttcccacctatgagtgagaacatggggtgaaccttcttttttccttacctctcatagtcactcagtcttcaggtcctgttaatgctacttctaaaagtatttggaatctacccacatctttccctccctactcagagatactgtcttggtcccagcaccatcttctgttaatccagctgtctccagattaacatccctgtctccattcttatccattcctaatagtctcatgcttcacagcccccagggagacctttccaataactgcccccattgcctgcaggataaaagacaaatcccttaatttagtctgtaagacccttcttaacgtggtcttattttcatgcctgtttcatatctcatcactgaagtagtcactgccataagtatcttgcaaaaacttactataaaacaaattcaagtttttgataagaaatttgagaaattaaaaaacaaaaaaggaaatgcacccataatctcaccattatcattttggttttgttctctaatttttaatgcatatacttacatatcttcaatcaaattgcatatgtagctttctttgtccccacaaaaaaaaatttttatttcgatttttaaatcgaaataaatacaggctcattatttgaaaacatagaaaatggcagatcctatttatgattcatacatttaccacttctcccaaattccctaatctcatttcctttttgcctgtgtttatgagtagaaattcatagatattttcttccttttttttttttttttttttttgagatggagtctctctgtcgcccaggctggagtgcagaggcttgatctcggctcactgcaacctctgcctcccgggttcaagcaattcttctgcctcagcctccccagtagctgggattacaggcttgcgccaccacacccagctaattttttgtatttttagtagagacggggtttcactatgttggccaggctggtctcgaactcctgacctcaagtgatctgacctgcctcggccttccaaagtgctgggattacaggcgtgagccatcatgcccggccttattccattttttaaatgacatatgaatttttataacattaatattttataaatttcagttaacattgttaaaggtgatggtagttgctaccttgtgttgagtaactactgtgtgcctgacatgtaactgctcatcttacacagtaattcccatttgactaatgagggaactgtatggctaataaagtgtcagctctgcctctcccgtggatacctcaacatgtgggtatgtgacaaccatcaaccagtcttcccccattgctggatgttaatggtttcttattttctgctattacaaaagatgtagtcactatttttgcatgttagtctgtgtcttcatttcacattgtttcccaataaaagttactagaagtgaatattttaaaagttttgacacatattgccacttgccttcctgaaagattatgccagtttacagggagtgattaattctaatgggagggaaagcagagaaaggagtgacatttcatagaggaggtgacatttgagctggatcccacaggatgagtagggctttgccagaagagaggcagagtggactgaaccttccagacaggaggaggaagcaagagcaaaggctccaggtctggagagagcctttgcctcagcagaggctgtgtgttccctatgcttatttgcaaccagaagtcctcgtcatttacttattttataattggcagggaagatagaataaagccacagagagagttaaaattctcatatgtgactctgccctttcatgtatttagaaaccaactcaaatgagaacttctttgaagttctgaaacattcatggtagtctatttcttttttccttttcccaaaggagggaaaaataccccgaggattcagtataattgggaaactcatcaaacctccctggttccagctgcttccctgaacgttaagggacaatagcagcatatttgacattggtcctaatgtggataggattcatcacctaccatcttctagttacatgcaaggagaaggtcattaactttttgcatttagcaggatttatatccatttgcttgataaaatggatgaaagtaactaaaatctatttttaagcttgggataagtgccagacactagggagtcaagttatacagtaagtagagctgtagccggatttcggcctttatctaagcactggtatgtctgtagttctctctttccgggctagagcaagtgctgaaagccaaggtgataaaggtgacagggtaagggagcaggtctgagctggggaggcttccgtatgccacttcttactaattctatcattgcagcttgaaatgcaatatggccagtaagccatttcccatcatattttgaagaaagcaacttataaattatgaattaagttaataaaatatttctaaagctgccaaagtacctcaggacaaataggattttttttgcatctgatatatatactgctactgggaggatttggtatatctggcattcatgaagcttataaagtgtgaatgtatattatgaacttatattttcttaaaaacctaaaaacaggcactgtgccacagtagcagaataacagatcgtacccagaagacacgggtatatatcccacagtgctattttgccagtcaaggcctttctttctgtagtttaacttattaaaaggaggaagccagctgggcgcggtggctcacgcctgtaatcccaacactttgggagcctgaggccggcagatcacctgaggttgggagttcgagaccagcctggccaacatggcaaaaccccatctccactaagaatacaaaaattagctgggcatggtagggcgcgcctgtaatccctgcaattagggaggctgagtgagacaggagaattgcttgaacccagggggcggagattgcagtgagccaagatcgtgtcactgcactccaacctgagcgacagagcgagactccgtctcaaaaaaaaaaaaaaaagtatgaatttaccttaaaaccttaccatgaaataaaaattagggaattagggaaacgtgaattacaggttgttttaacataaattgtgtattttggttttttttttttttttttcgtttaaggaaatgtaatacaggttaagtatcacttatccaaaatgcttgagaccaggagtattttgaatttagggtttttcagattttggaatattcgcattacattggttgagcattcctaatccaaaaatccaagatctgaattactcccttggagcattatgttagcattcaaaaagtttcagattttgaagtatttcagatttcagattttcagataagggatacttagcctgtaataggaatagatgaagtgatgaaataatctgttggaccagatttacttgacagctaagaaatattttttttgagatggagtctcacactgttgcccgagctagagtgcagtggtgccatttctgctcactgcaagctccacctcctgggttcaagcaaatctcctgcctcagcctcccaagtagctgggattacaggcacccaccaccatgcctggctaatttttttgtatttttagtagaaatggggtttcactatgttggccaggctggtctcgaactcctgacctcatgatccgcccaccttgacctcccaaagtgctgggattacaggcataagccaccgtgcccggccagctaagaaatctttatcatgcatttaaatggctttagacacagtccaacaaaattgctgtggccactctcccatctgtctcttgttctgcaaatgtctcctcagaagggagccagcaagtggaagtatttactccttattacgtccagtgaagccttaaaggaatcaagagtactttcttcttaaggttcttgcaatctattaattagataatgtatgtaaaactcctaacattatactgacgcttcttaatgttagaagtaggagggagaggagttgtaatttttgctttattatgatgactgtggttgttattgttgtggctattatttagattgttttacatttctgatgtttatttccgcctttctagtcttttctccaatcctgtcaaaggaatatgtaatattggagggctgtgtcctaaataccatttacctgtctatgaaagggaggctagaacttggtacatagaaaatatgcaaatctgcccctggccaggcgtgcagctctccgctgagcataaactgctggtagttagggtgtccttcctaagtgacaaacttcgtctgaaaggcaagttcatgcccgttcatgaaaacttatttcctcaaaatttcttcatgaagatagtgaaaatgagatctttaccaacagctcttggcaacttaaaagtttcaaaatcagatgtgaatggaagcctaagagaaggaaagccttcagtctacaacctaatgttttatttcaccaacgctgtgtctgatttctttagatcatattttccgactaaaacagaaaatctccctgcttagattaggattatttggccccttcttagatcaatttgtttcccattcctggttgtgccctttctctaatagcatgcgctttcttacgtatttggatagaaggaatattttttaaataacacatttaaaagtgtaaaattattttatctgcttaaagtgcttgcataagttttataagtcttttaaaatactccatgcaattggttataagaatttagggttagtggccgggcgcagtggctcacgcctgtaatcccagcactttgggaggccgaggcgggtggatcacaaggtcaggagatcgagaccatcccagctaacatggtgaaaccccatctctactaaaaatacaaaaaattagctgggcgtggtggcgggcgcctgtagtcccagctacccaggaggctgaggcgggagaatggtgtgaacctgggaggcggagcttgcagtgagccgacatcccgccactgcattccagcctgggtgacagagccagactgcatctcaaacaaaaaagaatttagggttagtttgcattactactgaggctgacatggtaaatgcatttttatttctgttaatgaaagtgatactattcattttatatggactataaagttttgtcttaggaaaaaacttacgtaattttggattatttaataaaaaaaactctccttactgcctagattcccaattcttttcatttttattatgctccaagcttttatcacttaactttgtttaactagtacctatgcaccctttatcacttaatcttccccttcaattatttcataggtttcagtcttaacttcccaaatgtactataagttccttgatgacagatactgccttatagccggggtatattctacaagagcctcagttgtgctacacatagttgttgatgaagaaaggttatagtcagcatcagtaaacttcatctgtttgtattacattgaatgccttgatgccacatcaaaattaatattagaaatatgcatctgcttcttccccaggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtagtgcttactgaacattgaagaacctaacacatttgcaccccagccagatgccttacatcatctctttttcttaagtttcctggagcaaatgattgatgggctcattgttatgctagagaaggctttaaaggaacattgttacctgctggcttagactccagatttgagccacattcgaattccttttttttttttttgagacagaatcttgctctatcacccaggctgaggtgcagtgactcaatctcagctcactgcaacctccgcctccagggttcaagcaattctgcctcagcttccctagtagctgggattacaggcatgtgctaccacacctggctaatttttgtatttttagtagagacgatgtttctactaaagtttagtttcaccatgttggccaggctggtctcgaactcctgaccttgtgatccgcccgcctcggcctcccaaagtgctgggattacaggcatgagccatgagccactgcgcccagcctgaattccttttttctaaaggggaaaatgttctgcggcttttgcttaatattcttaattagaaactctatgcacctttgactaaatgtctttaaaacaatttgacaagactcactgcaatgaaaattctgcttaaattcactaacagcccactttgtagtttaagaacgtgtaggatttcactgttatcctaggtgtcccaaactaaattttggtttctttctttctaaagaaaactgacaagaaccacacccagttgtttgtattatttactcaacaaccagcttgctggatctatagaaaatgaaatggagtgtcacatagttttccagtgtggaggatcaatgtaatcaaatattagaaactgttttttccaatctttccattatctggactcctctcagtaccacctccttagctcactgaaaccttaaagaagaaaagagtaactggatatgtttgtttttttaattctctacttcacatttttgttcaaatactgattggagcaaatgtctcctttttatgcaatgaattggagagatggactaatcagatagaattaaaacagcagtgttagtaatatgtcctctaagcatgaagagaaggggctactttcatttaaatgaacagtcgtatgataaaagagaagatgatttgttgatgttccagaataagcactctccctgccatcaccatcagctctccgcttgtgttccctgcacacagtacaaagagtacaggaggggctgggtgcagtagctcatgcctgtaatcccagcactttgggaggccaaggcaggaggattgcttgagcccaggagttcgagaccagcctggccaacatagtgggaccctgtctctatgaaaaataaagaattagccaggtgtgttagtggtgtgtgcctgtagtctcagctattcaggaggctgaggtgggaggattgcttgagcctaggaggctgaggctggtgcagtgagccatgattgcaccactgtactccagcctgggcaacagagtgagaccttatctcaaaaaaattaacaaagattgcaggaggcataactgagtgcaatcatcagtaaatttttgttaaatatcttcaatgtctcagcgatatacgtacattttctaatttaattatcacagaaaccttgggtttctaggtattatcaggtgctatatctcaattttacagatgaggaaaccaatgctcaaagaatatacatcatagaagaggtttttttttttttttttttaactgtgtaatagttgacagtgttctggtaaatacttttaacggaaatactccacaaatattgttttaaagtaaattgaatatattttgctcttctacctgcttcatttagttatataataggtttaatttttctataaagattttgtcattatgttatctctactcgctttatgtcttaaaatatcacattttaaaaaattcaacattcattttagatttggggttacgtgttcaagtgtgtcacatggatatattgtgtgatgctgaggtttgggatacgaatggtcctgtcacccaggtactcagcatagtacccaacagatagtttttcaacccttgcccccgtcctttcctccctcttttattcatctttaagtccatgtatacccaatgtttagctcccatttgtaagtgagaatatgtggtatttgattttttgtttttgcattaatttgcttaggataatgacctccagctgtatacatgttgctaaatatcacattttaaattctgatatattttaatgttataaaactatgtgaggtaccatgctactctctctattctctttttctttttgagacagagtcttgctctgttgcccaggctggagtgcagtggcatgatctcagctcactgcaacgtctggttccagggttcaagcaattctccctgcctcagtctcccaagtagctgggattacaggtgcccaccaccacgcccagctaattttttgtatttttagtagagacggggtttcgccacgttgatcaggctggtcttgagctcctgacctcaggcgatccgcctgcctccgcgtctcaaagtgctaggattacaagcgtgagccaccgcgccctaccagtaccatgctacgctcttgccagcattctgtcaggtcccatgagggatttcttttcatatccatgatttgtattcaaatgcctgtagaaattaaaagtgattccattcatttaaccaacatttacagagcagctttcaggggtcaggtactgagaatcacagcctagggacggtgtggatttggggtttttttgtttttgttttttttaaaggatggggatctcgctgtgctgcctgggctgttcttctgggctcatgagatcctcctgcctcagcctcctcagtagctgggactacagggacatgccactgcacccgcgttggattttgtttctccatctactagttttatagtcaggaaatacttcctgaaggggttatgtttcattgtggaccttaaaaaaggaataggctttggattggtgttttgaaagaggatgaaagttattcctggcaaagtgagcatcactagcaaggcaaagaggcagaaagaaactagctgccggtcatttagaggagacatggaaaatagcgtgatttggagttagggtgcctggtagttagaaagcttgggaagtgtgtgtgtgcttgcgtgcgtgtgtgtgtgtgtgtcaagggaacaagccattgaatcacgcttcctcttctcctgcataggcaataggagactaacgtcagagaacattctgtgatgttgatgccatgtgaaaccattcaggcatcattagatcatctatagagttgataaatggaagttgattgtgcagcacccaggatttctagtataagccaaacatccctactggagggtgttcattacatgctaattgaaccaaacagacatttgaacatctgatacaaatccttctaaattactccctttggctctactaatagaagagctaaataagggctttctgggcctcagaaataaattgttaacctaatatagacatgtttatatctttgtttagaaacacaaagaaagtaagtatatatgtgaatcttactggtctatttctttgaccttttttttttctgaacccctattatgtgttggtcactaagctaaggctttctgtttttttatccctatttctcctgacaactccgtaagaggtgaaagcataattggtgacttacatatgatcagtgtgagactcagaggggttaagtaaattgcccaaggttgcctaaatggtaaagaacaaagcccaggtttgaacctagttgtatctgagtgttttgctgtcaccccacctacttttgaggcacgtgatgactcatttgtatagtctttgagaaggggcttgtctttgagactcctctgatcagagagctcttcctcactcctctgacacccttcctctctcttcttttttttttttttttttgagaagaagtttcattcttgttacccaggctggagtgcaatggcgcagtcttggctcactgcaacctctgcctcccagattcaagcgattctcctgccttagcctcccaagtagctgggattacaggcatgcgccactatgcctggctaattttgtatttttagtagagatggaggtttctccatgttggtcaggctggtctcgaactcccgacctcaggtgatctgccggcctcagcctcccaaagtattgggattacaggcgtgagccactgtgctggcccctctgtcttcttgtctctgccttggttcaagctgtcttcatctctcgctctacttctgcagtagtagcctaggatcttctcttctaatgaaagaacttcaggatcaaagacacccccactccccccaccccggtgagattgttctttctcccttactaagtgagcgtggtagtgttcccgtaattgaaatgagaacggcacatcttagtctcagaagttcatcttcaaggtcactgagtagtgagcattggctggagtgagcagggatatgccttggattaaaacggacaagtcatgataagagtgcagcaggggttcttatccctctttcattacatatgaaagagtcagggtaattgtcagtgaaatgtgttaaaactgcatattaatccctgcatattttatagaagtacttaattggattgctgtatttaataaaatactcagaatgttttgctataaaatatttattatgcactttctttaagtaattgtatattattttattccgcattcgtaatgtgtaacaaggtaccctgggtttatatataacttggaatacgtggccgtttcaataatctgatattccagttaagatttgcaaaatttaggtgaaaggaggggtatatctatgcaagggaaattgtaaataaataaaaaaaaattcctcccactctttgaccactttgaaaaacacggttaaaaagaaccagttttctttcttgtccttgtccgagcggtcattgtcctcatctctgcctcctcattctttttcactgaagatagggatttatttaatcataaaacttgtaagttttgctgcctatgtgttaaggcagatttgttaaattactatattttctgtcctagaggtcattaatttttttattattatttttatttatttttttgagacggagtctcgctctgttgccgaggctggagtacagtggcatgatctcggctcactgcaagctccgcctcccgggttcacgccattctcctgcctcagcctcccaagtagatgggactacaggcacccgccaccacgcctggctaattttttttgtatttttagtagagacgagttttaccatgttagccaggatggtctcaatctcctgacctcgtgatccgcccccctcggcctcccagagtgctgggattacaggcatgagccaccgcgcccagccgaggtcattattatttaacatgagttgtaatatctaagctccctttactggttagctattttttacaaacatcacggttggcagtaaatttctggctaatggagttattgtctcttataattggtaattattctaattatatcccttaacagagtccagatccctttctttttggctagaatgagagcctcatggtagaaaattacaggcagacagaccatctgcaacaaagagctatactagtagacattaagacactatgaaaaaattgatcagaagttaaggatgagacacatgaaaacccaaaccgtaaatattatattaggtaatccagaatctgatcattgaagggacatctattcagaatcatctagtctattggtttcctcatgcccaaactggaatctttttttaaaatataagttcctgaactccatcctgagactctggctcagcaaatttggggcatggcccaagactgtgagtctgttttgtcactgggctcatttggaaactgctcatctagtctaacactttaatttcagggtaaaagccctcatctactttctgataagagataagctaatttttattccctctagtgatagagctgggtcttacaagtagttctttctgttttcttcaaagctctcttagaagtttatactttcagtgagccaaaatctccttctttagaatttccactcatcggttctggttttgcctcctctagtcatggaaaatgatatctagttgtttaaatttgtatttctttagttactagagaacatggattcctgtgtacattagctcctaatatcagttggttttgtgttatgtaccttcccaatttttctactggtgtttcgctttttagtgatttataaaaattctatatattaagagtattaaacttttatctcatattgtacatattttcccagtttgtagttggttactcactgattttgtgtgagggtatgtgtgtatgagcatatgtaattctgaatctctattgaacatcttagttctttcacagctttcatgccacccagaaatttgacaggcatgacatttctatgcaaaatcctatattagaaattctaaaattatgctgaaacttccaaaatcatatacttttgtagaaataatggagcatggcaagctctaaaggatattgactgttgaaggaaaattccactccctttgttccaattaatcctctctggtttttattgtaaggtgtactttttctttgagtgtcctgtgtggtcctttttaaaaggaggaaatgtcattatgcttcacattcttaagcttctggcaggcagagactattaatttgtttgcttatttaggactaaagaagcttttgttttttttcttcatttctctcttctttctaacttgcttttgtagcttagtaaccaaaactcagcctcagacttgtctttaaattgttttcaaccaccttctgagttttatctgtccctcttccagggcctcttaaggagaagcaggaggaatgaagtcattgtattgcaaaacctgtggctgagggacactgctccttaaccccaaatgctagtttgatcaggaaaatacctcctcataagccagaaatctagtcctcacaagacaccagacacagtgtcactgtatctaatggaagctctgtgtaggctccagtggaaatctggttacagtttcaaaaagtagctacctgtgcacagcagaagcaaactgtttaagcccaaaagactgcatgaagcctaatgtgttctaattggttggaccaaatataagtatgctgagtaattaccaagctttaactatacaggctcttatttcaggggaggtgatgtttgccacatagttcagccaagtctgccacatttgctgtgttcataaaggagcctgccctgagtacctatgcttcctctttcctttgtacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtgagacccctgtctctactcaaaatacaaaaaaattagccgggtgtcgtggtctgcgcctgtaatcccagctactcaggagactgaggcaggagaatcacttgaacccgggaggcagaagttgcagtgagccaagattgtgccactacactccagcctaggttaccgagtgagactctgtctcaaaaaaaaaaaagtaggaattgctgggccaggcacagtggctcacgcctgtaatctcagcactttgggaggccgaggtgggcggatcaccaggtcaagggttcgagaccagcctggccaacatggtgaaaccccgtctctactgagaatacaaaaattagccaggcatggtggtgtgtgcctgtaatcccagctactcgggaagctgaggcaggagaattgcttgaacctgggaggcagaggttgcaggtagccgagattgcgccaccgcacttcagccttggcaacaaagcagtactccatctcgggggagaaaaaagaagtaggaattgttgcctgggcagtgagaaggatagggtagaaagggaagagtcatcccttctctttctgcccctcttctccttttcctgggcattagtgagttagtgtaacccattacggtatgaaagataatgaggcgggccaggcaatggctcatgcctgtaatcccagcactttgggagatcgaggcagcagatcatttgaggtcaggagtttgagaccagcctggccaacatggtgaaacccgtctctaccgaaaatacaaaaattagtcaggcatggtggcgggcgcctgtaattccagctacttgggaggctgaggcaggagcattgcttgaacctgggaggtggagattgcaatgaaccgagatcaagccaccactgcactccagcatgggcaatagagtgagacgcagtctcaaaaaaaaagaaagaaagatgacgaggcaactttacacctgctgggagtccctggaatagcaagcaatcagtgtacagtcttccttccactgaatcagaaggattcgagctccaaatttcaaaaacaaaaaaaatcctaaacgtatatgccactttctattttctctcagtactcagcctcagtctgtatgtcacagtatataccttataaagtacaacatgctattatctcagtttcttctggattggcctatatggtctttctctttaatatgggggattcaagaggaaagagaaaatttaatgagtaaatagggtactaatctttgagcagtacttaggccatgcaagttggccaatagggaagatgctgttgtctctccttcactgccaaactataaaataaggatacatgaggtagccagaataaattgctggaggacatgattctgtcattgggtaacagtcaataacattaattggtgatgttgatcagcttcctgttgacaggcatggagaaaggctttctgcagaccttccctgctcttactgggaggcacaatgtcaggtgaaagttacagttagtggggaaggaggcagggaagatattttcccatgtgtatctaagggagaaaaaaatatgactctttaaaaatgttgaagttttagttacaataggaccattttaagcctgcctattggtgagcccagactttattatcccggtcaggtcagctttgtggtagggccctttaggagaaacagcaataaatgcttaagcatgtctggcctttatttgtatatctgattagtttaaacctgcacagtttgtagcctaagccatgtatttattgctcatgtgggtcagcctccatcaccatctaatgagttctaattgggttcttctagttgagaaagaggctggccccccaaccccccaaatttttttatgactagtcatagccctggagttgatggccttgactgaacttttcagcggtcattttggtcccaccctgcactgttttcatggtaactctgtgcttttctaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaaggtaatgctacctgtaccctgccctgatagaagatgcaataaaaaattaggtagccccaaggaagtcaggatatattctgcctttggttcttttctagttacacagtttgtttgatggtttgtttattttatttatttatttatcttttttaaaacagagtctcgctctgttgcccaggctggagtacagtgatctacctgccttggcctcccgaagtgctgggattataggcgtgagccaccgtgcccggcctacacagtttattttttgagagactttatttggatggtaactgaaagaatttattatgataagatgtttattttatctccatagttaatcacacagtaatacatatcaaataccaattttgtgtaaagcattatgttagctactgaaggctatacaaagatgaataagaaaacccttggctgggtgcggtggctcacacttgtaataccagcactttgggaggctgaggcagaaggatcagttgaggtcaggagttcgagaccagcctaggcaacatagcaagaccctgtctccacaaaaaaatgaaaaaattagctggacatggtggtgtgcacatgtagtcccacctactcaggaggctgggacagagaatctcttgagcacaggaggttgaggttccagtgagccatgattgcaccactgcactctagcctgagtgacagagcaagaccctgtctcaaaaaatataaaacaagaatatccgtaagaaatgtttagtggagcaggggacacagataagcaagtgaactagaagacagctacaatgaaatgtgttagagcagcagttctcaaagctggccacaggtccagcaccacctggaagttgttagaattctcaggtcccaccccagaccttctgaatcagaaacactcaaggttgggcccagcaatctagttttaacaagcctctaggtgattctgacagtcactgaagtttgcgaactaggatgtcaaaggtgcaagtgaagtgctgcgggaatgcagaacaaaggaccattcatggcatctggtgagatcagaagggcactagaaaagaggtgtcgagtgagctgggccttgctggactattttggtagtcagaaattctctaaagataaaggaccacattcttgaaaggcataagaagtgcctaagtggccttcctcgaatccatcttctgtactgcccattgaatctgcttttctagtgcactttgatccatcgctcacctgcttaaacatatttcacgtcttaaagtttctctccagctcccattgccttaccacataaaacagagttcttagtatggcagatgtattaggactctttccattgaaaatggtgggaaccgaacttaaactcactgaaacaagtcggaattcattggcccatgtggctgagatattgcaggtcacttgaggaagtgaaggaagtataccaggaaccatgaccgtattccctttttgggacagaattcagcattcctaggactcactctttttctgtttgtatgtcatctctgcttgctcttcttttttcatagtgggctcatttcctgcaaatgcaaagaagccttctctactgagcagataacttaatcgtaggcagcccttgcttagccacaaaaaaaaaaaaaaaaaagtgcacatctttcttaaaatgattgtgccaatcacagggaaagttttttcctggccttgattcagaaaggggcacatcatttgagcaactgttggcctggattgtccaagcctggatcagatacctccttttatagcaaggacagcaaaatctgttaccataagaaaaggggtggaagaacttagtgggtgaaccaaacaaaaatggaagacatcttggtccatcacagcatacacagcctttttcagtctatccacaaccttcattaccaccttttttcccacagatatacttcacacccaccaaagtgcttgcttttccttagatgtcatagtactttcatatcaatactttatttaattttatttgcctggtaaacattttctattatctgcctgttgaatacttaatctcctaacgatttaaaaccaaagataaagttcataatgttcataaatgttctatgaaacattttccagcttccccagcaaaagctagtgcttgttcctgagggttcaaacgggagttcatagccaagtcaccactgttactgattttgtcacattgctgttatatgatagttgtttacatacctttgctactattaatagattttgccataaaagctaagcctatgcatttaaaaaacatttttaatgcctgacacttagcaaagttttcagcatatagtaagtaagcaaggtatttgaataaaatgaataaatgaatgagtgaacaaatgaaaattgatggtgaaattggtgaataatcaagtctgataagagtatggagtttgtgatagaaagtaatcaaacagaaattggaaacataggctaaagccagatagtggcgatcttgaggatcacattaaggagttaattttttttttttttaattttcgattcaggaagtacatgtacaggtttgtcacacaggtacattgcgtgatgccgaggtttggccttctaatgtgccgatcactcaaatagtgaacttagtacccaatagatggattttcaaccctttttcctgctctgtccctccctgcttttgaaatccccagtgtttattgttcccatctttgtgtctatttgtacccagtgtttagctcccatttttaagtgagaacatgtgatatttggttttctgttgctgcattaatttgcttagaataatggcctccagctgcatccatgttgctgccaaggacacgatttcattctttttcttggctgtgtagtattccatggtgtatgtataccacattctccttatccagtcccctattgatgggaacctagccatgtctttgttattgcgaacagtcctgcgatgaacatgcgagcgcatgtgcctttttgatagaacaatttattttcctttgtatatacacccagtaatgggattgctggattgaatggtaattctattttcagttctttgagaaacaggagttaatttttttcttctgtaagcaaaattagctagtatggaggacagagatatgataatttttgtgggaagaagaagaataatagtattaacaggaaaggtgtattgtgaaggtaaaaatctaaaggcaacgatgttagttacaaatctcttcctgtagtctccccttatgattgatgagtagaagctatacattggttggttgtagcaatgccctggttggcacacatttttcagaacatatagtagctgaatacactccagtcagaatagcactgttttaaacagtgtttgcaaaacagtccagaccactcatttgaatttcaccttccaaaagcagaatatagccaaaatctgggaagtgagtgccataatgtatatgcttactaaactgtccattccgatttcatctgtatatctaatttataacaataatagctaacatttattgttgttatgttctagaaactgctctaaatgctttatgaggcttttctcagtttactctcagtagcactccctacaagataggttttcctcattttatagatgaggaaacagcctcagagaggttgagtgattttcctaaagtcatatggctagtagtagacagagttgaaactcaaatgccggaagcttgtcttcaaattcgaaggtcttagtcagtatgctagatacattagtatttgtcacatgtccacagattgtgattttgtggataaagcccctgcccttcatagtctcaagacatcacagggtcagatattgccaatttacagacatattcagttgtcattatgggcactgtatcagcatttcagtgttgttctttttgaagttctgtgcatgtagaactctgcactgcatttcatataatcaaagaagatacaaagatgaagcatatgaaatgggacacctttccaaggtaggagatggcattgtagacaacttcagggtaaatgttgtcacaatgaatagaaaggccactaggagaatactcaggatatgagtcagaatgtaagaaaagaactccatggaacctgcagtcacgtagcattgatttccaggacatagaggtatctgctgagtagttgctcatttatgtctacagctcactcttaaaaatcttaagacagatgttgactcgttctagtaagagttaatcttagctatatttttaaaaatcatgaatgttaccgaatatcttaattgccacaaattcattggtgttattttcagagccgagagtgtattcagagccgacagtgaactaaattgagtagtatttcaggcattgtgtttgatttagattactatagtaaattatttccatccattttggagaaaaacttgtgcatacaacagtgaactttctccgtttactagacttgacattgagatcatttctggtctgcatgtggcaatggtgctgagtaaatctgctctgcatataaaatgtttgcttaactaatgaacttgtgttagtgacttcagttctgcccatctgaagcttctatggtgagatcactcatctaagagaacatgcataacttatccttcaaaaaagactagcactgtcaggtccaccaccttgaggatgtatcggatcatttgtctttaggatgagcatgtgcccacaacagcatttaccacaggcatcagtgctgtctttaggtccctttggaattacatacttttcacaattgaagtcactcacttaaaggtgatgcagattttgcaatagggataaccatgtgcccacgtaagtttccaattttttcttaagtaatactacactagcttaatgagtgggaaaatccaagataggagaggaaaataaattgtacactccagtgtgttggagccagcaagtgagagtgattcttggcatttcagcataattccatgttcagtgacatcatgttggtagcttgaaactagccatgatgggagtattttactaagaaactggcaaacaagccaggcatggtggtgtgtgccagtagtctcaacaacttgggaggctgaggcaggaggattgcttgagcccagaggtccagcctgggctacatggacccatctctaaaaacaaagaaagaaagaaattggtaaactctgtaagtcagacatctccccctcccccagccccagaaagctggttgttaaacatttatcagcacgctgctagcattgaatttccattagttgactactttaacatcacaatctagataactaaggtacaggcatatttctctaaaacattccttttcaaagaagaaacaattcctttgttttcttggacagtataaggaaacttcagcatgttttcttcttcttgcttttttttctttcttttttttcctctttttctttttttcctctttttcttcttcagtggagaaaagctgctaaaatatctttttttttcacagcctcctttatttacttggagtaagaagtataacttagttaaaatatgtattgcagttatcagattgctcttccaaatattttaaattccaaaatatttatataataggcttagaattttaaactacccaaaagtaggccgggcacggtggctcatgcctgtaatcccagcactttgggaggccaaggcaggcggatcacaaagtcaggagttcaagagcagcctgcccaacatggtgaaacctcatctctactaaaaatacaaaaaattagctgggtgtagtggcgggcacctgtaatcccggctactcgggaggctgaggtaggagaatcgcttgaacccgggaggcagagcttgcagtgagccgaagtcgcgccactgcactccagtccgggcaacagagcaagactctacttcaaaaaaaaagaaaaaaaaaaagaaatggctgtcttctttgattccataccctcctagacacacacacacacacacacacacacacacacacacacgcctattgtgagtcccttttttttttttaatttagtgtgaatttatactgtggctcatagtatcagttcctagggcattggtgtgacctgactattaactctgttttctacatcactgattggaaaacccctggatgtagcatcaataaaaccaatgtttattattcgggagaagtctgaaattgctgccaaagttttatcatcatttctgcatattattcttatagcttctttcctcctctttcttttcttctttcttccctcctcccccccagtcttctttcttctcttaaaggacaagaactggaagcaatttagaggtaataaattaaaatgcctcagagttcaggtaggcacttaagtgggcaggtgtaagaccatgaggaatggtaggggctccatcagactagagaagggaaaaaacacttgccccaagagcagtgagagtcaagttttggaaaacatttaggtcaaaaacaaacacatctagggagcttctgttagtggcctcattcttcaggtgaagaaattaagtccccaagactcttccgcaattgtagaaccagctatcagaaatttgagaatgacagctagctagtccagccttcttggtattctgccactggtctgcctttattctccctcttatccaaccctattgttattccttgagtacttgttgaaggcctgctctatccaaaccactatttaaatttctgagatttcaaaagggaatgggacctatttttgccctggaggaactctgggtttcgtggaggaaactggcacctgaagagatcatgacaatgcatttggtaagagatttaagagagggatgaaagttgcttcactaactttgccttgggagttgggaattttttctggagaaagtcaaacttaaagagctgttaaaggatgagtaggtgtttaaatgtccctctcagtctttagttcatcattctatcattaggtcatcaccaacgttcttaaatactgtagtcatattaaaaatgtgaattcataaagccctaaaaagtcactttcctgagttactatagtttcttgaccgtccacttacgagacaggcttataaaattgccaccttaagataaaggtgcagtctgctttgtgaaggcctccccagaatttgtcattacacattttaaaacatattcttttttctcaatgcattttatgcctgtgtatgctggttaaagaagaaaagcaatttgtaatgcatttctcctacaaatggcataaacttcactttttcccacctgtcatcgtatagtaaatgtgttttgaatgtataatatccttttatatattaaattttattacttaaaattatttaaattcttaaaagaaattttcattgtctcttacactggaaatctagctggagtggggagttgtcagaggaagcaaaccatacctttggaaagaaaggctataactatcagtcttgtttctaattagtcacagagttaagggcaagttgttttggaatatcaatatgagctactctctggaaaatgaatgtctccatgtacatttttaatgcattcagttacaactgtcttctccagcacatacacaccaaaaaaaccacataccaaatataatttttaatgcgtatcttggtaccaaactttagaaatttactgcatctacattttcatgattatgcattttcttttctttctttttgtattatttatttgtttattttttgagacagagtcttgctctgtcaccctggctggagtgcagtggcatgatctcaggtcactgcaacctctgcctgccaggttcaagcaattctcctgtctcagcctcccgagtagctgggactacaggtgcacggcacctcgcccagctggttttcatatttttagtagagacggggtttcaccatattggccaggctggtctcaaactcctgacctcatgatctgcctgcctggcctcccaaagtgctgggactacaggtgtgagccagcgtgcctggcctgtatgcattttcattctagttacctttgctcatccatatcttattctgaatactcatgacttatttgatctagccttgtgcatagtcccagataattaagaagataattaaatcagggtctaattttcttgactatcaaatagctatttttcttttttgtaagatgtagaccccaaaagaggccagaacttactattgaaaatcagaatctaaatgcatttacttctggagaagaatttaccataaaactagaagagtaatgctagatgagatagtgcaaacaaaatggaaacttgatgaaagtatctagatagttcaccccagagattggctttcccaaaaatagaaagacaactgaatcatcaacttcagcctcagttatttggctaattatttaaactctttatgtttcatgtgtaaacataagcaatatgaagttaataaataatggaattggcaatatttctaatgttatactatcataaccagtcataaccatattttctgttggttactttagatatacaaacaagtacatggtttaattaattaaattactttgtaaattttttttttttctttttttgagacagactctcattctgtcaccaggctggagtgcagtggcacaatcttggctcactgcaacctccgcttcccaggttcaagtaattctcctgcctcagcctcctgagtagctgggactacaggtgcgcaccaccacgcccagctaattttttgtatttttagtagagacggggtttcaccatgttggccaggatagtctcaatcttctgatctcgtgatctgcctgccttggcctcccaaggtgctgggattacaggagccaccccgcctggccagctttttctttaagtaaatttaaaaggtggaagtggtatttaaatgggtaaataagatcctgatttttaaaaatgattgttttatgaactaagcttcagggttttaggccattattttgaaatctctcaacagttcttaagttgttaaagcaaacaaataaaatcaaaacaaatatggctatgcttgcctggtcacccatgttcttcctgaacccagtgtttttaagagtacatgtctcactgagatgctgaagcagcccatctacaaccagttgaccaccttacaaaggtccctgttcttcagactatcattttccactgtcctattcatatctttaccagattggtccagattaaaagttgtactttacagaaattatgtaacacttctctttgctaaagagactctttattcttatcaatcagtgcataaatattgactgcctgaaaatacatgaataggaacaatacagaggaataaaaatcaggaaaggaaacaaaagattaatttttactcattatatcaagtggactctttttgctgggctttcttaatcggttagcttatgagttgagtcttgggcagaaaaaagaattcacaagaatgtctttctcagatacttttaataccatcttcatgtttaaagaaaaatatctgtgtatagctcaaattggtgttttatgaactgtattttgtgacacaaggtcttattccaaaaaatttaagactatcatcataatcaaaatgactgctaaaattttttttattcattattataaaaagtgagtgggctgatacatcaggataaagcaactgatgattttgtcactattgtgtggttaaaatctgtgcctatcttggaggtatggattgagcatcatattattctactctaggtcttaaacatctttcttattcctggtctgacattccaaacatctcctttacatgtcaagaatgcttattcaagttgcaatagctcttaggtatatttttaaaattatagtttgctgtttataattaattttaaatggaatttgggattctgtcctacctaacatattctagctaattgagaggaaattaatgtagcctaccagccagatgattactggctgaattaactattcagaatgcttttggaaaacctgaaaatgcaggaaagcagagctaaaggattttttttttttttttagatgcagtctcactctgttgcctaggctggagtgcagtggcactatctcggctcactgcaacctctgcctcccaggttcaagtgattctcctgcctcagcctcccaagtagctgggattacaggcatgcgctactacacccagctaatttttttatttttaatagagacagggtttcaccatgttggccaggcggtcttgaactcctgacctcaggtgatctgcccacctcggtctcccaaagtgctgggattacaggcatgagccaccgtgcctggccagagctaaaggatttttaaggatagattttctcctctaccaccttctagtttcttggtgtggaacagatgacaacatagcttttttccattaatttttcttatccccgtaggaccaagatgtgtaggttgtagggccttgttctacctcccaatgttctctatttgcagaatgaacagctgactttggctgatgtttgctgataccttcaggaaataatgttgacttcagaataacagacaagccttcttttggcatcgagtttttcttcctctgccagttcaaatgaggctccccttttgttgtgtgcaaccacaagctgactgtactgcttctcttagttaatcacagacaaggcccaactgtttgatatgtatcaggtgggagttaaacaaaagcccaagcctaaatctcaaataacaagaggaagaaggatgcttccatgtcagccgatgtctcatcaagtacctacttagtcttggaatagactctaactttgcctaccaagtgtttatctgactggtaccacttagagtcttaccatataatttacattacacagtattaggaagtctatacttgttggtgatgcgtgcataattttttaaaaccattgaggtgatcactatctcagagtgctgattagaacttcaagactggtcccaggccaggtacagtggtttacgcctgtaatcccagcactttgggaggctgaggcaggcggatcacctgaggtcaggagttcgagagtagcctggccaacatggtgaaaccctgtctctactaaaaatacaaaaattagctgggcgcagtggcacacacttgtgatcccagctactcaggaggctgaggaaggagaacccgttgaacttgggcagcggaggttgcagtgagccaagatttcgccactgcactccagcctgggcaacacagtgagactccatctcaaaaaaaataaaataaaataaaagactggtcccacagccaccaggccttgtatacaatacatgcacataaactgtgtgttagttaaaaaaccatacccattatcaagtagcaatagtcccatttaaaaaacaaaattttggctggtcacggtggctcacgtctgtaatcccagcactttgcagaaggattgctagaaaccaggagtttgaaaccagcctgggcaatgccatgagaccctgtctctacaaaaaataaatccactgagcatggtgacatgcgcctgtagtcccagctactcaggaggctgaggtgggaagatcccttgagccgaggaggttaaggctgcagtgagctgtgattgtgccaccacactccagcctgggcaacagagtgagactctatctcaaaaaaaaaaaataagaaaaaataaataaaaaataaagaaatttctgggccaggcacaggggcttacacctgtaatcccagcactttgggggccaggctggaggatcacatgaggcgaagagttcaagaccagcctgggcaacatagactctgtctgtacaaaaaataaattagctgggctcggcagtgcatgcctatagtcgcacctactcagatggctgagataggtgcactgcttgagcctggaaagttgaggctgcagtgaggtatgatcatgccactgcactacagcctggacgatagagtgagactatctcaaaaaaacaaaacaaaacaaaaaaaaatttctgcctcctaaagttatttattttgtatggtggtgaagtgtcttgaaaagatgcactcagacgttattgttcccggccattctcatgtcctggaaactaactgtagccttttactttaaccatctccttcagctcattgtttccccaggccagctgaccacacactgtacactaagcttggatgttctgtgttgtaacaaacttcctttcagcactggtcaattaagcatatttgacagcacccctgcacatagccacagacaaactactttatatcctaccttatgtggaagagcctgtaacaatcctgttagagcagttaattctgattttaaatgagaatcacaggtcagaatttcccagaatgaaattctagggtaccctaatttcaggaattttgtgaaaattacagatcatgctatttataagttgcctaccataatgtctagtgcaaacactaaattgcagctgtttttttccatttgtcactgtccattctttggtttaccatatgaatctaagatttactcacactgtcattaatctcaaccattaacataccattctttcttttaattctatcaaggtccagggtgttgtgttttcttttctctttttcattgtgacactcaggaatgtgtgagataagaggtcctagagggagtgaaaagtcacagatttgctttctgataaaacacctgaatccccctaaatatgtgaagctccgtgaccatttcagagacacacagaggtccagattctatttcttcccccattacaagtcacattgctagagagattcttcccgatatcaagcactggccacaagtcaaactggcgtcttcccatttgggaccagtggaggtgaagaactccaaataattcctgcctttatgtgaagagtaatttgtctccttcctcactctacttctcctaaggccctggccccttgccttcaacccctaaggacctgtttttaaatttcagtatataacagtatgcagttttagttttcttaaaggtctgcagatatttactcagacttaggcttgattataccagaggaaataaacccatcgtttaatcaaatgcaaacgacaggcactaaattacacgtttttaatatattctattggtaactttaataagcactatttattaagtaactaccatgtttgtatgctcattctcttttaattttcgataaggtaattgtttcagtatatttcacttacagttttgagatatttttctattgagccaccattgggtaatgtatgggaaaccaatcaataaatagttcttatgattcaagagatacgttgtaaaaaagatcaattctgcctaaaggtagccatgttaattttctgattcccacaagcttaagtactagctgttaaaaaaaaatattttaagatggatgtatcattttctatagttattggttattttcggaatggtgcaataacaaattactttctgtctaatgacttctattcatggatgcagtggtataaaataatctacccttatcattcatatttctgtgtagttgagtaaggtgggaactatttttgatatgcaggagcaaatactaaagcaatggggttccatgcactttctgtcagcaaaagtatcaactgccagaaacccctgataagtcccatttcaagcaagtagagtctggataataccaaacagcaagacaacagttagtacttgtgaactggcagtactgccaacttgacttaccattctaacccgaaataaacaccccggagttaaacaaagctaagtcatccatctgcaaggtatgtagtgggcttagccaggaagaaagactttttgatttgtcaaagcaattttaaactactgccatttatcctggccagaggttgaaaaggccaaagggaagcttttaaacatatgataacatcatgtagttggggacatatggtatttgcagactgaatgaatgctagctgggatttgctctgttctgggccaccctgggtgtagaataaagaacagccctcttttcctgactttaccactaatttgctgtcaccaggaaaagtaacggaaacttttggcttctagtttttcatgtataaaataaggagactggaaaagatgctttttcagtttctgtcaagcttctgaatccccatgattcttaaagggctcacaaagtagatagaggatcttggttgaaatgatcattctttgaaaaaagctaagtaaaaaattgttttatttccagcttatgaacccattcatttttttttaaatgaacaaactgtccgagtttttcaggtacagtaaaaattaataaggaagtagaagggtcaaatgagaatcagtcacagaagagattttgttaaaaaattcattgtatcaattcagcaaccattaaattgttagtatattcttagttttaggtatgttatctcctcaactgtcacgttgaatcatgaaattgccatttttgagggttaaaacagtcgggttttgtcagtttccagagttcaacctatagatatgatctctgtgaaagcaaggtataatattgtgcatcttcctctcattccctttagttcttttttttttttttttttttgagacggtgtctagctttgtcacccgggctggagtgcagtggcacgatctcggctcactgcaagctccaccttccgagttcacaccattctcctgcctcagcttcccgagtagctgggaatacaggcgcccaccaccatgcctggctaattttgtttggtacttttagtagagacgggttttcaccatgttagccagatggtcttgatctcctgacctcatgatccgcctgcctcggcctcccaaagtgctggaattacaggtgtaagccaccacacccagccacctttagttcttgatgtaatgcttaggcacctttgtttctttgacaaatatgcactgaaagcagtattttgaggcagaaggccttttggaaatcacttatattatattactttattttgttaattttttagacagggtcttactctgtcacccaggctggagtgtagtaatgctcactgcagcctcaacctccaggctcaagcaatcttcttcctcagtctcccaggtagctgggactacaggcacatgccaccatgcgtagctaattttttgtattttttcatagagacagggtttagccatgttgcccaggctggtcttaaactcctgggctcaagcagtcctcctgccttagcctcccagaatgctgggattacaggcatgagccacagcttctggcctatattattttaaagatgaagaaagtaaggctcaaaaatgtctcaaagttgcagttctttttgatgttcagaatgacactaacacattataaagaaaaagtcctgaacatattctggatattctacctaccagtaaaagaaactgatctgggccaggcgtggtagctcacgcctgtaatcccagcactttgggaggccaaggcgggcggttcacaaggtcaagagatagagaccatcctggccaaccaacatggtgaaaccccgtctctactaaaaatacaaaaattagctgggcatagtgacgcacgcctgtagtcccagctactcgggaggctgaggcaggagaatcgcttgaacccgggaggtggaggttacagtgagccgagatcgcgccactgcactccagccctggtgacagagtgagactccgtctcaaaaaaaaaaaaaaaaaaaaaaaagaaactgatctgatacattttatagggacagttcttagcaattaaagttgggaatagaggtgattctcaagttcttaaaacctgaaggccctattttttgtcattcttgttgactgaggtattgacatttttggaaaaaaaaatatttttttaagtagttaatgctagtaagaaaaacttaatctaaaggaaggtagtaacaataataccagactatacacatgatctgaatctgcactgtaatccccaaatgcattactttcctgtatttgataagtttcatttctctatcagtaaacaacttccaattataggtttagttactgtttatagaaaggtgtcatgacttagcaatattagaaatagactaagtgtaaagatatttataggtcatacttttgactgaagccttacacactgcaaactctcatgttttctgtaacatctctctgccattttaatgataaaataatcgcattttagagcatctgatttaatatttgtcaataacagtttatactgaaatttagaaaaccacaaagaatgtagtccaacacactgtctttacaagtgaggaaactgaggcccagagcaactttaagttacttaaagttaaaacatggggcaaattgggacttggcatccagtatattataatgtctaatgtgccatttgctcttgttctagttgcaaaaacatttgcctcatatccacactcaaaatggagtgaagattaagtaaataatgttttgatcatggtacttggagtgaagtagaagacttatgacacaattacgtgttgtttggaaatatttagaaagtatgttcatagttgatctattaagcagtcaatgatttgttgactgggcaagtctgccacacttttacaaatttgccagtttccaaacacctggaagaagcatcaagtaaaacttcaaaacaaagacctgttggatacacagcctagacttacttttttgttttttgttttttctgatagaaacatgagttctgctggcgctgatgggagaaaagcgatgagaagatgtgacggactcattgactcactggtccattatgtcagaggaaccattgcagattaccagccagatgacaaggtaattcaagagataaatatcctgttttgtcttactaagatgcttcagaatattcttaagatagccgcttggttttaggtttattcactgattcatttactgagcctaagatcttccattcatccttagaaatattaaaacctaggccaggcatggtggctcacgcctgtaatcccagcactttgggaggctgaggcaggcagatcacgaggtcaggagattgagaccatcctggataacatggtgaaaccccgtctctactaaaaatacaaaaaatatagccgggcgtggtggcgggcacctgtagttccagctactcaggaggctgaggcaggagaatggcatgaaccccagagcttgcagtgagcagagattgcgccactgcactccagcgtgggcgacagagcaagactctgtctcaaaaaaaaaaaaaagaaatattaaaacctattgccttatttttctattttccaggctccaatgtctgtctgtctaaccacactatgtggatatttgaaaggagcccaaatgctacatggtcagcaatgaattttaatgtatctcttttttcattcccaaacttgttccttctttttataatcctttttttttttttttttttggaggcagagtctagcttcatcacccagcccaggctggagtgcagtggtgcgatctcagctcactgcaaccactgcctcctgggttcaagcaattctcctgcctcagcttcccaaataactgggattacaggtgtacgccaccatgcccagctaattttttttgtatttttagtagagacagggttttgccatgttggccagcctggtcttgaactcctgacctcaggtgatccatcacctcagcctcccaaagtgctgggattacaggcgtgagccacagcacctggactataatccttcttaataatcatcaccatccaccaaaagaagatggaaatctgagtaattgtgtgctgtctacctctgaaaaggctttcagttcttacacttccctctaatgcttctaatgttttcctacattgtgcatctttcatgccgattattgcaatagcctcctagttggtccctataaacagtatctcctccccttctccagctcaacatggctagtaagttacgtatctaagctatacagttgttctggacacactctttagaaagtaaactaaaaagactcagcctctacttcttagcattgtactcctgactgttcatgaaaaccttagcttttctagccatactcattgcatttcccccaggcaacccgcagtttaagcacacccagttgcatctggtaaaccttgtaagagctaaagcctgtgtcctgtgatatcacacctgcaaggatatctatatgtatacgatcaatattcttgtcctgttttctcaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagaggtatattgggaagtttttgaaagaatgagaaagggagagaatgagagagagtgtgtgtttgtgtatatgtgtatgtctaagtacttggtatatatcggcactattttaagttattttaattcttacatcaaccttttgaagtgtgtattattaataccctcatttaccagtgaggaaacagagacacagtaagattaattttcctggaataattcagcaaataagtggaagagattgaatacaatgccaggcagtctggctccagattttcattgctacccatgaaccgtactgctttatgccttataggttaggaaataagcttaatgcagcatagctaattgtatataaattgtttttattaaagtcggccctgatatttggccttgggtattctaaaaacaaactttggacatactaaaagcaaacctcataggaaggaatacatatttatttccatactgatatgaaaactaagagaatgtaacctcccctccttctctgagtatcgtggtatttgtggaaaccagctggtaaatttagaaccctggtgctatcctggacactttcacaagactctgagggaacaggcctgtttttcttatctacagggtggttgtgactaatttagcttttagctcaacagcagcctgaaaaccattctagaatgacctatgcttaattctctgaattttctctcactgggagaaatatcaagttaggggtgtggagtgttattaggaagaaataatcattatgggctaaaagttaagtgattagaaattatatatatttgcttttaaaatttctatttcaagggcttcttatgcaaattatgagcctttctagacagtatttctggtctcctggtttgagtgtgaaattatagccatcacctgacatgcattaattctggattccttttgtgtgtggtcagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccagtgagtattgggcctgatttcctactttttaaaataatgatattgtagacatacctacattcaattcagagatgaaacagtgagggaagagaaaaaggtttcttattttagtaaagacaattctcagaaattacagagggcttcggtctcagcttatgcaaagtcaagtcaggctgcttgactgacaagtcaagtcagtactctttcagttacagatctcagaatcctgcctcaagctggtttaagcaaaaaagaggaaatttttggcttatggcactgaaaactccagggtgggccttctttctgtcgtgactggacttaggtgcaccagtgattacagttgactttcttcatctccgggcttggttttcctctgctgggtttgttctcaaaggctctctccatagggtaacaaagacagccatgaattatttcaggctcacgttttatcagcccaatgtgtcccccacaagaaacaaactaccattttcccaatagtgttgttaagaagttggagaatatgtctcacgggctggcttgggcctcttgcccatttctgaaccaatacctgtgtctatgaggctatgatgttctaattggccaagtctggatcatatgcccagatgtgcacttccagggcatgggtttgattggatgagggccactgccacttgtaccacatgggctgaaatggtaaaggagtgctccctaatggaaaatgagactgttactaccaaaggaaggaggaataaatgctgggaaggcaaaaacaacagcagatgtctactgcagtatggagttggaaaggccatctgtgcttttgtgtcccagaaattcaactacaaaataaagagctgatcctctttccagatgcacttactttatagcagcaaagtcaaaataattaaaatagtaaaaggttattcccttccccatgtattttatacccttcctatatattaaggtattctgtaagtatttaatgatttaaactaagcttgtattctttgccttggtcatgaaacgattagaataaactccccccaaatagctcattgtctgtctagtctccaattatctctgtagagaaaagtactattgtaagtagcaaaaaatatttatgttttacttgagaaaccatatttattctttaatatgtgtgtttacacagaagcttgttctctgaataaaattgtgaaatgctaaaaccaatatttctcttaccttagcattgtggttaagaatgcaaccaaactttcatctgtttggctttctgcaaaatgtacattgagaaagaaactgggaactaccagggagcccttaatgacacagggacactaatgaatcacgttattccccattttcctatgctaggtttcccaaaaccatttctcttactttgctaaactatagaagccctctttttaattcccagctaacataaaagaaaattaaatgggggggggggggttgtgtgtgcgtgtgtgtgtgtgtgtaagcttgctgtggtctgagtctagttcaatataagctaaccctttaagcttggattttagcctcttccattccaagagcctcccacagaatccagaccaggggtgctttcatttttctgaggatacagggatatttatgccacttaatctctcaatattagtgtattacctagttcctacattcatttgctgaacaaacattcttttgagcatattacataacagacactagcagttatggtgtaggttacacagcagtaaataagacaaatccctgtgttgggtaatagtcttactgggatgaaaaacagaaatttaaagtactaggaaaaatttaaggtaccaggtccataaagagcccaagtcatacctaaggggcctaataggccatccctaaatggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccgcactcagcctccctttattcttttaagttacgggatgctttttaaaattttgacatatgtgtttttttaataatacttttcctacttttgtatgcttagatgctgtgataaagatctctggctttataatttcaaacaaggaatcattgaataggaaaacatgaaaattaggtcatacacatagtaccagaaaatatcaagtccattggccatgtgatcgtaactgagatagcactgagcaattaatgaccgtgtaccttacgtggcaaagaacccaagctgaaataaataggttcctaaaagacagattatataatttacatacagaattatgacagaatttctagttagtaaaagtatgttagtttaagctttattagttcagttataatggtcactctagtagcaaaaggatggaataataaaatttacttatttagcaagcttttaaatataatataaattaaaagattaaacattgtatagtaaaagttaaaagtcattgaaataaagtttcgggtttttttgggttttttttgtttttgagacagagtctcattctgttgcccaggctggagtgcagtggcacagtctcggctcactgcaacctctgtctcctgggttcaagtaattctcgtgcctcagcctcttgagtagttgggattacaggcatgtgccaccactcccaactaatttctgtatttatagtagagacgggtttcaccatgtcagccaggctggtctcgaactcctgacttcaagtgatctgcccacttcagtctcccaaagtgctggggacaggcgtgagccactgcacccagcctgaaataaacagttttaaaagccctttatttaatatcgatcggaaaaaaatgaaacatattccctcagcggcccccaacctttttggcaccagggactggtttcatggaagacagttttttcacagactaggctggggagagatagtttcaggatgaaactgttccatcttagatcaattagattcttataaggagcacacagcctagatccctcatgtgcggttcacaatagggtttgcgcccccatgagaatctaatgtcactgcggatctgacaggaagtggagctcaagcactaataatactcgctcactgctcactttctgctgtgcggcgggttcctaacagtccacggactggtactgtgacccgggggttgggatcttccccactaccgcataccttacccaaaaataaataccaacaggaatgaaacctaaatatgaaaggtaaaacaataaagatgctaaacaattacatggaagaatatcttcatgacctgaaacagggaaagacttcattaaaatggacacaaaaaggactagccttaaagtaaatatttgataaattgactaaattaataacttatgctatcaaaagacatgttaagacattaaaaaggcaaaccacagaatgggaaaagatttttgcaacatgtataagtaacaaacgtgggtatccagaaaatatagaagagttgaggtaacaatacataaacaagacatggacagcccagtagaaaaataaatggacaagagacttaatagacgaaagataacattgaaatagctaacagttataaattctttcccatggccaatgtccagaatggtgtttcgtaggttttcttctaggagtcttacattttgaggtcttaacgtttaaatcttaaatccatcttgaattaatttttatacatagtgaaaggtagaagttcagttttgttctgcatatgactagccagttatcccagcaccatttattgaatagggagtcctttccccattgcttatttttgtcaactttgtcaaagaccagatggctgtaggtgtggagcttcattgctgggttgtctattctgggacctaattaagctaaagagcttctgcacagcaaaataaactatcaacagagtaaacagacaacctacagaatgggagaaaatgttcacaaagtatgtatctggtaaaggtttaaatccagaatctgtaaggaacttaaaaaattcagcaagcaaaaactaaataaccccatttaaaaagggagccaaagacatgaacagacatttctcaaaaaaagacattaccagtggccaacaaacatgaaaaaacgctcatcatcactaatcatcattaattatcaaatcaaaactacagtgagatgccatctcataccacttagaatggctactattaaaaagtcaaaaaacaacagatgctggtgaggctttggagagaagggaacacttacatactattggtgggaatataaattagttcagccactgtggaaggcagtttggaggtttctcagagaacttaaaacagagctaccattccacccagcaatcccattactgagtagatatccaaaggaaaataaattattctaccaagaagacacgtgcactcatatgttcatcaccatgctattcacaatagcaaagtcatggaatccaccagggtgcccatccgtggtggattggataaagaaaatgtggtacatatgcaccctgcaatgatatgcagccatgaaaaaagagtaaaatcatgtcctttgcagcaacatggatgcatctggaagccattatcctaagtgaattaatgcaggtacagaaaaacaaataccacatattctcccacttatacgtgggagttaaaccatggttactcatggacatacagatggcaacaatagacactggggactacaagaagagggagagaaggagggggaaagggatgaaaaactaactattatgtactatgcttactacctgggtgacgggattattcatatcacaaaccttagcatcacacagtatacccgtgtcacaaacctgcacatccaccctctgaatctaaaagttgaaattttttttaaaggccaataaacatttgaaaacatttttcaacctcattaatgatcaaggcaatatgaattagaagtgttatttgcaaacagttgaccagagaattaacagtcattctcacatacttacaaaagctagaatacagaatctctatttggtagcactcattgcttattttccttatggagcaaattctaaaggtcatcctacttcaggcattctcatttccctcagcaaatcggaattagtgaaattttgccatgctgtccccaagctgagcaaacagcatttaaggaatcagacctcatctagagtcacatgttttcaatgattgttcttacaaattaacatgaaaacattaatgctctttattatatctcagcatatatcattaaatagtatagtatgatgtatctataaagcgagattttagttctcaagaaattctcatgttttaaaagaaaacaaaaattttaagaaatattttgtgactttatttgattccccatcttgttttcaagtaccttctgagatgataaatcttcagggaaacttgatagcatattatttgtacaattcaggtcagtaaacatttgtataggacctatcatgtggaaggtaccatacaaggcactgaggtggagaaaagatggataagatatgttctttcaagaggctaatgaatggtctagtaggagagataggcagtttaggagagttgtaaaatagagaattagggagtagtggtaaggaaggaaatgaaagaaaatgtcaggctacagaggactgtatgagccatactaagatgtttgaacatcattcggaaggcgatgaagagtcatgaaagggtttaaatctgaggtgtggaacataatcagattaaattttacaagggtgattctggtgtaaggctttgaaacccccactggtgtttaagagacaacaagtttactagcaacattgagttccttgtagagattggaggccataatttgcagattggttcttctgcaaatgcattgttcgccctagcaatatttggtagacaagtataaaatcagaaaagaaaaaagttaaatgaaccgtatattgcagttttgatgggtgagagaaaaataaaccagactgacaagattgttgagattattggaatttttttttttttaagacagagtctcactctgtcgcctagggtggagtccagtggcacgatctcagctcactgcaacctccgcctcctgggttcaagtgattctcctacctcagcctcccaagtagctgagattacaggcgccaaccaccatgctcagctaattttttgtacttttagtagagacggggtttcaccatgttggccaggctggtctcgaactcctgacctcaggtgatctgccttcctctgcctcccaaagtgctgggattacaggcttgagccatagtgcccagcctggaaagataatatttaatgtgatggttcatgcaccatagtctaaataagaaatttaagacaggagagaattgataacttgaggtgtaaggaatgaaggttaggtaaaggaactaaagttcttgatgaggctgaagagaaacatggtaggagggagggagggagagcagggagaacgggaaactatgttcagagcctgacattgctgagtttatgttttcagaggcaacatgtctctgagtgaacacaggctctgtgtgaccatggaagtgagtggctgatgtatggaagagatgaaagtcagggactgtggggaagtctaggaactgtgaggtaatcattttgatgaggtatatgaataggaggtggagaaggctgtgaactgggctccaaagcctccagcaaatgttgaggaaagaataataggccttgtgatagcaaagaaaatgctgtggggggtgatagagctggacggtggtgactcagaagagcaggacttatgcatttgagggaaaacggaatagtgtagaagcgcaactgggaagacagagagtgccaaacgtccctcctggcccaggatacaggagtggtgtccagtagtctcctccttggatggctacaggggaaggattcttctcagaggagagcaaatagtctaacagaatgttctgcaaattaatgaaagacaaattttaatttgtttataatagaacaaacattagaaaatagtaattaaattcctttgagtcatggacactttgagagtctaataaaagttatgttttaataactaataaacagagtattgcaattgtatctaacaattacatgttttcttcctccttattttttttttttcccaagatgaggtcttgctttgtcacccaggctggagtgcagtggtataatcatggctcactgcagccttgaccaccagggttcaagtgattctctcccacctcagcctcccaaaaagctagaaccacaggcacataccacaacacccagctaaatttttttatcatttgtagagacagggtctcactatgttgcccagctggtctcaaactcctggcctcaagcaatcctcctgcctcagcctcccaaagtgctggaattacaggcatgagccaccaggcccagcttcttcctactatttttaatattgaaaaaaagatactgactaaattataaaaacaataagacatgacagttatttgtttcattatatattaagcaggctcagtttaaagtaagttgattagcattaaagtcatatctgaaggcccaaaatgaacttgaaatgattctacttcccaatgtttatacattttctcccactgatctgataatcctgttcctaaaatccagacatccatatgagagttcacaagaggtccttatggcttagtccatttgtttggttgtttgggggttttgttttgcttagttttttgctttggttttgtttacatttttgttttatgtttgtttgtttggtcactattgggctaatactgaccattatttagatttataaccttcaatcttgtgatgaattggttttgaaaactgcaggctacaattttttatttctctagtaagctcctggaagtcaagatattttatattttcaaaaataaaattctcttcttcagaccgactgtgcccacgatagtttacagctacaaccaggaataacaaatgcaaggactgcgatcaagttaacatggatttgactgaatatacatccaaacttataagtgggttacagaaagtcaattggcaagtcatttgtatggaaatagtgatgagttttcccatttaaaagttaataatggccaggcacggtggctcacgcctgtaatcccagcactttgggaggccgaggcaggtggatcacttgaggtcaggagttcaagaccagcctggctaacatggtgaaaccccgtctctactaaaaatacaaaaaattagccaggcatggtggtgggcgcctgtagtcccagctactcaggagactgaggcaggagaattgcttgaacccaggaggcagaggttgcagtgagccaagatcatgccactgcactccagcctgggcgacagagcgagactctgtctcaaaaaagaaaaaaagaaatgagtaaattaattagtgtgtgtaaattgccaaaacttgaacaagaagaaacagaaaagatgactaatcatcaaccagtaaataaactgaaataatgaaagacatctccctttaagattttttctcagctcagttagctttctgggtgaacacagattccatgttaccgtggaagtgagtggcagatatacagcaatgtaggttgagcatccctaatccaaattttcaaaatctgaaatgctccgaaatccaaaacctttttagcaccagcatgacaccatgcgttgaaaatgttatacttgaccttatgtgacgagtcacagtcaaaacgcaggcacacaatacacagtttactcagcatcctcaagcagaaaaaaaaaaaaaaaaaaaccctcccagctcccttcagctgccatatatcttttccacatacacccagtttcccccacgcaagcaagcacacacacaaaggatagtaaaatggcatatgtgcaggccaggcatgctgatggcaggtttcccacaatgccccacatggagccaagacctgcatgcatgactcaactgtgtttggttgcttactctctttgctgtgtggtgtaaagatattgttgaaaatgacaaaatggcctgcagatacccctcagggtaactgataaaaagaggaagcatttatgtttacctctagcacagaaagccaagctgttggagaaactggacaggagtatatgaaacatccatatatgacctgaagaaacagaaggatacaccgctgaagttctgtgctgaaactgattcacagaagttagtgaagattagaaaactgcataaagccaaacatgaagattttgatcatgtattgaaagtgcggatctgtccacgtcacagtgaacacatggcacatagtggtatgctgaccatgaaacaaaggccaatgatgaactgaaaattaaaaggaactgtgaataatcaatagtctggttgcagaaatttaagaaaagacacagcattacatttttaaagatttgtgatgataaagcatctgctgatcacaaagcagtgaagaaattcattgagtttgccagagtcatggctaatgaaaatctgaagccaaaacaagtctataatgctgatgaaacatcactgttttggcatcattgcctcagaaagacactgactacagctgatgagacagcacctactagaattaaggctgccaagaacagaatatgctgggatgtgctaatgcatcaggcatacataagtggggtgatagataaaaacttgtgtcctcactgttttcaaggagtgaatttcttaccagtctgttattatgctaacaaaaagacctggagcaccagggacatcttttttgattggtttcacaaacatttggtaccaagtggctcatgcttgctgcagggagactcaattggatgatgactgcaaagattttgttattacatgacaactgttctgctcatctcccagctgaaattctcatttaaaaaatgtttattctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaatgtttattctatgtactttcccctaaatgtgacttcatcaatttagccatgtgaccagagtatccttagatcaataaagagtagattaaaaaaacacttttcttaaatagcatgctagctaccagcagtgtgcagaggtgtgggtgtgagaaagtgttcaaaaggagtttagcctgaggatgctctatatgctgttgccattgcttgaaacaggtgtgcatgactggcacaactctggcctacaactatgtcgactggtaatgaagtcaccagatggtgactttgaaggattatatatgtcaagtgagaaaaaaaaatgatggctgaactccttacctttgcaaaaaaatagaccttcacaatctgtcagttagctggaagaagtgaatactaaagaagtttctaacattgataacaaggctctacttgttcattcattgaccaatggtgaaatggccaaaatgattctgaataaggtaattgtggtaatagtgatattgttaacactgcagaaaaagtgcctgtagatgacagggtaaaattgtgtgatgggcttattgaagaactagagcagcaggcattcataacagaacaactcatgtctatttataaaatcaaagagagactgctaaaataagagctattgttgagatgggggccaagagggcccattagaagcagctgcagtccacagcacagagaggaatgaaagcatcaagtgaattcagcaccttcaactgaaatatccaggttctcgcattgggactgactaaacaatcaccctgatccagagagaataaagaaaagcagagtgggtcagtggcccacccaggagcctcacggagccaaaggaacccccacccccagcaaagggaagcggtgaccgattgtgcgacccgcccaggaccatgcttctcccacagatctttgcaacttgtggatcaggagatcccctcatgagcccacgctaccagggccttgggtccaataaacagagctgtgcggagtctcagcacaggtacacacagagacaagagttttacatactccggccccggaatttccagcaaggtgacagatccctttgtaccttcccctaggaagggggctgaatccagggagccaagcagcattgttctgcaggccccacttccacagcacctcacaagttaagtcccactgtcttggaattccagccagccaatggcaacacagtgagtctgcctgaaacaggatggagttccctgtgggaggggtggctaccatttctgtggtttggtcaactgcacattccagcctgccagctccagagagtctgggtggtccagatgaggaagggatacccccaacacagcacagctgctgtgccagattgtgcccaaactgctttaaagtgggaccctgatccattcctcctcactgggcagggcctccctgtggggggccttcaatcactccagccgggcttatatggacagagagctctgatctctccctgggatgcagctcccagaaggaggggaggctgccatctctgtggttcagtcaactgagctgttccagcttgcctactctagagagtctgggcagtccagatgaggaagggtcctccccaacagagcacacctgctctacagccagactgcttctttaagcgggtccctaattctgttcctcctgactgggtgagacctttcaataagggtctccagaaacctctgaaacgagcatttgggccagcagcaggtcagtacccaccctgggatggagtgtccagaggaaggagcaggctgccatctttgctgcttcacagccttcactgttgatacctccaagtacaggaaaagcagaggcaactaaggtctggagcagacccccaacaaaccacagcagccctgtggttgctaagagtcagtagcctgaccgtgaaaagaaaaaaacaacaacaacatcaacaaaaaagaccccacagaaaccttttcagaagtcagcagcctcaaaggtcgaaggtagataagcccacaaagatgagaaagaatcaatgcaaaaacgctgaaactcaaaaagacagagtgcctcttctccaggtgaatgcaacacctctccagcaaggcctcggaactgcgatgaggctgagatggctgagttgacagaagtaggcttcagaaggtgggaaataacaaacttcgctgagataaaggagcatgtcgtaacccaatgcaaagaagctaagaatcatgataaaacaatacaggagctgataaccagaatagccagtttagagaggaacataactgacttgatggagctgaaaaatataacatgagaacttcacagtgcaatcacaagtatcaacagcagaagagaccaagtggaggaaaggatctcagaccttgaagactatctttctgaaataagacaggcagacaagaatagagaaaaaagaatgaaaaggaatgaacaaaacctccaagaaatgtgggattatgtaaagagatggaacctgcaactgactggggtacctgaaggagacagggagaacagaaccaagttggaaaacatactttagtatatcatccagtagaattaccccaacctatcaagacaggccaacattcaaattcaggaaatggagagaaccccagtaggatactccatgagaagattatccaagacacatacttatcagattccaggtcaaaatgaaagaataagtgttaagggcagccagagagaaaggccaggtcacctacaaaggtaagcccatgagactaacagcagacttctcagcagaaaccctacaagccagaagagattgggggccaatatttaaaattcttaaagaaaagaatttccaacccagaatttcattttcagccaaactaaccttcataaacaaaagagaaataagatccttttcagacaagcaaatgttgagggaattcgtcaataccaggcctaccatgcaaaagctcctgaaggaagcactaaatgtggaaaggaaaaaccattaccagccactatgaaaacacactgaagtacacagaccagtgacagtatgaagcaaccacataaacaagtctgcaaaataaccagttagcatcatgatgacagaatcaaattcacacataacaatactagccttaaatgtaaacgggctaaatgcaccaattgaaagacacaaaatggcaaactggataaagagccaacccccattggtgtgctgtcttcaagagacccatctcacatgcaaagacacacttaggctcaaaataaagagatggaggaaaatttaccaagcaaatggaaaacagaaaaaagcaagggttgcaatcctagttctgacaaaacagactttacaccagcaaagatcaaaaaaagacaaagaagggcattatataatggtaaagggttcaattcaacaagaagagttaactcagctctggatcaagcggacctgatagatatctacagaactctccaccaaaaaacaacagaatattcattcttcttctcaccctacagcacttactcaaaacttgttcacataatcagaagtaaaacactccttagcaaatgcaaaagaaccgaaatcataagaaaccatctctcagacaacggtgcaaccaaattagaactcaagattaagaaattcactcaaaaccacacaagtacatagaaattgaacagcctgctcctgaattacttgtggataaataacgaaattaaggcagaagtcaagaagttgtatgaaattaatgagaacaaagagacagtgtaccagaatctctgggacacagctaaagcagtgttaagagggaaatttgtagcactaaatgcccagatcaataagctagaaagatctcaaggtatcaacctaacatcacaactaaaagaactagaaaaccagaccaaacaaaccccaaggcaagaaatagccaagatcagagtggaactgaaggagatacagacacacacacacacacacaaacccttcaaaaaatcaacaaattcaggagctgtttttttgaaaaaaattaataagatgatctactagctagactaatagaaaagagagaagaatcaaataacacaatcagaaatgataagtgggatatcaccactgaccccacagaaatacatacaaccatcagagaatactatgaatacctctatgcacataaactagaaaatctagaaaaacatggataaactcctggacgcatacaccttcccaagactgaaccaagaagaaatcgaatcccttagtagaccaataatgagttctaaaattgaggtagtagtaaatagcctaccaaccacaaaaaacccaggaccagacagatttacagctgaattctgccagaggtacaaagagcgggtaggtaccatttctactgaaactgttccaaaaaattgaaaaagagggactcctccctaactgattgtgtgagaccagcatcatcctgataccaaaacctggcagagatacaacaaaaaaagaaaacttcaggccaatatccatggtgaacatagatacaaaaatccttagtaaaatactggcagactgaatctagcagcatatcaaaaagcttatccaccaccatcaagtgggtttcatccccaggatgcaaggttggttcaacattcgcaaatcaataaacgtgattcatcacataaacagaactacagacaaaaaccacatgatctcaatagatgcagaaaaggcctttgataaaattcgacatcgcttcatggtaaaagctctcaataaactactgcccaaagtaatttatagattcaatgctatccccgttagactaccattgacattcttcacagaattggaaaaaactattttaaaattcatatggaattgaaaaagagccgaatagccaagacagtcctaagcaaaaagatcaaagctagaggcatcatgctacctgacttcaaactgtgttacagggctaccataaccaaaacagcatggcactggtacaaaaagcagacacatagaccaatggaattgaatagagaactcagaaattaagactgcacacctacaacaatctgatcttcaacaaacctgacaaaagcaagcaatggggaaaggattccctatttaataaacggtgctgggagaactggctagtcatatgcagaaaattgaaactggaccccttctttgtaccttatacaaaaattaactcgagatggattaaagacttaaatgtaaaacccaaaactataaaaaccctagaagaaaatctaggcaataccattcaggacataggcactggcaaagatttcatgacaaaaacaccaaaagcaatagcaatgaaagcaaaaattgacaaatgggatgcaatcaaactaaagagcttctgcacagcaaaagaaactatcatcagagtgaacagacaacctacaaaatgggagaaaatgtttacaatctatcttcctgacaaaggtctaatatccagagtctataaggaacctaaacaaatttacaagacaaaaaaaaaaacaaccccattaaaaagtggacaaaggacatgaacagactcttctcaaaagaagacgtacatgtggttaacaaacgtgaaaaaaagctcaacatcactgatcattagaaaaatgcaaatcaaaaccacagtgagataccatctcatgccagtcagaatggtgattattaaaaagtcaaaaaaacaacagatgctggcaaggttgcagagaaaaaagaatgcttttccaccattggtgggagtgcaaattagttcaaccattgtggagaacagtgtggtgctttctcaaagatctagaggcagaaataccatttgacccagcaatcccattattgggtatatacccaaaggaatataaatcgtcctcttataaagatacatgcatgtgtttgttcattgcagcactattcacaatagcaaagacatggaatcaacccaaatgcccaccagtgatagattgaataaagaaaatgtcatacatacacaccatggaatactgtgcagccataaaaaggaacgagatcatgtcctttgcagggacatggatggagctggaggctgttatccttggcaaactaatgtaggaacagaaagccaagtaccacgtggcctcacttataagtgggagctgaacaatgggaacacatggatacttggtggggaactacacacactggggcctgttgggggatgagggagagcatcactggaagaatagctaatgggcgctgggcttaatacctaggtgattggatgatctgtgcagcaaaccaccatggtacacattaacctgtctaacaaacctacacatcctacacatgtacccctgagcttaaaagttgaaggaaaaaaagccattgttaatgaggcagatgactctagaggcaacattttgcaaaaccatccaacagaatgcctcctcatccctaaaggacccagttcctggtccctcaattgcttttcatgtttcttctcacctgaaaacaaaaaatacagtggacagttacctttccatcaaaacacagcatggtagagacggaaagcctgccgttgtctgttgctgtctaacagctgagacaggtattctggtgatgctactgtgcttcttagttacctgaacacattattttttttaactgtattaatggcatatcatatttttaactgttaagtacatgtgtaagtgtaagaaaatgattgcttatcagtagtacatgaattcagagtcaggaataatggtgatgccaaacaaccacagattgtccacatgggtggctgagttagtgacacctttgctttccagtggctcctcgtatataaactatttcatgcacagaattattacaaatattggataaaatgacctctaggctatgagcgtaaggtgcatatgaaagataaatgaatttcatatttagacttggttctcatccccaagatatttcattatatatttgcaaatattccaaaatctgaaaaaaaccaaaacacttctggtctcaagcatttcagtgaagggatattcaatctgtatggctaaattctaccaaaagaagagattacttgtattacacaaatagctaaaggagatagaaaaagattaaatactacccaactaacttaatgatgttagtataaccttgattctaaaagtgaaaagggtagtacaagaaaaggaaaagggaaatccattttatttataaacacagatggaaaaaatgttaataacctaattaaatccaacattgcattgcatttgtttgtttgtttgtttgtttgtttagacactgtcactctgtcacccaggctgagcgcagtggcatgatcttggctctctgcaacctctgtctcccaggttcaagcgattctcctgccccagcctcttgagtagctgggactacaggcacgtgccaccacgcctggctaatatttttgtattttttagtaaagacagggtttcaccatgttggccaggctggtcttgaactcctggcctcaggtgatcagccagctttggcctcccaaagtgctgggattacaggtgtgagccaccacacccggccccaagattgcatttaaaagtactgaataaacaggtttttatctagtaattgacttgaaaacttaataagagtttaaagaaaatacctttagactagttccatcacagttctaatttttaaaacatcttcggctgggcatggtggttcacgcctgtaatcccaacactttaggaggctgaggcaggtggatcacctgagtcaggagttcgagaccagcctggccaacatggtgaaacaccatctctactaaaattccaaaaaattagctgggcgtggtggcacacacctgtaatcccagctagtctggaggctgaggcaggagaatcacttgaacctgggaggtggaggttgtggtgagctgagatcacaccactgcactccagcctgaatgacagagagagactttgtctcaaaataaataaataagataaaaataaaacatcttcatcaacctctggtaatctacagaaaacttaatgttatcgtgaaatcaaatacaatagcacttataggatatgtctcacaaaacagatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattggtgagtcggtataagtatctatgtgtaatatgtacatgctgaagatacaatgcaatgaaatgttgtctgtatcacctcccgttcacaaagatgcactggaaatgggagtaaggagtaggtgataaaccggcctgccttttgtgccaccagatatcacaaacaggctttctcagtggatctcaccagagattttttttaaatatccaacatttaaaaaaaaaattactacaaaagagaaattttagagcatactaataattaacaagataagtaatattgttgatatttttcactgggtggcaccctcagtcacaccatccaatgaagtctttctaatccatatagttgtctttcagaatgttctctctgtggctctcttaagcaccacaattctagaacatttgaaaaacacatatagtggtggtttactttagtagtttggcagtgtgttggactattaaaaaaatggataaacagataatcacaataaaaagacaaggagtcactgaatatagcaaatttggcatggattttttttgagtaactgtgatgagacatattttgcctttgactgtattattgacagagatgataacggtacttttttatttgtttgcttataccaagaagtatgtgataaatgtttgttgtatctagtagaaaattacaaaatgagatgatagaaagataatgctaaaattaaacatgcttcataatgctctgtaatcggtcgtttctaacaactcaaattcggtttttcacatttcacaaaaattataaacaatattttgcctgttttaatggattagatttttaaatatgcacatatatagccccagagatattaaaggctgcagttatgttttagtaatgtcattttcaaagccagccagcagcacatttgacaggaggttttatgcaatggcttcatgctcattctaagtagagataagcctggaacattctcagtgaatctgaaagagacctcgccataggcactctcagaattattaaaatgctctccccatggtcttttgtgctgaacttcaatggcagtgtattatcctttcccttttttgttcttttcccaaatgaaaaattgactccatctttaaaacaccaccaaggtaaataacagcactatacacattaagcatgtaccttcagggcagaaatgctgttggcctcaggttctgcagtcccctaaatgtcgggaaggtatagctgtagccacatggtttatattagaggattctgttgataaacttcactttaaggataacagagaaaagaggcttcagcaagataaatgctattttaaaattccagattggcttcatgtcaaatatataagtaaaaggacttctcttaattcagaattttaatagcaagaaataagtgaaagtcagcttgaacacatgctttgtgtttctcatgagagctttctaagccaggtaactttccctgttctcacctgcaataaagttgttatgttttacttacatctagagaaataaacttgaaacttacattttctcaaaaacttaaagacaggcaatggagcatggtaacagaataacagatttcacacagaaaacatgggtttgtatctcacagtgctattttgccagtcaaggcctttcattctgtagtttaacttactaaaaggagggagacttctgataatagcatccactgagagcttaccacatgcgcagtactgcaatacaattaacatgcattgactcgttccctcagaacaaccctgtgacgtagacattattatcccacattgcaacttagggaaaaacaaatagagacattaagtagcttgctcaggccatagagctgtaaagtagcagaaccaggactgaaactacagcactctggctttagatgaacgctgagctctccacagtatgctgtgtgcttgaaccacagtcaaaaggaaagtgttcaggcctgtgagcaaaaggtatgtcttacctgtcaatcaggtccaggtattatgatgacatatcattcagtgccttttattgagtacttgtccatttcaggaataatgatcaacgctgtaaacacagaaataagtaagataattggcttcaaggaacccacagcctcatctgaagttgagacagtcacacaattcattactatcagtatcatagagagagaaatgtgcttcaagatgccacatgaacacagatgaaggcacacaataaaattaggcagtatttgttaattgctgataaacacaacacgtattcagaagctgtggggatcagcaaaagcaaaagatgcatgctctctatcttttaagaagagtctaaagtggttagaggaaaaagaggaaaacatacatgaaaataactattacaaaaagtttaagcacaagttcacattgaccaaaatatgtaccataggacaagttccagtggatttatcaaatattaacaccttttaagaattttcaatagatttttgggtacaggtggtgttcagttacatgcaaaagttatttagtgattatttctgaaatgttggtgcacatgtcacctgagcagtgtacactgtacccaatgtgtagtcttttatccctcaccccttcctacctttcccccaagtccccaaaatccattatataactcttgttcctttgcatcctcatagcttagctctcacttataagtgagaacatccaatatttggttttccattcctgagttatttcacttagaatagtggtctctaattccatccaatttgccgcaaaggccattatgtctttctttttaatggctgagtagtattccatggtgtgtatataccacatttcctgtatccactcgttggttgatgggcatttaggttggctccatattttgcaattgtgaattgtgctgctataaacatgcatgtacaagtgtctttttcatataatgacttcttttcctttgggtagatacccagtagtggtattgctggatcaaatggtagttctacttttagttctttaaggaatctctatactgttttccatagtggttgtactagtttacattcccaccagcagtgtagaagtgttcccttttcaccatatccatgccaacatctattaaattttgatttttaaattatggtcattcttgcaggagtaaggtggtatctcattgtgcttttaatttgcatttccatgataattagtgatgttgagcattttttcatatgtatgaggcgtatcaaaaaatttttcttatgccatttgtatatcttcttttgagaattgtctattcatgtccttagcccactttttgatggaattatttggcttttttcttgcttttttgagatccttgtagattctggatattagtcctttgtcgaatgcagtttgtgaatattttctcccactctgtggggtgtctgtttactctgctgattatttattttgctgtgcagaagctttttagtttaattggatcccatttacttatttttggttttgttgcatttgcttttgggttcttggtcatgaactctttgcctaagccaatgtctagaagagtttttccagtgttatcttctagaatttttatggtttcaggtctcagatttaatctttgatccatcttgagttgatttttgtataaagtgagagatgaggatccagctttattcttttacatgtggcttgccaattatcccagcatcatttgttgaatatgttgaatagggtggcctttccccacttaatgtttttgtttgctttgtcaaagatcagttggctgtaagtattttgctttatttctgggttttctattctattccattggtctatgtatcttttttattttctatagcctaattgtgaaagtggcatgtctatttttttaatacctttcttgttagtacaaaaaaaaaaagccaaactcaaaacttataaccaagaagttatatacatagtagaaaagtacatttaaaatagtttatttctctttttaaaatagtaggccaggcgcagtggctcacgcctgtaatcccagcagtttgggaggctgaggcgggcagatcacctgaggtcaggagttcgagaccagcctcaacatggagaaaccccatctctactgaaaaaaaaaatatacaaaaaattagccgggcatggtggtgcgtacctgtaatcctagctactcgggaggctgaggcaggagaattgcttgaacctgggaggcggaggttgcagtgagatgagatcgtgccattgcactccagcctgggcaacaagagcgaaactccatctccaaaaaaaaaaaaaaaacaagagtagtattacttatgtattggaaaaaccttgggaagcaaagattattcgtttattatttatttactatttaattttactttttaaaatagagacggggtctcattatattttccagactggtctcaaactcctgggctcaagtgatcctcctgtctcggccttctaaagtgctgggattacagacatgagctaccttgcctggccttaaaaatgattttagcttggccaggcgcggtagctcacgcttctaatcccagcactttgggaggcccaggcgggcggatcacaagatcaggagatcaagatcatcctggctaacaaggtgaaaccccgtctctactaaaaatacaaaaaaattagcccggcgtggtggcgggcacctgtaatcccagctactcgggaggctgaggcaggagaatggcatgaacccgggaggcggagcttgcagagagccgagatcgcgccactgcactccagcctgggtgacagagcaagactctgtttcaaaaaaaaaaaaagattttagttcactattaatattgttgtagaaaaacagctcctattaacatttttcctcaggtttcttacgtgggttttttggtaatagtatgtattctttttttttttttttttgagacagggtctctctctgttgcccaggctggagaatagtggcgtgatctctgcccactgccacttctgcctcccaagctcaagcaattcttgtgcctcagcctcctgagtagcagggactacaggcacaggcatgtgccactacgcccagctaatttttgtatttttaatagagacagggtttcaccatgttggccaggctggtcctgaactcctgaccttaagtgatccacccacctcagcctcccaaagtgctgggattacaggtgtgagccaccgaacctggccaataatattatgtattatttatataaatatactgatttttcacatacactattaacataattattttctttttattatacatgcttcatagataggttttgtgatgaataatagtctttgcaggtgtgttttagttaatcatagtcctattataaggatattcaggctttttagtttttcagttacatgtagtactgtcataaagatctctgtagaaagcttttttcattttcaaagtgatatttttaagatgtattcctagacatggaattaccgaattgaagaagatgaaaatgttttaagttcttgacatttctgccaaattacactctgaaaagattttcaatatactgagcacagagtatcctcttttcaaatatttttaaaaatttgttattagggaaattacatctttccatgtgttgttaaccagctgtgtttctttttaagaaagttcttggccgggcgcagtgtctcacgcctgtaatcccagcactttgggaggccgaggctggcggatcacgaggtcaggagatcgagaccatcctggctaacacggtgaaactccgtctctactgaaaataaaaaaaaataaaaaaataaaaaaattagccaggcgtggtggcgggtgcctgtagtcccaactactcgggaggctgaggcaagagaatggcgtgaacccgggaggcagagcttgcagtgagccaagatggtgccactgcactccagcctgggcaacagagcaagattccgtctcaaaaaaagaaaaagaatgttcttcacccaaaatatattgggatcttgggattaagaaacaatctttttaatcaagtgttttgttttttttttcattttgtagccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcgtaagtccttcagttctgcccgtcagctgcctccctttcccctcaccagcctgtgtgtaaataatccggttgtgaatgtgcggtcatgaccatcatgtgcaacatggcagcaaacaggatgtaaagccaggccagatcatctggtcagccctcagtgatcagccaaggaaagaactgaatccaccacaccacatgcttgtcccttctcttctaaagtatcaacagagggtcagactccagaacttctcttggttgtgcattccagcattgtattggcctaatgaattagtttcccaaagccacagctgtgatttaataacagcagaatgtaggcaaagcaggagtcctctgaataggcaagtgcccttttcctcacttccatcttaggaggggatgtcacaccaggtggtttagaagaagcagtgatgggctgggcacagtggctcatgcctgtaatcccagcactttgggaggcccaagcagatggatcacttgaggtcagaagttcgagaccagcctggccgacatggcaaaaccctgtctctagtaaaaatacaaaaattagctgggtgtggtggtgcgtgtctgtaattctagctacttggaagactgaggtttgagaatcacttgagcccaggaggcagaggttgcaatgagccgtgatcgtgccactgcactccagcctggttgacagagtgagattctgtctcaaaaaagaaaaaaaaaaaaaagcagcagcagcagtgatgacacaggagaagcagtcagggggtagcctgatgagaaagtcttgctttcacagttttttctctgtcttatctcttccgcatcttattcccttttgataatagaaggtccaatgcatgtcattccacatctgtgttcctgttttcaacttttccctattaaaaaaaaaaaggaggagaatgaaaaaccttgtataaccaaattatttactattagttaatttagagtgatgagattggaaaggggcatgaagattatctttttctctttatacaattctgaattgtttgacttattacaaatagatatgttacttttgtaaataaccaaacaagaaaagaaatggctatgatagcctagttttaatgagttacaaagcagatgacttcacctgtactgaagaaatgtgtgcttggctgtacagggatgtacatgttacctctactacagccccacccaatttaggccccttctgctctgcagccccactctgcagtgcacacaaggaaggaagactgcatttagagtcagattaaaacaagccctgagcactggctggagtgtcagttccccaagaatattcacccatccccagaggctggcagatagtattagagttgctcagtctttgtggaaagagtgaattactgttgcaaaacagaaatgacttttcttccaaatagtcatccaaacttccaagcaaatcaccgtaagatagtatgatgctcattattcgagtattcagacataacaattgttgcacatggcaatatgcaattacttttggaaacttctggtagcttagcaagataaggggtgagctactctgttacttgtttatttccgagtgtccacttgtgagtcctcacatgccctgtctcaaaaacaaaagttaacaaggagcttcttgccagtggtgtctgctgctctttccttactagagtgttatatatctgacctaccgtttgtggactagcctgggaactaattatcatttataacattacatctttgaataaaagagtaccaagtatcaaacaaccaacttataaacaaatattatgaatataacagccttgcaatttaataactttttacagttttgaatattagagacccatcactttgatggatttatttgcccttcagttattaccaagtgattctgaaaagtccaggggttactaataagtgctgatttgactgctcctccctgccaggctagtatggaggagaaagacttttcactcttgaaggaacacaccatgctcttctccgtacatctttgcactctctggttttggttttatgtttacaaatgcctgtgatatggggggaaaaagaatctttgtttaagaaaaaaaatcagccatgtgctaatcaggtgatagaagagaaagagatctaaggcggcactgatctaagccagaggtgggacatttaggataaagttaaaagcagaacatgggctgggcacagtggctcacatctgtaatcccagcactatgagaggccgaggcaggcggatcatgaagtcaggagatcgagaccaccctggctaacacagtgaaaccccatctctactaaaaatacaaaaaattagcctggcgtggtggcatgcgcctgtagtcccagctacttcggaggctgaggcaggagaatcgcttgaacctgggagacggaggttgcagtgagccgagatcgctccactgcactccagcctcaaaaaaaaaaaaaaaaaaaaaaaagcagaatatgaaagactaagtacagttcaaatgcagtggtgactttgatttatagcaagaacaagttttccatttgctctatatggaaacgtaaagagattttgaaactgctttaacaagggctgccacaagaatttcttttattgacttgaaaaattactcctacattcatgatgtcacaaaatcgtatgtatttttcagtcatggtttcatgcatttttattctataaacatacattataagtatacaaatatagattatattctataaataattcaaggatttataacatatctaaagatacattccttataaatatcagggatttttctgtataaattacttgtttgtttattattattattattattttgagatggagtctagctttgtcaccaggctggagtgcagtggcgtgatctcggctcactgcaacctccgcctcccgggttcaagtgattctcctgcctcagcctcccgagtagctgggattacaggcacacactgccacgcccagctagattttgtatttttagtacagacggggtttcaccatgttggccaggatggtctgacctcgtgatctacccacctcagcctcccaaaagtgctgggattacaggcgtgagccaccccacctggcctataaactatttatttattagcactgtgctagtggtttaaaaagaaaacaaaaacagatatggtccccgccttgcagagcttgctgcctaattgtctggtcaccgagtggcctgacttcatggatggctgctgcggagtagcagttgaggagcgaagaggtcttacagaacacccacaggccgcatccagaagcctcactcattctccctgatctcagaatgtccttttcttttcagctatgcctccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcgctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaa

SEQ ID NO: 22 - DNA, 26450 bp, Homo sapiens
  source 1..26450: mol_type = genomic DNA
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggtgagccgggcccgcggcccgccctggtcggtggcgccacctcgacggcaggcggcggggagtgggctgggccggggggacgcgaggcggcggggcccgggggtcggcgaaggcccctcgcgggcggacaccggctccgcgccccgccacacactcccgctgcgcccggacgagtccccgctccggacccgcccttgacaggcgtcggggcgaaaggaggccccgggattcggtggcccgggaagcgaccccgcagtggctccggtgccgtccacggctcgactccagggcggaaggccgggtgtccagcgctggcctcgcgctctagggctgggagaggggcggccggcctggtcagctccggaggccccggcccaccgtggcccctgctgcccgctcggcctccgggcccgggacccgcggcgcaccctgctgaccgcggactcgagggggacactcgcaagcttggatggtggttttggggggaattttaccgctcaagttctccaacttggttgaggggtatcttggctactgtcccatgttaggcacccaatgactctggaggctggtgtcaaaacattcatatatatatgtgtgtgtgtgtattttaaattaaaattgtattattgtttgaaagtgctttcaatatgaacgtatcctagtatgatttgtaaaataaaaaacagggtgtgcttctccccagcagtttctagagatctagactagagatctgagactgtcttacagttggccattgccttaccacattgcctcacactggagagaaagagaatgatacgtgtatatttataatggcattcgcttcctgccttgttatggtattaaaatacttaggatttgttaccagtacacaaataactgactaatgatactcttgtgaatacagcagaagtatgtctcatttacatacatgcaaggatatatacttcttaatccccaagagcatgaaatttgaaaatgtaaatttggaatgagtgtgttaattttcaaaaatcagagttagttatactattctttcaattttttataaatttgagctttcaggataaaaagtttttaaaataaatatgttatacttaaagctgaattgttaacgccgtctgggcaagataaaagcagcaaagagctggtaaattattttgaagatttaaaaactcaccaaattaaaactgctgtgtaacccattgttttagaagaaagacctgtattatttcccttcatctttatgcactttttgttttaacaatattgataaaactccggtgcccagcagtgagaccgtgtacaggcagcagtttacatttacgagagattagttgtatatttattcttgaaaattagtacaagaggctgtaattagctgggatgggcacagttacatatacctttttgtgtgtctgttccacccatttttgggtgaaactgacactcatttcaaaccacctttcttaggagtctgcgtggatgtacatgatctttagtgtggtttacaactattattttgaagccttcttcctgtagacatagggatagtggtatctgttggcagcctttgttgtgagtgaagatcaagtttgaacataaacattcccagcactttgttctcagcatgaaacttacccagcaagttgagatcttcctgtacccacctggtgcatgggttaggctgtgatttcataaaccttattaaaagaaaaaaagcaggtttagttaccattattcttgtcagcaaatacaaagaactactaaatcagaagtctgatgctgggaagatttatttgaaaatttcacggtcaaaattttaaagttgaaatgtccttgaagatctcttatgttaggcttctttattttctgaaacccagagagttcaggtgtgactttgaaggtcatccagctagtaccaacaacagggagagaactagtgtcaggaaagtcctaataagaggcagtgtgtctcttcagaagttggaagtgagtgttttgggaaactgaggcatgcaggctagaatacttgattatttttgtgccctcctggccaccaagttattgggtcactgacctctgtgctgaggttgcttggattttgatgatgggactgatgaactcaagaaaagagttccctttaccaagtgaatgacttgagacttgtcagcatggcaccaaaacttaaggagaaaactaacattcagcccatgagctgtttgtgcttcattgctttcaatcctgtgctttgacacacacaatatcaggttgcacttgtgtgagttacaccttactggagactaaatgtagtggaaaatccttgaatatcattttgtatttgaaattggcttctcaatgcataatgagaaaaaggcccttgcagaaaacaaagggcgattttggaggagctgagctgaggcccgtctgagcatcatcatcttcaagaggaaatgctgtcaatcagtaaaaagctgttcattgagcatgaggagctcaagagacgacctctcttttgggggaggactcagcttcaggatgtttaaaatttaatcacgttagtaagaaaatggaaagaaaagactagacctttgtattttatttcgtcttctactgccgtcttgcagttgatcttccgccttctcctgaagtagttaggacaactccctgttttcacagaggggcagagcgaaagcaagtatcttctgtcattgctgaagcaggacggctcccggcaaagatgctgggcttcatccagccccattctaagcagctgggcctccccacctgcagtcttcctggattttgattttctgcacacttgggcttcccactaatttggcaagttcataccagtccaggccctttcctggcagaggatggcattcagtgctggtgcagccactcctccaggctcctccctgaataaacagaggccggatgttctggagtgctgttcccgccaggcctccttgggatgagagggagaccttcctccctcatggagcagggccgctctagctccatggatcttgggggttaccagtctggcactctccagggagtcctgttaagaacacagattgtggctgtgtctcatcgcctccctgccccaaccccatgttcaaatctgaattgctcagtgtagggcccagaaaactattaagtccagaaagcttttttggtggttctgattctgctgcactggcagtgggagccacggatggccagtgatcccattttggggaggaggagctgcggcttagtgcctcctgaacatctatcctgcagagcattttcccaagcctccattttccttcttggggaaactccccaggtacgcgggcttctggaggtgtgaatatggggatgacatgggaagcgagccgagacagcaccttgcaaagtctggcagggtggctggcagtgcgagagtggggaggtggtccagagatcttcctggaccccaggaagaagcaagccagagccttttctttttgtcttgcccatctggcagaatctcaccataatcatttaacagattatactcaggcactgtgacagggagatagaaacatcctttcagataacactggaaatgtttcgagttatgattgaagtagagagacccatttattttgcttaaggttcagcagagcctcctgaattttcttaaagatgagatcgttttgctctttccagatctattgcaagctgttatgcctcttagcagaggcggagcacaatcaggaaatgagtggccgttctctccttcgtatttccagcaagttgcagttgtggctgagcaagttcctgtgcgactgcatgaaagtgatttgttggggggcagatgaacagcatggccagatgccttggagcccagctcatccaggactttcattttcccctctgaagaacagcctgtgttgttcacatgagaaccgactgcacctccgagaacatcatttgtcccgttttgtagggtagatttgccctttatgagggtggagcctgtacacaggacctgcggcagcgtttgacgttggccagggctgggaaggcttaactgttggatgctatcagggctgcttgtgagtcagaaagcttcataccacccatgaggcttgcttagtgctgtcctcgtttctggaatgacacacagtcaccttatataaaccactctacatgtttattactttctattgacatttaaaaatgatgttctgatgtttatcatccaaagtagaaaaccattcatcatccagacctactctttctcctttaagttttgctgttttaatattgctcttaaatgtttaagagagcttacagaagaaactgaagacaaaggccttgcttattaggatctttgagaccctctggcactggcgaacacgagtgaaccctgtgtcacacttgaccgtgttattctccagcccctcctgggttcccttttgttgtgagtcaagtagacacctctgatctgcttctgcctcagagcatagactcagctggccttcttttttttttttttttttttgagacggagtcgcactttgtctcccaggctggggtgccgtagtgcgatcttggctcactgcaacctccgtctcctgggttcaagcgattctcctgcctcagcctcccaagtagctaggattataggtgagcgccaccatgcccatcagccggccgtctgaggcaggctccagagccccttgttttgcaggtgcaggattcatctgtatgcatcatgtggcacatgtgataccatgtgaggtatctggtgttactaagtcgtcacgtatttcgatgaaggtatctttgggaccttggcagccttttaggaagccaggcagcttgcaaaagcttaggaagaatttggggggagaggaatgaatgtagtatttttctgtctgtcaacacacacacatatatatatatatgtgccagatatgagtgggtgcttttggtaaccttatctctaaatcctcaccagctctttgaactagaaactatgaagtgtcttacacatgggacagcagatttggagaggcagtgtgcctggcctgtgataaacagaaagacttctgtggctttacccccatctgagttcctgaaggggtgacagacagacttgcctttagcgggcctggctgctttatactccccaggcacggctgctttatactccccaggcacagcttgaggtgataaacagccctgagtccatctttgtatagttaatcagaaatgttggcctgtttcttgaacctgggtctggatttaggagatgggcccgactctttactcactcctttaccccatctgaaattcactgagtgcccacagtgtgcgagtcacagtgttaaatgccatatagaggacaagtctgcccactttgagactgttctccacaaagcatgtcctgcctctccctggtccgaagcaggctgtctctcttctggaacccatattattttaatttgaatctttttgcttaagctctgcacttttctgctttgtcttggggtcacacccctgttaggagttctggggcagagtctgtgtgcttcatcgctgcctcttgatgcctggcagggtccacaggctcagaaaagatggaacgagtgactgtggagaagggtagaacatgggcctgcccagagcgcgaaggcagatacagaagagctgcccgtgaaggatgcaggtgtgtcccgggaagccttccattggttcctaagaactgcagagttgtcctgggctcctaaaggtccccagaggcctgctcctttttgtcactttgtgaatggccttctctgcacaaaggacttcagtattgattccctaagttcatccttacaggtctggagaagctcttttttgtttctcccaatgacacagcatcttacagcagggctggagaggctgggagctggcagcagccagaccctacttccatagctgtgcagagagcagcccctggcactgtgaaaagagtctcttaaaaattttttttcgtgtggctggcagcaagatcagacaccgtatacgtgaaggttcttattcactgtcaattcagaaaagcctagaatcgcagagtgccagctctgtgcgtcaggagcctgtaaacagctcagctgtccaagagctcccagcacagagctgtgccccagtgaactggggagactttttacggaaaattccttagcattcaattggagaacaaacgtttgctgttttaaagtatcttcctcagtgtttattaaagtagaattatatatttttttcagttatttaaaaaattcttccttgacattgaatgaatgaataaatgaatggatggtttaaaaattcatacagtgggaggatgggaaggccccttcatgtgcagaagaaaagccagccccttcgctggcccaccctttcagggtcagttcagacccccagcatcccagcggggttagcactccttcctgggttggacggtgtcttccccggttctgacagcgctccatgccgggcgtccctgcagtcttggggctgtggtgactcagaattaagctgagtgctctcactctcgtgtaccctgcctggctggcctgatgactcagcatggagcgctggctccctgacccagagcacacttgaactgaatgttccaggtctgagcctcagccgagcgtggctgggcgaaatggaagcctttctctcctgctgcctctcctgctgcattttaccccgggagatgaaggttttggagacgttagtgacacatggatgttatcacagtgtacagctgtgacaggagtagcagaaaggttagcatctacctggccttaccatcagacaaacctgggttctagagatcttaggcaaagcacttacccttcttgagcctcagtctcccgttgtgtgaagtgggcatagcaacacttctgttagcagggttgggagaatcaaggaagatggtgtgtgggaggcgaacgtcccaaagcctgaactgatgcatgcgtggaactcccggaaacatatgcagcctgctctgtggagtagaagtgtgtttgtggataggtgtgtggcctctccacacagcagactgtcctggctgtccgtgggcctttcagctctcagagaggcctggggtcttgtttcttagaagcaaggcctcctcttatcccccttgtatggagtgtagctgactcccccgaccagtgtccaggtggcccttggagccctccctggggcttcccgtgccccttgtgagtggaggatgtaaaggaacagtaacagatgaagctgcggggccttcgggagccttgacccagctgccagaccctgcgccatgcgtccatagatgcatctccccatcctctgcccaagataggctgggtccttgtgtcctccactgtgctgtgtagagcgctggctttactcagcctcagctcctcaaggggagggtctccctcagctgtgtctgtgcagccgcaaagtaccaggcaggagctaggagcgctgcctgtgaggggggacatcagcccaccttactgaggggccgattacctgcacagctcttctggacccagctctcaggggtgtaaatgtcaccgcagatggaaggaaggaggggttttccaagtgccaccaccctcttctggggggtgtggctgctgtggaccgaatgcttgagaagccactgcaggtgggagcagagcccccccgggactcaggggtctcaccgtccatcagagagggtccccttgcctgcatggcagctgatgaactgaggatgtttttcttttggaaattgtattttgtacagaatacacgtccgctgatgtcctgtacactgagacctaacaggcacttgtagggtcgtgtctggaggatggacttgccaggtggctgaccattccatttagcatggaaatgtagcagttgagagaggtccttttccttgactctgtctaaattcagagtttgcttcctgggatggaaatttcagatagtttccatctgtgatttgtgactttggcttgattaaagcaggtggctccgctcttttttttttcccctgaagaagaggtaggtaggttctaacatgccctgaagctaacttcatgtgaccttgggccacattccagttcctacctctgccacatggaacccgtgaggcaggctgcagggctggggctgcagggaggctggatgctgactcaggtgcccccagcaggggaaataccagcagctgcggatggtgcctggcctggagacggctgacgtgtgccctggtgaggggccatcgaggatgttgaggagacgccagcagatgttctgctcccaggcggacccttctgtgccccagcctggcctggcttttctctctaggcctcagggagatgtgtcaaggaaccacagtcagtgcggctgggcgccctgctcagccaggagtttgtctgcagagcaggcctcttccccagagcagcggcccagcctgttggagaggtgggtcgtttagggctcaggtccctagagttgtctttggctctttgcttccaggctgtgaaactttagataaagtcttaagcagagaaagtgacatccttgctaattagtcctcttaagactctcagataaaggggcttctaattctaactgtcttactaccaacttggtgagacagactaaagaattaggctttgttgaacagggcgcggtggctcacacctgtaatcccagcactttgggaggccgaggcagatggatcacttgagcccgggagttcgagagcagcctgggccccatagtgagaccttgtctctaaaataaataaataaataaatatttttttaaaaaaagaattaggctttgtaaacggtaagcccaaccagctagtgctggagaaaagctgagtccatcaataactatttgtggaataaagaaatgcaattgtggctgggcgtggtggctcacggctgtcatcccagcactttgggaggctgaggcaggaagatcacttgagatcagaagttcgagaccatcctggccaacatggtgaaaccccatctttactaaaaatacaaaattagctgggtgtggtggcacatgcctgtaatcccagctactcaggaggctgaggcaggagaatcgcttgaacccgggaggcagaggttgtggtgagccgagatcatgcctttggactccagtctgggcaataagagtgaatcttcgtctcaaaaacaaaaacaaaaattagctgggcgtggtggcaggtgcctgtaatcccagctactcgggaggctgaggcatgagaattgcttgaactcgggaggcggaggttgcagtgagctgagattgtgccattgcactctagcctgggcaacagagcgagactcagtctccaaaaaaaagaaagaaagaaagaaaaagaaacccaattgtttagggcacagagcagctcagagtttacaaagacttgtaccttatttcgtaccttatttcacttaactcttgcaaaaacccctgggaaatatggggatctttacagctgcggaaacagtagcaaggagtcctgtccatggtcacacagctggtgagcatcaaggagggactggaacccagggtggcaccttgaagacccgggctcatgctggttcattcctgtttatttggacacagctgcaaagagaagcaatgttggtttcatcttctaaaaaaattttttttcccattgaaaacacatagggacagtcatctgtttattccaggataaaatgtatatatattttagtaacaggcatattagataaagcctccagtagcctgtgacttatgatagtttatagagtatgtggttggcacacacctcttgtcttaccaggagtctttggacaaagcctaactcctcaggtgtcctgtaagtggaatgtggacttagtttattattcagaattttccccaactctattatgtgcccaaaatagtgctgggggagtgggagagaccctgtattacaatccagtggggactgaagggattttgactttggctgtagggatgttaatggctgtttattgtgtatttcagtatcaaatgggcagtaatacttaattcattcatgcaccccatcatagcaagcagagagcttcggtagggtgctgaagctcgactccagttgcactttgttttttgttttggttgttgttttaattcagagcctcactctcttgcccaggctggagtgcaatggcatgatctcagctcactgcaacctctgcctcctgggttcaagcgattctcctgcctcagcctcctgagtacctgggattgcaggcccccgccaccatgcctggctatgttttttttttgttttttttttttttgtatttttagtagagacagggtttcaccatgttggccaagctggtcttgaactcctgacctcaagtgatccgcccgcctcggcctcccaaagtcttgggattacaggtgtaagccaccacgcccagttccagttgcactttggaagaaagtgtgttttgtttgtttcctgcctgatggaggcgagccaggccacttaattttgatccaggccttagccatatggggagttccaggatttctgtgttcttgcatcttttttctttgttttagaagttttgaagtgttcacttgacccatgtgaaggctcttctggcctaaaaacccagttaatacagtctgtgtcctacttaataccccaggcctgccaagtcggaagtgctacgagacagccctaagagttgcctttgttactgtttctcctagttcagaccagagtgatggaagctgtggtttgtagatgtggagcccactttttaaagagcactgtacctggccaggcgtggtggctcacgcctgtaatctcagcactttgggaggccgagatgggcagatcacgaggtcaggagatcgagaccatcctggccaatatagtgaaaccccgtctctactaaaaacacacacaaattagctgggcatggtggcgggcacctgtagtcccagctactcaggaggctaaggcaggagagtggcgtgaacgcgggaggcggaggttgcaatgagccgagatcgcgccactgcactccagcctaggcgacagagcgagactctgtctcaaaaataaaaataaaataaagagcactgtaccatggagccaagattggggctcacagaaggtgcccattttcgggtttcagtgaccactcagtgtgcagggagtcagttgtgggtgggtcaaggtagattcttctccacggctctttcatgaacatgtgcctggcgtacgcctctctaggcagacaccttgcaggtgcccaagggttgtggttcccaccctgcttttagggcacagggttgggggttagaggcttccttctcttcatttgtttttggttttgtttttttgttgttgtttttttaagacagagtctcactctgtcgcccaggctggagtgcagtgctgcaatcttggctcactgcaacctctcacccctgggttcaagcgattctcgtgcatcatcaacttcctaagcagctgggattatgatgcccaccgccacggccagctaatttttgtatttttagaagagacagggttttgtcattttggacaggctggtctcaaactcctgggaatggatctgacctcagatgatccacccgcctcggcctcccaaagtgctgggattacagacatgaaccaccggacccgggccctcctcttcatctgggacatgaaactttggggtgctctgagttctggcagttctgatatgatttgagtgtagttaggagtagtcgtttttagatttctgtgacattaacttttccttgtttgggggcttgtatagctgttgagagcttgaagggactttggaaatcaggccacgcagagtgtcagagctgaaaggaactttccatcatcgtttttctcactgcggacctttaggcttcctcacacacctacggaatcagacctacttgggttgggcttaagagtctgcaatgtttgcatttcctgggtgcttcgataccccaagtgctggagaaccactgctttctagaacatttttgggcctccccttcattttgcagctgagaaaacgaaagttcacagagggcatgtgagccacttccgtaacacatgtatttaggggcagagccagcgttaggaccaagtgcagcctcttccgagctctcctgctgttccctcagcgcccatgttgctgctaaaaaccactagtgcagtttagacctgctcttaagcaaacgagcccaacagctcaccaaagctcagaacctgacctcaggctttctctaatcataatatcttgtacataatagggcaaattttgactcatctggggtcatttttttcctgctttctatcttggccatctcatggagttgtttggtgccctgagacatgcctcagatttttcagatttttaatgcaatgcacaaacaagggggcagaattagccaattcattttataaattaatatagtgagataagcagtgagagtcaggactgagcccctgggctcttctttcctaattggattttgtataatatgtgttcctgatgtctttagccgagataaggataatgagctctgagctgcaggcgggccctgatgaggtggccatgaggatcagcagtcatctgcttggtcaccgtggttgcatcccagtccctgtcccatgatcacacagagctgtccccccaactttgaggaggcagattccgagctcccgcttgaatcaggaaggggcacatagtaagccttatctgagagatgctggtgtaaccaagaggcattatctggatgtgcttgaacttgaaaacacttagtagactgaagagacatgttttagtcagattctagaattataaatattacacattttttcttttgattcttttatttacaaaatatctctctttgctagattgtgttgaaaacaccatagaagagagaaagggcaatttaactcttccaggtggtgttttttgtgtgtgtgtgagagtttttttggcagagtttcactcttgtagcccaggctagagtgcaatggtgtgatcttagctcactgcaacctccgcctccagcttcaagcgattctcctgcctcagcctcccgagtagctgggattacaggcacccgccaccacacacagctaatttttgtttgtgtgtgtgtgtgtgtgtgtgtgtgtgtgtgtgtatatatatatatatatatttttttttttagttggagtcttgctctgtcgcccaggctggagtgcagtggtgcgatctcggctcactgcaagctccacctcccgggttcacgccattctcctgcctcagcctcccgagtagctgggactacaggtgcctgccaccatgcccagctaattttttttttgtatttttagtagagatggggtttcaccgtgttagccaggatggtctccatctcctgacctcgtgatccacccacctcagcctgccaaagtgctgggattacaggcgtgagccaccgcgcccagcctaatttttgtattttttttagtgaagatggggtttcatcacgttggccaggctggtcttgaactcctgacctcaggtgatccacccgcctcggcctcccaaagtgctgagatgacaggtgtgagccaccacgcctggcccaggtggtgttttttacttagtaaaagcggaagcatttgctgttgtgaccctaatgatagtggatgggaacattagaatgtggcatcagcattcctggcatagacctcattacgggtgggagtttcatttttcattggaattattcattcatgtagaagtgtttaattgcctattttgtgaaattcatgttttttttatttaaagcaattttttgttgttgttgtttttttttaaacaaaaccccaccagagtagaaggggagcctggaacgtcttttagatgcagtgctcacaaggagacacttggttttttattaaatggcaaaaatgggtcattaattcacccaagcccaggaatacagacctcgggactgttggagaagcagccaggccgcccttgcctgtcctgaccgtctctgctttccagctgtgccggcaggcttggcctgttcagtggacctcacgcacggtggagacctttccccttccccccacatgcctctcatttttctgggtgccctttaccctccaggccctctgccctgctttgtgctcatctcctcctccctgacgtccttcttcacttcccagcatgtcctggcttctcctttccagtccctctgtcttgctgaggcatctcctgtgatggttggaacactcagaagggtggacctcagcccccacttccagcctggcccctggtctctagcctcatctccctcagctcagcactgacccccaagcctgccccttgccactgcttcccaccactcttctgacaccactgcccctgcctgcagtgaccacattccttccccgtggaccaagccatgtctctggaaaggttgaatattggctccagcaagcagtctctgctgtcacagtcttgtgtgcagacagagttgtttttccttcctccctctctctcctgtcttattccccttctctttttcaatggaggcacaaaatgtgctcagcgagatgcacgaggtgctcagcgagatgcacgaggtgctcagcgagatgcatgaggtgctcagctcgtggctggctcaagggctttctggatccaggggcttcccccaggaggagctgcatctcctcaaggcctgtctgaggactccaagccctggaagggtctggctataaggggttgggatcagcagctctcccagttaaaaccagagagtgtgggtgggatgtggcagagtgggcagtgtgggggtttgatggagttttacacagccatacacccatttaccactgcccagaaaaagagaatattcccatcacctcagaaagctctttcgagacccttcccagccactaccatctcctccagaagtgaccaccattctggtttctagcaccatcgattcactttgtacttcactttttcttttttttcttctttttgagacaaagtcttgctctattgcccaggctggagtacagtggcatgatctcagctcactgccacctctgcctccggggttcaggtgattctcctgcctcagcctcctgaatagcagggactacaggtgccccccaccatgcccagctaatctttgtatttttagtagagatggggtttcaccatgttggttaggctggtcttgaactcctgacctcaggtgatctgcccgccttagcctcccaaagtgctggtattacaggcttgagccaccgtgcctggccctatccttcacttttgattcctttgacactttggagtctgaaaagcataattttgtgcgtatttagggagaaactcacatttattgccagtcttccgggcatccctcttgatatgcccttataaaacctcacaacatttctccagggcaggtgttggctagctccgttttctagaaaaggaagcgaaggcttacagaggtaagagaattacccaagctcacagaactgttagaaatagaggtacgaatcacacttagaccctacctagggcagcgtctaccctggaagagcctgtgcctttccccatccctcagggcctccgtgctttccaagtaattctgcttcttgtttgtttcctgcccccttagcccatcttctaagcccctgttggcagggagtgccccttgctggtttggtaaccccataggactcctcagcgggtggcaggatgttcccccaggtggtggatgagggtttgctcactgctggtccctgctgtgtggagtgtgcagatggttgaggcttttgtgcgtggctgggaagaaacaatgagcccctgggcagccagcaaaaatgacactgcaggactaatgcaggctccgatttcggctggaaggaggaggacctcagtgagtggacagaatgcccacaggcacgttatgactcaacactgagtagcagagggtttcttcagcgcctcttgctggctccctgtcagggccatctcacggcaggaattcagctctgaatgtgaggcctggacctgctcctgctcttgggtgacctgagagttaagcaggctaatgtaatgccgccgccctgagcacgtggctgttctaatctgagaatgcctgtctgcccatgtccccaaggacacagtgacacccatgcctttcctgtgtgctggaggccctccaagggcagggtctcagcaggagggaggcagttgatgggcctgaaagggctaaaccagggtcagccacctggtgcccacgcctgcacacaaatagaaacatcacagaattaatggtctgttctctcaaagtgcagagcagccctcagtatctgtccttacttttgattgattccgcagcagtagagattgtcccctgcaagctcatagattgttagcctttggcgtttgttcgccgtgcagacagctgccttcgtcaggaaagatcactccccttcttaagagttgccttacacagatatatgcaaatgacacttatcagtagctcccctcctgggaaaggaccctcggtgctcggggactgttaggacttctgttgcgcagcccagcttgctgagagatggcattgcccagtgagtgactggccagccttgttgtctgaaataagatctttcctgtggtacatctggaacttggccttctcaagggtcccaaaatagccaggccactgaagggagaacttcaagagaggacataagagaaggaccccaactgctccttgcccaagcaggctctgttgcgttgaagaaaaagttcttcagtgatacttgttaaagcacagtcaggaagatttattcggggccatcaagataggcacagggaccacggcagtggggtcgtgcagtcatgggtagagactgggcacaacttcaaatacaacacgggcgattgggaatttatagtcaaggagcagtgtggatggaaaattagaagaggaaacatcagggctaagggtgtttctggctatgctgaccaaacaggattcttgccgaagacaggccagggtgattagacagcacctggaggctgtggaagctgatcagatagtgaggctggggagggggtttctggctaaactgacttagcagtgtcttttgctaaaacttgactttacaaggaagtgcacagatgggcctaggagatgcttcggaagcctaagatttggtcaagcagagaatctttgtcagttggcatcgttaggcgacacagttaaccctgggtgcccctctctccctatgctgcctctgcatccctgtccttccccttcctgcaaattgttctaacaatactcctgaggaggcagccctcgctccccagcccacttctctgtaaagattcccaaactgtgtcctgtgtttgggcccagtacaagctctatattgctgggaaatgtgagggcctttttggaaacagagacgcttgctgtaatgtagaggttggagctgacccctgctcctggagctcatcttctgatccgggtctctgaaaatgcgggcatgggcagctctcctacactcaccgcttccctcagtcacccagaaaagaaacctgtcttaccagtttggagaattgggacctttcctttgcttaacagatacttttggctttctcctgatgcccctaattcctaaactgttggccaaatagcaacctctatggggtggggggtttggagggtacaggggctgggagctggctgacgctttgaggcccaagtcactcgggaagatcacaatgccaagcgccacagtgtttcctctgccaggagggttcacttcccagtttctaaccagcctgtgtttctccactttttatttcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgaggtaaggagaggccaggctcaccagcctgctggggagcaagccgctgtgcttcccaggccgggcccatcccctcaggacagtgccctgggccaggcacctgttcacatgcagggcatctgggtctagcctgcagcatcagaggtcacccagcaaagacagggtgatggccccacatcatcccccagcatctcatagggctgttcttcagtggggcagggcaggaatcatgtggcttctttttgtagctaaggaacggctcggaagggcacactgcagcctgcctgctccagatgcacacaggtggagggagcagagctgggaccggaagcctggcctgccttctggcgcctaatttccatgctccttattcacactgggctttctattcagaagcacagagatagctgtgcattattttgttcagttcaatgcttatggataaatcttaaccgcttgtggagctatgttgacaggaaaatgagaccccatgcctgccctcaccgtgcaccacagtttcaaaagaaataaggagtcaggaaggcagctgctttaagacagcattttaatcctgaagccaaacatctcagggatatgtcaatggattctgtgcattaatagctaaaaaatagttcttaatctggttcttagctgagatttgaggcattcctagtaggattcctaagcagtaagtcctctcattttcctgtctgcacatcatcctgtggtgtgtgccagcgttgttcctgggcacaaactcccgtgtcctatctgcaccctgagtcatgcttgcctctcagctccgtctgaatctgttcagcttcacacctgcttgagagtgaaagttacagttaatgtgggataccttttttcttttcttagagaggtagtacctggctgaggcaggtggatcacttgaggccaggaattcaagaccagcctggctaacacggtgaaaccccgtctctacaaaaaatacaaaaattagccgggcatggtggcacattcctgtaatcccagctactcaggaggctgaggcaggagaattgcttaaacccaggaggcagaggttgcagtgagccgagatcgcaccactgcactccagcctaggtgatagagcgagactgtctcaaaaataaaaaaataagtaatgcctatatttataatggttttgctgcaagaaatcaaagtgacacataaatgcgagacatcttcacaaatttaggctaacaaagcacttagaagaggaaatgctctcaatttcgaggtgaatagaaggtggcccagcagggaaaggtgcttgacctgccttgggccacacgggatgctggcagctcccagttgctcagccgagttctctgtagattggcagagaaagggtagtggggacaacacatcccttgtatgagcgcttcctgtgtgctggcctggggctgaggcacatgcccaggtgactgacctcatcttcagagcagcccagtgagggaggggcactcttcctatatttcaaatgaagcttagaaaatgattgaattactaggaatttgaacataggccccttgattccaaagccttcagtctttgttgtgtgtgtgtgtgttttgttttgttttgttttgttttgctttgtttgaggtggagtctctctctgttgcccagactggagtgcagtggtgtgatctcaaatcactgcaacctctgcctcctaggttcaagcaattcccctgcctcagcctcctgagtagctggcactacaggcatgcgccgccacacccagctaatttttgtatttttggtagagatggggtttcaccatgttggccaggctgctcttgaactcctgacctcaggtggtccactcacctaggcctcccaaagtgctgggattacaggtgtgagccaccgcgcccagccccagagctctcagtcttaaccgcacattttgaaaattgaaaattacagataggaggtcttacaatatggattgccctgaggaggtgcacagcagaaggcgtggtcaggatgccaagccaggggagtcatttgtggggtcatgccctctaccctgtgtctcttgcagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcaggtacgggaagttagtcgtcagcagactggttatggtggtatgtctccaggggtgcaggagctctgtgggtgccctgggttcccccttcatccctgcctatttaacatgcgtgtacctacaggcaagtgagattcgagaaattgctaggtattaacagaaatgcaggacagttgctcaggctgtgaaccctccgcactctgcagcttttgctgggctgatcattgtgcattgcggctgacttagagcagacgaaacagcttggcagaacttacatacctgggaccagcttccttagtgtccaccacaccctttcagggctcttcacacccccatccacaccgcagccacagcctcaccttgggtgtaggcagtgtgtcaccttccactcagttacccactccactctgcaggcccattctgctcattcccacccctgtgcctttgcccatgctgaacccgctccctgaaatgcccgcacagtataggttctccctgtcctctgagggacgagccagtcttgtctcctccatgaagcctactcatccttctcatctcatgatgcctcatatgagtcccttaatgagaactcccaacttgtatgagttcaacatgtcattattcggggcatttcagaagtgttcattttatctcttcagcttagggctgagcctgaccacagggcccatgtcttaacccccctcctccctttgtaatcaggtaccatgtggtctggctgaggcatcagccagctatggcggattggaagccgtgctggcctggggaaggttgtaggcaggggtctggttatcttccagtggagacacaaggtgcaggttcctggaagaggatgtcatttagtttaagcagctcacagcttagcagcaggacagtcagcagccctgggccccctgtggctgcaacttgagcagctgaatgctacagtttttaaaaaggaaagccccccgtgaacaaatgtgggatattctttcattacaaatggtcacactggccagggccctggaatagagcaccctcatcttaaaatgttgttttatttggaaataatttcaatctcatagaagagttgtgtgaatcatacagagccccacatatacttcatccagttcactgtttgtcaatatgtctgcattcgccttgtcatttcttctctcgtatattattgatgtgttttaactgtttgaaaattaattgcagacatcatgtcccttttcccctgaatagcaaatattttcctaagaggaagacattctcgttcataaccatggtagacttaccagattcaggaaatttcacattcttacaacattattatccagtacatttttgaatcttttttatagcagtttgcccccacttccaggatgtcttccaggactgaaacaaggatcatgagcaccgcatttagatgcaacttctcttcagtcttccctcagcctttctttgctttcacggccttgacggttttgaagaacacaggctgtggaacaccctctctaaagtgtttctaaagtcacttcttacacagccattgctgttagaacctaggaggggtgcgtggttgggttgtgagtggtaagggccaaagttgcgaatgtctgcattggcgaaagagatttgatggaaaaggaggttgctggagtgtagacagctacatcgatccatacttgggttcagcaatcctaggagggtcccatttgtagagagagggatattttctccacatcattcccatgtgtttctcatcatcagtgaaatgatatttcatcctgttcttaccattaaccgtgtttgtggtgacctcccttttagagctgattcaaagttcccttttgggaggctttccaggatttcaccaaactgaacgttatagtggaattgagtgttttaagctgggaatagtttagaaataatatagtccagttatttcccagttgatgaaattagggtgagattttaaaagaagtgttagatattcacttacatgaataagagccaagataaggccaagcgcagtggctcacgcctgtaatcctgtaatcctagcactttgggaggccgaggcgggggtatcacttaaggtcaggagttcaagactagcctggccaacatggtgaaaccccatctctactaaaaatacaaaaaaaaaagttaaccaggcatgttggtgggcgcctgtaatcccagctactcgggaggctggggtgggaggattgcttgaacttgggaggcagaggttgcagtgaactgagatcacaccactgcacactccagcctgggtgacagagcgaggctccgtctcaaaaacaaaaacaaaaacaaaaagcgtcaagatatttttgctttgagcatagctcattaaaaaatatatggcttactaggcgtggtggctcacacctataatcctagcactttgggaggccgaggtgggcagattgcttgagcttagaaattcaagaccagcctgggcagcatggtgaaaccctgtctctacaaaaaaatagaaaaattagccaggcatgatggtatgtgcctgtagttgcaactaatcatgaagctaaggtgagaggatcacttgaggccagaaggttgaggctgcattgagctgtgatagccccgctgcactccagcctgggcaacagagtgagaccctgtcccccacaaaaatctatatatctatatggctgtagtttatagtcacaggaaaacctgtgcagccagaggttagcacagaggcgctgtgtcattgctgaatgttaggctacagcacagctatcctgaagcaaaattgttctggagttaaccatttagagcatcttggctaatcctaaaaaaatacattggtctgggcagaaactactaggctgtcacggttttaaaaaaagaagatcgtatcttttctaaaacaggagacaagaagatcacaccgtgagcagactgtctgcacagtgtaaggaagaaggaccagaggcagcgactccaaggctgcaacacctgagagctggagtcactcaggactctgctctgagtcagcctagttcagcagtcagcatgagtttttgctatttttttccttctttccttccttccttccctccttccctccccctcccttccccccttccccttccccccttccctgcttccttcccccttcccccttccctccttccttcctgcccccttcccccttgcccccttctccccttccttccttccttccttccccccttccttccttccttcctccctccctcccttccttctttgagacaggatctcgctctgtcactcaggctggagtgcaatgacataatcgtggctcactacagccttgaattcctgggctcaagcgattcttccgcctcagccttctgagtagctgggactacgagtgcaagctcccacacctggctaatttttaaagattttttgtagggttggggtcttactatattgcccaggttagctattttcatttttgaaaattttattgggtttcttttcattgccattaagaataccatctacagagaaattcagtgagaggtaatagacaaatagcctggggtgatcaatggaagcctgactaatgattgggttacatacatgattaataccatgtttttattttgtaacagccattgattgactttgaaaatcttttatactattaaactttttttaaaaagccatttctcagttttctttctaatctgtactagctacaaacaatttctgtgactttcagtcagttattaaaaatatatttttgtgtccttttttcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 23 - DNA, 81105 bp, Homo sapiens
  source 1..81105: mol_type = genomic DNA
tataaaagaggcggggcgcgcgcgtcgccgccactacccgctgcggagtgaacggtgtggagcggaggccgcggaggctcctcggtccttcagcacccctcggcccgacgcacccacgcccctcaccccccgagagccggtgagaggggcagccggggagctccgggagggagcggggccccgggcagccgacccccgggtgggagctgggcagctcttcaggcggggcggggccggcgcgcggacaggtgagccgggcgggccgcggggctgcctccattcggctgagtgggggaagccgctgccgctgcttttgtggcgcgtgggctgcggaggagcagccgggccgaggctcggcgccgccgctggaatgtcactgacggggggagggggcgcgaggccgccgggtccctcccaaccacccccaagcctggctgcggcgcggccctgccctgccccatccggctgcggcaggtgggtgggggctccctcgtcgggatcttcgccagccgcctccctgcagaacgctccccgcaccgcccccggtcccttccctcggccgggagcgacttctgcagctcgttcttccgaatcgcaccagcaatgccggccagccgtagagggaggaagagcccggggagcccgagcatagcgtaaacggctctctgaccttaatttcatcctgcatggcgaatctctgccgtctctctgaacgcagaagggtctgagactggccgtctccttttctttccttgtaataaacatttttctttcttcctagttgtgatttgcttgtaaataataggtaaatgcagtgcttgcatggtatgtggctcaaatcaaataacttaatagcttagcgttcttgtttgtgtgtgtgtttcctgggactgggtctttcgagtcgagatacagtgtcaaaaattctaccataccactgttgaatgatagaacagtcttttgtttgaaagctgtccctgagaatttgattagacgcttcccctagaacatcgctttcaaaagtctctgatgtactagagtaaaatatattttaaataagcgccttgttaaaagttgaatatgttttaaatgaaaagcctaaatagctcagaaagctgggttgagatgatgcttgaactgttccaacatctaatcagatctcttttatataatagatcctaaaatatttaagccctttgttctgtcttcatcatgttattttagaaaaacttaccatcatggctgttcgggaagaacaggagagaggccatatgaagtattttcataatgtgttgagaaattgcgtcgtcatagcaattggccttaagtaaaacagaatgtatcaaagatggaagggtgggggtgtcttggagccaggaaacagaaaatcttggaaatagcaggaggaacactcagctatatgaagccattgagtcaaggttccgactccttaactagtcgtttattttccctttcattgcagctaactaatgtcttagattttgaaaggtcaaattgaatgtgctgcggaggaaaaaaaaagtgctgcagtaaaggcctctgtgcaggaaattaacaataagccttttttagtaactgggccaataattactcaaagggaccctcaaagtgtgttaactgttatccagggaccttgatggagagactggaaaggaggatttttgcttcatcctggacaagtgtgaagcagttcttatggcaaaccatcagcctagtaactgattctctgatatgctttggtcttggcagtgtgttttgtagtcatctaataattggagaaatctggtatgtcacaggctgcagtgtaagcctgtcaagcaatatgatgaagaggtgcacatggggagagctgttttaagtatgtcttttggttccctgggttagaattttttctgctttttcttacctgccttcatccaaagttgggggtcaactgcagatcctgaaaagtggatctcaggaatagtcccccatgtcctgtcactgctgaatctacactaagaatggacaagtgtgttcaaggctggcctgcctttgtaatcagtcctccgtgggctatgcagggatcccactagttacgcactcatctgttgcagcatatcagctgcggctgtactgtagaagaatgcaacgccctagtggcaaatgctgactccaggaatgcggaggaggaggaggactgcatagctcatcactgggggccacttgactggagcagctgtgctgcaaaccatcacctctcttccaccttttttgcatattcctcttgtaccaattttgaacaggaaatagtattttgtaaagtaagtgtactggcaaactaggcccaagtcagatctttgtggcttgagttctactttgtggcaatttcatgaagtcatgctcttttattgctgaatggaaggggatttaggaatcatcttgtcctgggatcctcaggaggaaggcatgtttagtttgaaaaagtatattcggtattattactttaacaagtggggaaattgaggccccaaggagaatgagacttgaccagggcagcatatctagaaagtaactgccaagacctgggaaccttggttctccttccacattttaaatcccttgtgggatttagacgctatacagaatgtcagagagaagacactgaaaaaatatctgaaattggatttttaatctgtattcatattttttaaataatctgttttcttcatgattttgttccgtttgcccttagaagcttgttatcttgctcttccccctccctctttagactccacattcctccatcatgttgtcatcgtttcgtaaacgcagagtccaggtatttgacgagcatgcagaaaacgggttgcctttttggttttgcctggcttgcagtgaaggcatattcgtgtcaaagaggttgaatgatccaaagaaagggggaaaaaaaccctgcctgcatgacgtttctgttaaacaaattggttaggatttgtttggggttttttggtgttaaattatcagaagtattagtaaatttacttgaaaatttgcaaagcctttttttttttttttttttttttaacctccctctctttctctttaaggcatgaatatattaatttcttaccaccattctggtgtttgcatgtagtgtttgctgactttttattggtggctacttggtttttaagaaccaagggactaaacatattatcctagatatttggagaaaataatctgaaaatacatagtaaaaattgtgtttttaaaatttgacaaatattgtaaacttgggtttgtttcctgttgcattgacttcttccaccacaatttctataatagagcttaccttttcatgtttaaaaaatagctctcgggctgggtgcggtggctcatgcctgtaatcccagcgctttgggaggctaaggtgggtggatcacttggtcaggagttcaagaccagcctggccaacatagtgaaaccccatctctactaaaaatacaaaaaattagccgggtgttgtggtgggcccctgtaatcccagctacttgggaagctgaggcaggagaatcgctttaaccgaggagttggaggttgcaatgagccgagattgcaccattgcactccagcccaggtgacagtgcgagactctgtctcaaaaaaaaaaattaaaaaacagctctctttatatgttttctttgtgtacagtctttgttttctaagtcggacctttttcacaaaaaaaaaatttagtatcttgatatcccaaaataaaaaatataaacattggaaatttctagtgtttataggtgataaatccaaggcaggcctttttataaatcagatgagttatttacttaaatgaggtttataaaaatgggccacattataaccatttcctgttttgagtcatagtaacaataaggaacttaaatacctctcatctgaattttgcaggttaaaaggtaagtagcagcaagatagtatttgggaagcaatcagaagtaagttttctcaatattgctctgcatttctggattttgatgcaatgcagtatgaatcttttgctttcttaaagctaagtccctgctcacctctgcaaaattgcgctaacaagttgaaatgaattaatcagtttgaaggctgacatgctgatccacaatcctgattggaatgtggtttaagcaaaaatatttgttgtttttatttatggtgttcagtcatcctttatgtattattgacctctctgcttaccatcaaatctgccactaaaatctgcagctaagctggttttgagttaattttgtttgatctgagaatcaactggtatacaattttatgagtgctaatcaattctttggtggtttgttcttagggaagcccttccacatccatggatatagttctcttgctttgcaaatctgaaatttggtaataggctggcatcctaagccacggaaaaaagacattgttggttctgcacatttgggttctgactaagcaacaaaagcaactgatgaatggtttctatgatcttttgctttgggtgatgtttatgaatttttccataaccaaatgaccaaacgacccgttcatcctgttagtccctaaaaatccctttcttgcaaaactgtatgtctagtggtgtcctgcctgagaatcagaattcattttgtagtattccaaatgtctcttacatccagtgcattcaacttgctgaaagaatggcaatcccaatgctttgtttttaatagagactcctttcagcttcactataatttttttctctcttttgggattccatagagaaactgactgcactcactgcaggtgccaggtttacagagtccagagcatttgacctttggttcgaaaatgtttgtatctgcagtcttttgtgttgcttaacgcagtgggattcccacccactgcctctgcctgtacaagaagatagagctatatatcccataaataccccccaattttttttatttttatactcccaaattttatgcccccaaatacccccaaatttttatttggggaatgaaaattccccaaataccaagaactgcctcaaacagctgtctcttggcgttcatcaataagacaaagatattcatgtctaatctattttgtaggaatccattttcagttgatactgtgtataagtttgtgtttgatatcctggatcattctgaagcatgctgtatctttggattaaattagaaatttcttttttttttttttttttttttgagacggagtctcgctctgtcgcccaggctggagtgcagtggcgcgatctcggctcactgcaagctccgcctcccaggttcacgccattctcctgcctcagcctcccgaatagctgggactacaggtgcccgccaccacgcccggctaattttttgtatttttagtagagacggggtttcaccgtgttagccaggatggtctcaatctcctgacctcgtgatccatctgcctcagcctcccaaagtgctgggattacaggcgtgagccaccgcgcccagctgtatattagaaatttctagccaagattcatatattcagaccccactcttcttccgagatctggtagtattgtaagaatgctgacaagttcattttattcattttatttattacaatagaggacatagttgtaattcctgctttatccccctgagattcgcattacttgctgaatgatgcagctaacgtttgactgctgcgttgcagcatttataaatagcctacgtcttcagtctcctctaataatattttgcaaatatatacctttttttttaagttaccttaaatgggaagttgtccttaaacatatagagaatatacttagcacttcatttcccctccttcagtctctatgtgaacagacttgattggcaaaatcagagacagttggctcctttgagataagcagtcagttgattgcattcctaggaagtcgtctctgttgtggtttttaggcagttagtggaactgatagataggctggtaagattggagtttgttttttaatggcacgtttcccagatttttcctttctggtgctctcaaaaggcgttaatcccatatggctgggaacagcctggaacgttctctgtgaagtcggccttatcagtctgctgcatatgccagggaaggggtggggtgcttgcagcatgcagcctcggttgtggaaggaatgtggcacgcccaggccgagctgagctgacatttcagtaactgacagtttcgggtgagaggctgtagcacctttggatggcaggaattcttaatgatatttatgagaattttcctgtgtttaatgtagtctgcagaaatgacccttttaggagcaaaaagaaactggaactcgtgtagataaacaagagacagctccctgtcaggttaagaggggggaaactctcactaacccataatgttttttggtgtctcctgtaattgcacaaatgaaaattctgaatgctgactgcagtgggagcacattggtgactttcagatacccagctccccagagacagcctgttgtggcttggcagacctcccacctactgacgtcagctgatctactgcaggaaagaaaagtccattattgcctgaccaaagcacttggtatagaattgactcgttctacttcactggggtgacaaagagggccttttaggttggttaatttcagcagggccttgctgaactgtctctctggattggcaggatcaaatcagcaagctgggcccaagcagggggacttgctcagatggaacctttgcgatattatgatggagattttcttatcataaagggctgttcccaaatgtgatttaatttctgtagcaggtaaaggattttagaaatgcagtgactcctgtgataggaggcagaacagcaccatacactcgaatcctggagactgccatctctttcaggagctcgtgtgcagtgtcgttattgttccatgtgtaactatgccttccttggaaaatttctttacaagaaaattttggaagcaaacaaattagatgcataatttctcaatgtttttccatcttaactgtttcctgagggttgagaacaaaggaaatatataaataaataagtctaaccctaattgtttaccaagactcaatcttaaataattttgattttttttttttttgagacggactcttgctttttcgtcgcccaggctagagtgcagtggtgcgatcttggctcactgcaacctctgcctcccgggttcaagcgattctcctgtctcagcctcccaggtagctgggactacaggcgtgcgccactatgcttggctactttttgtattgttagtagagatggggtttcaccatgttggccaggctggtttcaaactcctgacctcaggtgatccacccgccttggcctcccaaagtgctgggattacaggtgtgagccaccctgcctggccgataattttgatttttaagaaatgattaatacatccacatccacctcacctttttttttttttttaagagacagagtctcgctctgtcgcccaggctggagtgcaaaggcgtgatcttggctcactgcaacctcagcctcccgggttctggcaattctcctgcctcagcctcccaagtagctgggattacaggcgcacgccgccacacctggctaattttttgtattttaatagagacgaggttccaccgtgttgcccaggcttgtctcgaactcctgagctaaggcaatccacccccttcagccttccaaaatgctaggattacaggtgtaagccaccgtgcccgccttttttttttttttttgacacggagtctagctctgtcacccaggctggagtgcaggggcttgatctcagctcactgcaaactccgcctcccaggctcaagggattctccagccccagcctcctgagtagatgggactacaggcatgtgccaccacacccagctaattttggtatttttagtagagacagaattttatcacgttggccaggctgttctcaaactcctgacctcaggtgatctgcccgcctcgcctcccaaagtattgggattacaggtgtgagccactgtgtctgcctcactgttttttcactccaaagtgcagatgtgaaaaggaactaataaagagggagtgaaggccgggtgctgtggctcacgtctgtaatcccagcactttgggaggctgaggtgggtggatcacctgaggtcagttcgagaccagtctggccaatatggtgaaacccaatctctacaaaagtacaaaaattagtcgcgtgtggtggcgggtgcctgtaatcccagctactggggaggctgaggcaggagagtcacttgaacctgggaggcggatgttgctgtgaacccagatagcatcactgcactccagcctgggcaacagagcaagaccccatctcaaaaaaaaaaaaaaaaaaaagaagtgaaaggaactaataaataaccaaacagccatcaataaataatatgtcggccaggcacggtggttcacgcctgtaatcccagcactttgggaggccgaggcgggcggaccacaaggtcgagatcaagatcatcctggccaacatagtgaaagcctgtctcttaaaaagaagagaaatacaaaaattagctgggcgtggtggtttgtgattgtagtcccagctactcgggaggctgaggcaggagaattgcttgaccctggaggcggaggttgcagtgagtcaagatcgcaccactgcaatccagcctggcgacagagcaagactccatctcaaaaaaaaaaaggccaggcgcggtggctcacgcctgtaatcccagctcttttggaggccgaggcaggcagatcacgaggtcaagagatcgagaccatcctggctaatatggtgaaaccccatctctgctaaaaatacaaaaaattagccgggcgaggtggtggatgcttgtagtcccagctagtcgggaggctgaggcaggagaatggcatgaaccggggaggcggagcttgcagtgagccgaaattgcaccactgcactccagcctgggcaacagagcgagactccgtctcaaaaaaaaaaaaaaaaaaaaaaaaaagaatatgtcaatatgtcaactctaatcatgttaagaatcactgtgtctattgtgccatattctgggaaccggaggatcccaggtcatcctggcctttgcaacttgcttactaaattacctgtctcccaactacttaattataaaacgatggcagtttctttatttccaagctctgaatataattggatctataatatgtgccaagtcctgagttctgtgcccagagagtaagagtaaaatatggtcttctttagagttccttaaaggacttatgaatgtggtagggagaacacaataatttcatggcagaatgtggcagtgttataagatgaatgatagaggtgggtggtcagggagtggagacttctgattcagaaagacttcatagaggacgaggcatttgctttggactcagagatctgtatgatttgttttttatattttttatttttttgacaggctggagtgcagtgacgcgatctgggctcatcacaacctccgcctctcaggttcaagcgattcttctgcctcagcctcccgagtagctggggctacaggcgcgtgccaccacacccggctaatttttgtatttttagtagagatgtggtttcaccatgttggccaggctggtctggagctcatgaccttgtgatccacctgcctcggcttcccaaagtgctgggattacaggcgtgagccaccgcgcccagccgagatctgtatgatattagatggtagggttgggagtgggagaggagagtgcactcctgggaaagggaactttttgagctttcaaatggaccctgtccaggacctgtaattggtgttggtgagggagcttgacatgagatacggctggaggagacaactggaaggtgactgagtgaagtcttgtttaccttgtagtaaatgtgattatagtgatccttgtcagggtcctcatcagaaatcagccttctccaaaataggctgacagacttagggcagcagtgtaaactatgactgcctgttatcattaaatattacaaaactttgggaggccaaggtgggcggatcacgaggtcaggagatcgagaccatcctggctagcacggtgaaacgccatctctactaaaaaatagaaaatattagccgggcgtgatggcaggcgcctgtggtcccagctactcaggaggctgaggcaggagaatggcgtgaacccaggaggtggagcttgcagtgagccgagatcacgccactgcactccagcctgggcgacagagtgagactccgtctaaaaaaaaatatatatatacatgtatgtgtatatatatatatatatatatatatatatatatatgtatatattttattacaaaaactgctctgagcagacattaagcttttcaaggtcactcccagtttttggttttaaggacttgacgtctgttttaagaatagaaaataggccagtgcagtggctcatgcttgtaatcccagcactttgggagactgaggcatgtgtatcacttgagtccaggagttcgagactagcctgggcaacatggtgaaaccacacctgtacaaaaaatataaaaattatccaggtgtgctggcacctgcctgtactcctagctactcaggaggctgaggcgggaggatcgctggagcccaggaggcaaggttgcagtgagttgagatcgtatcactgcactctagcctgggcaacagagtgagaccctgccaaaaaacaaaaaacaaaaaaacgccactttctcagagtatactgccatgtggtcaatccaagattggtaattcagatttagtcattaggttgacacctagttgtgtagctttagtcagcacattctttatttgccattcttgtcatcagtctagcacttaactggatagaattccaattttacaatatgcaaactgaaagattcgttatggagctctctccctaccccttacaaatgaattcaggtctgctgcacagcatctgcaacattcagcatggacttgatcatttattcaaccatttcttttttttttttttttttgagacagggtctcattgtgtcacccaggctggagtacagtagtgtgactacgggcgcatgccaccatgcctggataattttttttttagagccagggtttagccatattacctaggctgttctcgaacttctgggctcaagcaatccgcccacctcagcctcccaaagtgctgggattgcagatgtgagccatggcgcccggcctattcaaccaacatttcttgatgacctctgtatgctagaaatcagggatacaggaccggacatggtggcttacacctgtaatcttagcactttggaagaccggaggtgggaggatcatttgagcccaggagttcaagaccagcctaggcaacctatcaaaaccctgtctctacaaaaaaaatttaaaaattagccagtcatggctgtgcgtggtggctcacgcctgtaatcttagcactttgggaggccaaggcgggtggatcacgaggtcaggagttcgagaccagcctggccaacatggtgaaaccccgtctctactaaaaatacaaaaattagctaggcaccatgatgggcgcctgtaatcccagctacttgggaggctgaggcaggagaattgcttgaacccgggatgcagaggtttcaatgagccaagatcatgccactgcactctagcctgggtgacagagcaagagtccttctcagaaaaaaaaaaaaaattagccagtcatggtggtgtgcacccatagtcacagcaagtgggaggctgaggtggaagcatcacttgaaccagggaggtcgaggttgcagtgagccgtgactgcactccagcctgggcagcaaaataaggtcctgtctcaaaaacaaataaataaataaataaaaatctggtatacaaatattaggttgctcggtgtaatcataccttaggatgtatgtacaattgctttgcaaatctatagagaagtgtgattacgtctgagaaggagggaaggaaggaacattgggtacagtttagtaaagagtcaggatcctgcagtttacccatttcagctgggtgttgagatataaataaataagcgctatctaggcaaagaagagtcataggacattctaaacaaaggaagcatgtgcacatggcttggagttttaaagggaattacacattttagagcagaaagaatacttctatccgccacaagggtaggggtcacgggtgagagataataccaggcaggcatgttgggccagattgtgaaggtcctgctcaagaggtgggttctttcttctgtctgaaggaagccataggtcgggggcagtggctcacacctgtaattccagccctttgggaggctgaggcaggcagatcacgaggtcaagagatcgagaccatcctggccaacatggtgaaaccccatctctacgaaaaatacaaaaattagctgggcgtggtggtgcaggcctgtagtccccgctactcgggaggctgaggcaggagaatcacttgaaccctgaaggcagagggcagtgagctgagatcatgccattgcactccagcctggtgactgagcgagactccgtctcaaacaaaaaacaaaaaaaagccataaaagatttgggagtggcatggcgaagaatgtttccttttatagtataaaacattttggactgtggaaaaacaataatacaacaaaaatacatggttgatatgtggagaataatttaaaggaatggtgatatgactaaaatcagctcatctacacttctccaggaaggtggtctcttagaaaggcaatcttcagatctgatcaggcacagacagtgccttcctaccaccaatgagaactgcttgaatccctacagagctggggcactagctagaaactctgacatcagccatctccttctgtttacctgctaggtggatgtggggcagcactcttgacaggtttcattcctaactcttagcctactcacccttttctttctgtcttgggatagacgacaggataaaggaaagaactcccagatgtttccagggtaacacaattttataccttttattatacattgtagaacaatagctggaagggaccagcaggcttatctgttctgcttccttagtgaactcaaaaacctctctataggctgtaattttgaagttcgaagagacttgagagcacgtcgtttttcctgacatttttagtcactttaggaaattgaggcatggagagggaaggtggctagtgtgaggtcacatgttgctgacaaattcagaagctttttggcgttaatctgtatctgtttccttctgtgttccttaattagttagaggataaaatggcatattctttgttttcggtttttgttttgttttgtcacccagggcggagcgcagtggtgcaatgatggctcactgcagtcttgaactcctgggctcaggtgatcctcctgccttagcctcctgagtagctggtaccataggcacacaccaccatgcccagctatttttttgtatttttagtagagacggtgtttcaccttgttgcccagctgctctcgaactcctggagtcaagcagtctgccactttggcctcccaaagtgttgggattacaagtgtgcgccaccgcaccccctgcttgaaaggacttctgaatggacttagcagtgattatttgaataccacagttgctgtttcctctgaatccttgaagcctttgtagaattgacagtacaaaccatagttctcccattcacagttttcatttggtttccttgccgtgtgtgggttaggcatcttctgagggccctatgtaggtaggtgttgcaggggaatggatggccgtttttaataaagaaataggatctgggcttcattgttcctaagaaggggctgtcttctcaattcatttgtctcctgggtttatctgataattatttctttccttcagagaggctaattacttttcatctattttggtgcctattggtacttatctcagcgcattttgtcatttcagaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcaggtacgtctgatctcctgggattcctgccaaaattcaagagcccaaatgttcttacccaaaaatcagacgaggaaagttacttaattatgaccttgagagattggacaagaagaatataataaggaaggacaaactcattgttttcctgtattagtgagggtgaatgtggaatcttagaggtattaattgtcttttctggatgctttaaactgatggttctcaaacctctgccttgatactactggtgagctttaaacatttttcagggaagttctgggttaatctcttggaatgaggttttttgttttgttttgttttgtttttgttttttgaggcagagttgcgctcatgtcgcccaggctggagtgcaatggtgtgatcttggcttactgcaacctccacctcccaggttcgagtgattctccagcctcagcctcccaggttgctgggattacaggcgcctgccactgtgcccagctaatttttgtatttttagtagagatagggttttgccatgttggccaggctggtcttgaactgacctcaggtgatccacccaccttggcctcccaaagtgctgggattacaggcgtgagccaccacacctggcctggaatgagtttttgaggaaggcataatagtgatgttgctggcaaaaatttatagttattctggagtcagatatcaaagaataagtacttaaagttatgagtccctttcagagacttggtaaatcttatcaaaagcaaagcctgaatcttatggtacgtaaattatatatttaaaacttttttttttttgagacggagttttgctcttattgcccaagttggagtgcaatggtgcaatctcagctcactgcaacctctgcctcccagattcaagtgattctcctgcctcagcctcccgagtagctgggaatgtaggcacgcgacaccacgcccagctaattttttgtatctttagtagaaacaggatttcatcatgtttgccaggctggtttcgaactcctgacctcaggtgatctgcctgcctcagcctcccaaagtgctgggattacaggcgtgagccaatgcactcggccaaaactttttttataaaaagggaaagcctttcttctcacttatttcagtgaaagatttttaaagaaaattgtttcggtagcaagtggaacagtagttgggcccatggattttttaactataaaaaattgattacagtaacctaagaagagaatgaagaacactgctttaggtacaatccctgcctggcaggccccttcccatcttagtatttgatgaaaaagaggtattgagaaatggagtgtaggcagggtcaaagagtctggcctctaaagcaagtgaaagaaagtctcatgtgtgagtgaatatggatggatttttcaagagtaagcactgaatgttgagaaaactgttggtatggttctgtatttctagaagggactggatgttcacataaaggctaattttctgatagcaaaaacaaaaaattattaataggatattttgtagcatcttccattgacaatgttagttctcaatggtgagtgaggaccattgatggccctcgctggccaggctttcagaggaccaggagaaatgcagtcagagtatttgaggaattgagcaggtaagagaatgggcaaggtgccaaatgatgtatccctaactagagggagcaggattgaggaggggaggaacacggggaacagcggggacaaaatgctgatgctgtgtggttgcgtctgaggctcacttcaaggtccgccaacagggaaagcttcagaagcatcaagcatttgaagctgaagtgcaggccaactcaggagccattgttaagctggatgaaactggaaacctgatgatctcagaagggcattttgcatctgaaaccatacgggtgagtatgagtagctcgtggagtggatggcttcatctgggtggagcattgtagattcatgcatacatgtcagtttgggttcccaaaaagatagacttttccagcttttaaaagaatttatgaagtctccttaagaagttacccgaatcctgcctttgtaatatgacagcatgaatgcaagcgtttgtatactcagtgaggaaattaatattccttttgcagagcaaattagaatgtgattatactttaaagaaaactgtgaatttaacatttataagtggcagtgagatggcagagcatattagtgaaattggcaaatttaaggactcagatgcaaagataaatagaaacaagcacagacactataaagaaggttatctgtgggaaagcttgctgtcttgaatcttggcttgccctgggaggggtttacgtctaggcagcaagcctgttaaagctccagctctaaggaatgatgtgtggcacctattggtcaatgaccatggtgatgggactgactttgaggcaggagtcctggaactctttggtctggctgattttagtgcgagtttattggagctgaggtagtaattgatctttctctgcttcgtttcacatatctagtatgaagatattaagggaaaacaaacctcttgacagtgaggtgtgcacgttgagtttcttataactggatgtacttatctatctttgatatacatcatgtctagctgtgtgttctctttggttctttgtcatccaaagccacattgcattgaggcccagccttttctagtcttttacctgtcaaagcagtcctgaagatttaaatgaaagctgcacccttaagccccagctagaactgttttgtctcctactcttccttgataactgtgtggaggtttcgttcactgaggatccagtctactcattttcaacaataaatgtttgttgtctcacgtttgcttggcaatactctacagtctcatattaaggacttacaattagccctaagatgtatgatgaataattattaactattactaataatgatgattgtaaataggaaataaaagtgaattccaaatgtcatatgactaataacatttaacccatttgggcaatgtaatatgtgtttgcaattaaatacagatatttatcttcccatcttcacactattttatatacagtcttagagtaaatgaaatcagtctgcgttattatttccttgatagaagttgttttcccagagtgaatgaggcacctctgtagtagaatatgtaaccagcttacagatggggaacattggacagagatcaagtgtttggcttcagtaattaaggcggaagggaggaggacctaaagctgactttattcatgtctattagtaccctctgccctgtttagacagcttatatatatatatatatatatatatattttttttttttttttttttttttgagacgaagttttgctcttgttgcccaagctggagcagaatggcaagatctcagctcactgcaacctccacctcctgggttcaagcaattctcctgcctcagcctcctaactagctgggattacaggcgcccaccaccatgcccggctaatttttgtatatttagtagagatggggtttcatcatgttgaccaggctggtcttgaacttctgacctcaggtgatccacctgcctcagcctcccgaagtgctgggattacaggcttgagccaccgtgcccagcccagatggcttatttatttatttatttatttatttttgagatggagttttgctcttgttgccccggctggagtggaatggcacgatcccggctcactgcaacctccacctcccagtttcaagtgattctcctgcctcagcctcccgagtagctaggattacaggcatgcgctgtgccaccacagccagctaattttgtatttttagtagagacagggtttctccatgttagtcaagctggtctcaaactcccaacctcaggtgatctgcccgccttggcctcccaaagtgctgcgattacaggcatgagccgccgctcctggcctagatagcttattaaagcaacattaacaatactgttaactggccgggcatggggctcacacttgtaatcccagaactttgggaggccaaggctgaggcaagaggatcacttgagctcaggagttcaaaaccagcctgggcaacatagtgagacctcgtctctacaaaaaaaatttaaaaattagtggggcgtggtggtgcacacctgtagccccagctactggggaggctgaggtgggaggattgcttgatcctgggaggtcaaggctgcagtgagccatgattgcacccctggagtctagcctaggcaacagagcaagactgggaaaaagaaaaaaaaaaaggccaggcacagtggctcatgcctgtaatcctagcactttgggaggctgagatgggcggatcatctgaggtcaggagttcaagaccagcctggctaacatggtaaaaccccgtttctaccaaaatacaaaaaattagccaagcgtggtgttgcgtgcctgtaatcccagctagttgggaggctgaagcaggagaattgcttgaactcaggaggcggaggttgaagtgagccgagatcctgccattgcactctggcttgggcaacaagagcgaaattctgtctgaaaaaagtaaaaaaataaaataaaatttaaaaaacctattaaatatagtttgttgagtaggtattaggagctatttatgtacagttactttgctaacctctgatcttcacagtaagtgtgcaaggtggccattatttccctattatgtgagagtagaaactgagtctcagagaatttgagtaacttgcccaaagtcacacagttgatagatgactgaactggaatttcctctatccccttctttgtccagtcaccactatttgttttattttaatttattattatttttgagacagggtcttgctgtgtcacccatgctggagtgcagtggcacaatctcagctaactgcaacctccttccaccaggctcaagtggttcacccacctcagcctcccgagtagccggcaccacaggaacgcacaagcacactgagctattttttttgtatttttagtagagatagggatcttgccatgttgcccaggctggtcttgaactccggagctcaagcaatccgcctgcctcggcctcccaaagtgctgggattacaggcgtgagccactgcacccagcctgtgtgctttatttttccaacctgtacttcattcctgtcttctttgcttaatgtttccaccatctgcttctctgaaggctcctgttgcttgcttatgtccctactgagaaatccacctgagtcagaaccaggcttgcttgtccaccccgtcagctttccacatgtttatgaagtgcacctgcctccctgcccactcacgctctcaaataatagtaagcctgtgaagccagactctctctaacctgcagtatttacaagatcagacacatcagcaatgggacaatggttccagtactgggacaggccttgccctagttctttcttgagggtgtaaaaatgaaatatgtgagatggacaattgacttgaatgtgagaggattttctctagtcttctgtggcctcatttttaatttgagcaggagctctcatttaatcttttactttcatgctcacagttactatggtgatcttggcttggtcatttatttggtcccctaactcagtaccttagtttggcagaaagtggtagcagaggaaggtgggtggcatgtgagggcatgtctgtgtcctggataacctgtctgtcactggtttagactttcacaccataccggacagcgtggcgccccatagtcaccgccacccacatcgggtcccacatccgagtaggtggagtattgacttggttgccttttcccccttgctttggagtgcctttcacttctttctcagtggtggggtcacagttttgccaacagtggtggaagtgaattgtgtgagcatgtattcctctgctgctttctcctttcaagtaaaacatccacacttgtttctaagagaatccacccatgttgactgtcacatggttttcaggttttcattttgctaggagtgacatctcaatcatgggtggatcccagacttcttttctgttagtgtttaaaccgctttgtttgttttacttatgtctgtcagtgttgtacagaaactcccagtatcttgggtaggcataatcaaggcattgaggttggattggaataccagaatgcatcatctaagcttgaattgattactaatttcctccaattcttgataagtccttactgggcctgtgttatgagaacccaaagatgctgggaagtgaatacgtttgaccctgtggctgccacttgggtgaagtttggaataaacctcacttgagatgtaccacaaactgtcttttcacagaaggtccaaagttttttctatcagggatcctttttgatagctgatgacttttcaggaccccatcttttctacttttttatttttcccgagatggattcttgttctgttgcccaaagctggagttcaatggcacaatcttggctcactgcaacctccacctcccaggttcaagcaattctcctgcctcagcctcccgagtagctgggattacaggtgtgtgccaccatgcccggctaatttatgtatttttagtagagacgggtttcaccatgttggccaggctggtctcgaactcccgacctcctgatctgcccacctcagccttccaaagtgctgggattacaggagtgagccactgcgcccagcccttttctactttttttttgagacggagtctcgctctgtcgcccagactgaagcacagtggcacaatcatggctcactgcaagctccaactccctggggtcaagtgattctcctgcctcagccttctgagtagctgggattacaggtgtgcgcccccatacccggctcatttttgtacttttagtagagatggggtttcaccatgctggccagactggtcttgaactcctgacctcgtgctctgcccgcctcggcctcccaaagtgctggaattacaggcatgagccgctgcacccagcctcccctttactacttttccaccaagattttcctgttgtgcctcatagtttttacattgatgatgcctataagacctcttcttttgtttttttccctttatctccatgaatttggaatacatccttcagtaatttcagctcagtttacacattaattcctcatttttcctttcccagtagtcttctggattaggaattccactctaataatttaataataattaatagtatcaattgtgtacctattattatataatactaaaatatataactatacaatataaatatatcataaatataattataaatgaaatataaagatattattaataatataaatgataatgattttcctgatgtaaactagagtaaatctacctgtgaaagaactagagtagatctacctacttgtaacttgaagaccaccaaaaaaccactgtgaactgtggacttttccctactgccagttaaatttactatttcctctcagtttagggattatcttttaaaaatatttttattcagcgctccataaggtctctaacttgtctaaactctatggaagagccagatcccacagagccagttgtgatctgattaaaactctgatttgaaactttcagacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcacgttttgggaagaagggtttgctaagctttactcaaagaaaagggaagagactcctctgtgatctgtagtgagacccagtgttagcacagatacggccattttaagtaaaagggtggaagtggggttgctgtctctccagctgctctctaggtgtatgtgctattctgtaactctgaagcctggagtcgctgagacagaaatgccgtgaactcaacctcttaactttctgtgggaggaactaaaatcacaaaccacagacaaaactgtatccattaaagctaacatggctccgtccctaatgtgtctgtttgatgtttctggaagccattgttaacaaatgttggttggtgactctggctctcttatggtccctgaataggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggtaaatagcaaagtgctgtatgcttctcacaacattattatgttaactttttagtatattcaggataaaattttgatgattggtcccctaatttctgagtgagcaagtttttgtaagcatgtctgagagttttgtttagatgtgaggcacaatactgattactcctaaattggaaaatgcttttcaatgtgttgccttgggcaggaagggcagagttcatttgatctgtttcctctacccacttttgggtagggctgggtgaagcttttattggactgctgaagctaggtctcagggtttctcagacgagggtgtggtggtgaatgctaagttagtattggcagatgtccaccaatgcattagggctcttgccttccttttttatttgaagcttccctgggctctcttgggagcctgggagaaccttgtcgtgaataggctctccactctggcgctggagcccattaagagggaatgacaacccttccccagtgcccacgtgtacaatcctgtaagctgcttccactacgagtccaaagggttccaaagacatcaagtactcggaaccagagagtttttacttttagggaaatttgatttggggggtacaaattttaagtgtataaatctgcttataggctggtacttgtttccattttctggccagtgattaagagaaagatacccggcattcctcagaaatatctcacccttccacagtgacagatgtgttgcttttccaaaccctaagctttcctgcggttgagcttgagaaaagtagtcaggccaaacccatggtatcccagatggattcaagaaccctgaaatgcttcattttattactttgtatcatattttttaaaacaccaaaatgtggttggtagggaaggatacttttaaagaaatgtctctaagcttgatgcagtggcacctgcctatagacccagctactctactcagactcaggctgacaagacaggatcacttgagaccagcctgggtaacatagcaagaccctgtctcaaaaaagaaaaaaagaaatgtcgtcagtctaaagccagggacaaactcttgagccccgaaaattatgtttatgtgcaagaatgcttaacagcctcatgaacatctgaaataccaaattttcaagcagttagggtagatgagtacattgataaagttaccacacagttgttgccaaactatttattaacataaaggtttttggcacttttgcacataaccaccttatagactaaccacactactccaaaagatagagaatggctctcccctttttacataagaaatagaaactctttggagttgtagttcactttgtatcatgttgaccattatttcttgtgattctcttcagagtggtgatttgctgagatgcttcaaggaaccaaccccagggtaactagttggaggagccagaagttgtgtacaaatccagtctcttctcttccttgtttaggagcagcaccctgaggaggaactgatcaagactaagcaggatgaagtcaatgcagcctggcagcggctgaagggcctggctctgcagaggcaggggaagctctttggggcagcagaagttcagcgctttaacaggtgtcaagccagagtgggctttggggaatgggtctcaacctggaggggagttgtgaagcacagggcatgtgctggtgagctgtcgaggctgactaggccttggtcccatggggtgttcctagttctagggagtcatcattgctgtggattaactggtgcctttgttctgtagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtgggttttacaagcagctgattctgtaaataagttaccaagggtcaggagaatagttctgacggagttcatttctaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggtgcaaataatgctccaggtcttaaccagtatcatttggcttcttttttggaagcaggaatagcagagttaagggtctgttctgtgttctgtgaaagtgtcaggtatcacctacaaatgcaaatcacttcttacctatgttctctctgtttggagactggcaactgtatcatgtgtagtatacgtatggtatttacaacttcataaattcttctattctgcatcactgcattatgattgatagaatgggaatgtccctttaagtatctgagtatcacatgaaatatcttattaaaaccaggattagaaaggaaaagaatccttgctagccaagggttgaacctgggaataacaaggaagttgaaaatgtgggacaggattggggcattatagtgatggagagaacctaagttttaaagggttgatttcagccttctcttgctttccttcacagtctagattgggaaattttcatatttcccagaattagaatttatatagtttgttagacatttgagaacatagaattcagagctttagggaggccattttccaccctggaacctccgctggaaacataatgtcttcctttggttttccctaggcttcaacgcttccttgctgacttccgtgacctcaccagctgggtgactgagatgaaagccctcatcaatgcagatgagcttgccagtgatgtggctggggctgaagccctgctagatagacaccaagagcacaaggtaatggtatctctagaatcttccagaagtgaagattttagcttataatgcaccagtttatcagtgttgggtgaggcctatagtcggcgttggtaccatgttattcacaggtgtttctcatcatgaggattatggttggttttgcctttggagacctggtctacctgcttctgatagaggcttaactgggttcagtgtcaagaggttcactgtggtccataaaagcaaacagacaagctctggcgagatagaagtgctactacttggcacattgatcctttgtgatgtaaaaagtatttgttgggccaggcacggtggcttatgtctgtaatcccagcactttggaaggctgaggcgggtggatcatgaggtcaagagatcaagaccatccatgccaacatggtgaaaccccatctctactaaaaatgcaacagttagctggtcatggtggcacgcgcctgtagtcccagctattcaggagtctgaggcaggagaatcgcttgaacccgggaggcagaggttgcagtgagccaagatcacaccattccactcccgtccggacaacaagagtgtttcactctgtctcaaagaaaaaaaaaaaaaaaaaaaccttctgagaggttttaatgtgctagatacaaaatcaatatactgaaagtcaaacatgtttctctacactagcaacagaaacataatttttaaaaatactacttattagagcagaaaatataaagtacttaggaataagtctaacaaaagagtgtaagacacttctggagaaaactataaaactttgttaaaaggcattaaataaaaactgaatagatagaatgatttatctagtacacagatggaacgatcttctgtgaaggtgtaaattcccaccaggatatataccgttaatgcagttccagtcaagtgctcagcaggtatatgtgtgtgtttctttttgcaatgagataagctgattccaaaactgatttggaagaaaaaaattcaaaaaaagctgagacaatgttgaagatcataatggggccagggagggactcgccctaccaggttctataaaatcatagtaaacaagtccatttggcacaaagaagacagagccctggaatgaaagagagctcagacccatgtgaatgtgtggaaccttgacaaatgacaggtgacctgaaaagccatttggaaaggatttcatcagtgagtgatactctcacatttgatgacctagactgattatgtattaggaaatctggcctaatctttcattttgtttctcattttagatgtcatagtctggcttataatgcttatgtaaaattcagcaccttgtttttattttgtaagatgctgggcacaaatcatggctttgtttttttctcctgtagggtgaaattgatgcccatgaagacagcttcaaatctgcagatgaatctggacaggcactgcttgctgctggtcactatgcctcagatgaagtgagggagaaggtaagagaagagaaatggagcttttgaggagcaaattacacctttcactaagtctctgaaagctattattcatccttaaatatccagagaacgcattcaccatgatatgtgagaaactttcctttctctgcagaggtttaaaaagaaggtatatgtatagtgtgctgatttcctgagagacagtcctccttatctggggcatgtgtggcatgtttcctacttacagggactttctgtagggagctgagtcttgcattaggagttggagcaaagaggaaacaaatttttataaaatgatacataggccaggtgtggtgtgaccccagcactttcagaggccaaggcaggaggattgcttgaggccaggaatgggagaccatcctgaacaacatagtgagacccccatctggacaaaaaattaataaattagccagacatggtggcacattcctatagtccgagctacttgagttcaaggttataatgagttatgatttgcaccactgcactctggcttgagtgacagagtgagaccctgtctctaaaaaaaaataaataaataaaaataaaatatgtatatatatacatattttattttactttttttatatgtgtatatatatacacatatgtatataagttttgaagtatcttcgagtataaaattgcctaggaacattagataaataatgatttatatgatttatatgttttttagtattacatagagtaaagacatttcaaagacttgtcattagtagcttcggagcctaaagtctagggagtttctgaatttattttccatatgttatggagcacccactcagttgacatttcttagtggagagtccctactccatttatactccattaaactccatttatactgcctcacttttaaatggatgccctatttcttctacctgggagtttacttactgtttttacctaaagtcatttgtgatcatttggcaataaattaattctagattaattaaaacaggccatcccttttatattgaacatgcacatacaagtgaatgttgtttttccccttttgcaaatcggaaaaaaggcctgaagattagcactaggattaggaattccaggatagctgttctgtctgcctcggaggcattggggctgacctcatctccctgaccatgtctcctatgcccccaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggtaatctgtgagcaaagccttgccagtggtgggagaagaagggcctgtgttttgcctcctcgggtagtgtgcttgttttgttttaggacatcagtaccatgttagttctgaatccattgaagagggggaattgagcaagcttctctcagctctgccagcatctctccctgctgagattgcaaggccttcagaaaaggccccagcttttcagattagtgtgatgtaaaatgttttattaaagagatttttttcttagaacttagcattgctgggtgcagtggctccctgctgtaatcccagcactttgggaggctgagatgggagtatcccttgagcccaggagctcaaggctgcagcaagctatgatcgtaccaccgcactctagcctgtgcaacagaccgagatcctgtctcacaaaaaaaaaaaaaacaaacaaaaaaaacaaaccttagcattatgtaacatctgaatctaatagaagcaacaaaaactatgtaagagaagtttcaatagaatgtggaataggatttcatgatatggctggattgattttaagaaaatccaaaaggactttagacttcctagaagagatcttagaagtttagcagccataaaatctctttccttctttttatattttggccaaaataccctttgcttcacagtcttagaagatcaaaggaataggacattattctgaacactttgtttcctttggcaaggcgttcctgttgaatgaagacttgggagattccttggatagtgtggaagcgcttcttaagaagcacgaagactttgagaaatcccttagtgcccaggaggaaaagattacagtaagaccccttcttgtcagtgctttcaaatgacccttatagtaagccagagtctttttccctggaaggattccaaacagatttgatgaaagattcatatgcagagtactcctgtgggtgcttaaactttcacaaggatgacatgctatctcgttgaagacataatacaactttatggaaaaatgatttacttaatggaaacctccaaacttctttaagtttgtacccttcattaaaagtaggtcagggttaatattaagaggtactcttcccattgaaaatacatcttagaaataagaatttggaaagctgttaacctgtgtttgacccctgccaggagatcgtgccacaactaatgtctccagtcttgaatggaggtagtgcagtcttatgatatctgactggtgacatcaagcaaaatctcaaaagttatgagaaaaaatgtcatcaccaacctttgggtgaaaaccttgacctatgttaaagtttggtgtgttttatgatctgttcagcagttacttttctccagaggccaagcttgggactagtgtgcttaccaatgaagaactcttatcttccttcctaggcattagatgaatttgcaaccaagctaattcagaacaaccactatgcaatggaagatgtggccactcgccgagatgctgtaagtttgtaggttcttcatgctcctcctttttggtacatgaatgtctcttctaagatgttccagttaagtctcttcaactggatatccctttgggagtgaacactagagactcacaggggatccttgtctttcagctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagtaatgtactgttagtgttgccatgtagcactcgattagtaagctaaacacagctctcacaaataaattgtagctaaaggacgaaataagggattccagaaaccccactacttaatgtaagccaactgttttatacattcctccataaagataagtatgaaggtagtgcaagggaacttgacgttctcaggttcaagatagaaagaacccccttcttttattcacaggatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggtaagagatgttccattgaattgtgacatgcatgtttggggaactaaatacccctttctattaagtattttagggacatataccccccaagaaaggtgaggtggatgactttggcgttagggataatttcctgtgtaggaattacttggcttaagttcttgataataatttggtaaatgtggtcgagcatactggttggtgagggagtctgagtgagaaggaactgaattgggcctcattgctgaaaatcaaagttcagctgagagccaagggcatttactaattctccagtgtccttatatctcaagggggttagaatgcttccagttcaaccttgagaaggtagagcagaggctgcaattgatattttctttctctttgtgacataagtgaaggaataaaattctgacctgtatagtccttcactaagatactactgttcatgggcagtgttggcagaagggtaatgctaagcagtacaaaattaaacttgttttcttccataggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggtagtgtgaactgggggctgtggttgggcaagtgaatgcagaaactataggagggaggaaaagccagtaatttgagactaaatgaattttgggagggatgaaatgtgttgattttcttagatcgctctgtgctgcatgtgcttctgctcaaattaaatatcatcccttagagctttctaggagccccagatgaaggaaggagatagcagaaagaatcctctcaggaatggaaaaaagaccttatcaatttttctctgtatacgataaaaccacacccaaagtaaagtctgctctgtccttttgcattcccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtcagtctgcttccctcaggtaggaatcaacttgggaaaggctgtgctattgtagcataaaggggatgcatgtcaggatgggcagggtcgaatttaaattattgaactggaaccatggtggtagctaagaatgacaaatcagtgctgacttttctcttcatggttggataactggggactggtgtctgctttcaggtaaggatttaattggggtccagaatctgctaaagaaacatcaagccttacaagcagaaattgctggacatgaaccacgcatcaaagcagttacacagaaggggaatgccatggtggaggaaggtgagtgattggtatcagtgacatggcttggtgctgctcctcgtgtctccccttcttgccgagggcatggccacgtgggcatcacaaaccaggctctggggctgaataccatccccattctttcctaactgtatgacctgaccagaccttaccctttctgagcctgaatttctttttttttttttttttgagacggggtctcactctgtcacccagggtggagtgcagtggcgcggtctcagctcagtggaacctctgcttccctagttcaagcagttctcctgtctcagcctcccaagtagctgggactacagggacacaccaccatacccagctaatttttgtatttttatttttgtatttttaatagagacagggtttcaccatattggtcaggctggtcttgaactcctgacctcaggtgatccacctacctcggcctcccaaagtgctgggattacagccatgagccaccgcgcctggctccgagcctgaatttcttatctgtgaaacggggatgacagcacctctcctgacactgtagtggggagtaagtgaaaccaagtaggaaaagagctgatagagtgcctgcacgtgccagtctcagtaactgagcgctacagtggtactgttactagtctttatgatactatcactaatgccaacttgcgatatctgcttcttagagtctagatagaggtcatggtttgaggaggcaaaaaatgaaacagtccattagagggttagaacctgagcctctcaaaaaaaatggaattatgaaagggcacagctcaccaaaacatagtaatgaaagtgccgtgaacacacagagaaaacttatttttgtccttctgtgatgtgtcaacgtagtttttgttatcctctttccctacccatcttccaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggtaaccaggcgtgggaagcgtctcacctgccagggaagtggaacagggcttgtactgagaaggaagttaggagaagtagtgatgcgcgggaggtgtgcattacagtgattgttttttaaaatgttttggaatccatttttcacttggtttttttttttttttttttttttttggagacagagtctcactcttgcccaggctggactgcaatgttacaattgtggctcactgcagcctcaaactcctgggctcaagcgatcctcctgcctcagcctcccaagtagttggaactataggcaggtaccactacctgcctagctacgctttttaattttaattttatttttagtagagacagggtctcgctatgttgtcccatctggtttcaaactcctggcctcaaacaatcctcctgccaaagcctcccaaaatgctaggatgataggaatgaaccaccccttctggcccatttttcactttttattatgaaaatgtaatcatacctaaaggagagagaagatgacttctcactcaccttcaaccgttaacatttgtcactcttgtttcatctatgtgaaaccatatgtgtgcttacatacatactaacataccaacatgcacacatacatatatacatacctacaaacataccagcatacacatgtacataccagtgcgcacatatacccacataccaacatgcacacatacatacatagatgtacttggttttttactggttatctgttttttgactaaaattctcaaattttattcataaaggtctaggtatagttcctgtacctagctcttaccactcttcacaaaaactagaatgagttgaatttttccttttctttttttttttctgagacagagtctcactctgtcatccaggttggagtgcagtggcatgatctcggataactgcaacctccacctcctgggttcaagcgattcttctgccttggcctcctaagtagctgggattacaggcgcccgccaccacgcccagctaactttttttgtatttttaggagagatggggtttcaccacattggccagtttggtcttgaactcctgacctcaagtgatctgcctgcctcagcctcgcaaagtcctgggattacaggcgtgaggcaccgcgctcgttctgtcgctagggctggagtacagtgatgcaatcacgactccctacagctttgacctcctgtgctcagcagtcttcctgcctcagtcccctgagtagcttggactacaggcacgcaccatcacatctggctaatttttgtattttctgtagagatgaggtttcagtatgttgcccaggctggtcttgaactcctgggctcaagctgtctgcctgcctcagcctcccaaagtgctgggattacaggcataagcctctgtgcctagaccaggatgagtaagctataatcataatatatatgattgtcccaaaagatgagaatcctgaaaaactttgaaaatgatattagcactgtaagaagggcaggaggtgattacgtcattgtgcaactgagaaaggctgttgaggcaggatggcaggttggcgaggcagtggaggatgggaggcttcagcccctgcacagtgctccatgtgtggttttggtttcaggctctactgaagaaacacgaagctttgatgtcagatctcagtgcctacggcagcagcatccaggctttgcgagaacaagcacagtcctgccgggtaaacttgtaacagtttatgggttactggagggaggccttgaaggactcagatactgtcagcaggtgttcctatcataggccccatttgactctgctattaactcttgtgacacaaagatttacagagtttaaaataagatttatttatttatttatttatttagagacagagtctcactccgtcgcctaggctggagtgcagtggcacaacctcggctcactgcaacctccgcctcctgggttcaagcgattttcctgactcagcctcctgagtaggtgggattacaggtgttcaccaccatgcccagctaaattttttttttttttttgagatggagtcttgctagagtgcagtggcactatcttggctcactgcaacctctgcctcccaggttgaagcaattaccctgcctcagcctcctgagtagctgggattactggcgcccgccaccacgcccagctaatttttgtatttttagtagagatggggtttcactatgttggccgggctggtcttgaattcctgacctcatgatctgcccgccttggcctcccaaagtgctgggattataggtatgagcactgtgcccggccctactttaaaatgagattttttttttttttttttgagatggagtttcactcttgttgcccaggttgaagtgcattggcctgatcttggctcaccgcaacctccgcctcccaggttcaagtgattctcctgactcatcctcccgagtagctgggattacaggcacgcaccaccacgcctgtctagttttgtatttttagtagagatggggtttctccatgttggtcaggctggtctcgaacccccgacctcaggtgatctgcctgcctcagcctcccaaagtgctgagattacacgtatgagccaccgtgcccagacaaaatgagattttttttttaaagataccaaaaatttaaagttcttggatcagattttattggtagcttcagtgaagaattctcatgagtgtatatttggtacatttggtacagctggtggcatttgaatctgctctgtacttagatgactcagcgcggacgtgtttttaccatgtttgcccttcctttggatttttagcaacaagtggcccccacggatgatgagactgggaaggagctggtcttggctctctacgactatcaggagaagagtccccgagaggtcaccatgaagaagggagatatccttaccttactcaacagcaccaacaaggcaaggcacagagagtggctgtgtgtttgttccacgctggcacctccacgtatgctcagttgggtttctgtgggttgcatgtctccctgaaatgagaaggcttagaattcaaagacatgagtttcctcaccaatcccccacgtgacatacatttatgcagtactgtgtatgaccaagaagttaatctgtcttcttgaatacctgcaagaagcatagataatcacactcagaaggatagcttattttcaccattgagtgtctctaggtggaatttttgtcctgtcaagccaaagtttgctttctgtataacttggacctgttggttctttttttttctttttcttttcttttttttttttttttgagacagagtctcgctctgtcacccaggctagagtgcagtggcacgatttcagctcactgcaagctccgcctcctgcgttcaccccattctcctgcctcagcctcccgagtagctgggactacaggcgcccaccactgcacctggctaattttttgtatttttagtagagatggggtttcaccgtggtctctatctcctgacctcgtgatccacccacctcagcctcccaaagtgctgggattacaggcatgagccgccgtgcccggccttttttttttttttttttgagacaatgtcttgctctgtcgtccaggttgcagtgcagtggcatgatctcagctcactacaagctccacctcccaggttcacgccattctcctgcctcagcctcccgagcagctgggactacaggtgcctgccaccacgcccggctaattttttgtatttttagtagagacggggtttcaccgtgttagccaggatggtctcgatctcctgacctcgtgatccacccgcctcagcctcccaaagtgctgagattacaggcatgagccaccgcgcctggccgacctgttggttcttactccagactacaagctacatctcagcccagcagatcattgaagacagctgtgacctcaccccacaggctttgtcttctttaggctaaataatgacaataataaatccatcctggtccaccagcctttcttccctaacacactctgaattgacagtggtgttgaagcatgcacagattgactgatcctgaaagaggcctgccttctgttttagttaaggctggagaaatgtccttggccatttttaagagcaagtttattcccattcccacaccttatttatccttgtcatgataatttgaggaaacctgtgattcttatctttctattgagtctaatttaaacctaaaccaacttgtggtctaactttggtttattcaagagcagcattgcccagtagaactttctgtgatggtggaaatgtaagtgtctgtgctgcttctgcagtaactactagctacgtgtgatagtaagcccttaaaatatggctagtacaactgggtgttttatttaattaaattataactcgatgaagccgggcatggtggctcacgcctgtagtcccagcactttgggaggccgagacaggaggatcgcttgagcccaggagttcgagaccaacctggggcacatagcgagacctcatctctatttatattaaaaaagaaaaaaaaaaaaaagggccaggcgtggtggttcacgcctataatatcagcgctttgggaggctgaggtgggtggatcatgtggtcaggagattgagaccatcctggccaacatggtgaaaccccgtctctactaaaatacaaaaaaattagctgtgcgtggtggcgtgcacctgtagtcccagctacttgggaggctgaggcaggggaatcacttaaacccaggaggcagaggttgcaatgagccaagatcgtgccactgcactccagcctggcaacagagcaagactctgtctccaataaaaaagagttctaactcaatgaaagttaagtgggcacatgtgactggtggctacagtgttagcacagctctggagcatctaagcagagagaaggccagccttggtggcaggcggcattgctcttctgcctgtgaccctctgcaggtatggcaggtgaggaagggactgaattatcagaccttatagaaagtgattttaatatcattttggaccttttttttttatgagacagagtctcgctctgacgcccaggctggagtgcagtggcgcaatctcagctcactgcaagctctgcctcctgggttcatgccattctcctgcatcagcctcccgagtagctggggctacaggtgcccaccaccatgtccagctaattttttttgtatcttttttagtagagacggggtttcactgtgttggccaggatggtctccatctcctgacctcgtaatccacccgcctcggtctcccaaagtgctgggattataggtgtgagccactgtggccggccgttttggacctcttaaaacaacgctctcgtgtgtgtgtatacacgtgacctccttggattctccctctcagagaaggaatttactttcagttctccctcttttttccttaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagtaaggatgacactgggggccgcaagggctaggcgtcccataggcatactctgttccacatgggccgaagcttaggcgtgtcctgaggctcctggagcccacctgcacgcctcctgctgtctccaccccactttgagcccacagacctccctgtgtgggtctcagacccctgactgatgacttatattgctttgttttttttccaccagtgttcatgagtttttcctaaccagaatttttctaatcattgccatttgccttttggttcgagatgctttttgaaattggattttcagatactctacgcccctacagctctgtccactttgaaaagctgctttcagagcttctctgtctgccatagctttgagttctgagaatggaattttgtaatgaaatggctctgtcctctttcctctagctgagcccccatattgccctgtgtccctcctttagggtatttctgactccactagtggaatcagcagttttggacacttgggaaatatccaggaaatacattcccactagagtttgggtagaatagtgaaatttttgggctccagtgatcctcagtaagatcagagttatttgtccactttatagattctgttactatagagataagaatgggaggttttggtttgtgttctttttttttttttttgagacagattctcgctctgtcatccagactggagtgcagtggtgtgatcttggcttactgcaacctctgcctcctgggttcaagtgattctcctgcctcagcctcccaagtagctgggactgctggcacatgccaccatgcccagctaatttttgtatttttagtagagatggggtttcactgtgttggccaggctggtctcaaactcctgacctcgtgatccgcccgccttggcctcccagagtgctgggattacaggcgtgagccaccacgcctggccttggtttgtattcttaccagtagtctgggtcataaatataagaggaaaaagatcaaatacgtggctaaattgcctgttagcactcagtaaaatttctttctaagggtagtccagtctgttccctgaccttgctctgtgaagttaccagtgttttcagcacaggaaaatctgccttaagcatggcagacccgccaggaaaatgaaggtgaactaaccctctaattttcctgctatttctttactgtcatgtcactcatgacttagactgctccttagacctgttgaataactccatagtttcccaacattaagcatccaccatcatggcaccagtcggagctgctgcctttcatccctgtggattaaccccactaattcgtgcatgcttttgctgtgccccctctgtgcaggacacgcataactaaggaggccggcagtgtatctctgcgtatgaagcaggtggaagaactgtgagtaggctgagagtcttgcagagcaccaatgtccactgctaccctatccattctccctctgccgcttctcttgaaggcctttgtccatccagaaagatgaggtggtgggaggaactgcctgtccgtgcagcagctttggctcacaagggaagaggtcgcggtgcagctgtgtcggtcgatgactgcttatctcattggttgcttccatgtgcagctgtgtgttcagagtggtgttggttctccctcctgttggtttttgtggtggaccagccactatcagcagcaaacctgaaggcctgttctatagttttccttagtaggaaggaaatcatatgcttctcttaaagtgctctgattcttggtaactcattgcttttttattttactttgggacacttagatttgatgatgattctagttttttttaatttttagttttttattgtttgttgttttcgtgttcaaagataatatttcagccttttgtattttagttcccgagggttagaatattctttgattcttaagaaatctttcaagtaacagaatggcacagatactcagtactgtgcctgattttccttctgaacttgccaaaactttctgagagctgaatgtatcattttagaaatgtcctactaatatggagataaaacatcctatatgaggatattttaaagctcagtgtaccctcccccacctcaccccagcctgggggctcttcagagaattataaaagacagaaaaaccctctgtatacattctgcccagcaagttcatctcgtctctccactgtagttgcatgagccctgtgttactgtgctaagcgcttggtttcagtcccttgtggttgtgttgttctaagtgcagaatcggcctggggataagtgtgcctggctgttctagccacctggttgtgaacagtacagtgtgcgcatatctctcaggctgtggcgtgggtacttgggatcctcgtcttcatctgataactctgttactagggcatcatcattacaaactcgtagcctggaatccacatcttggagacacctcgtggtttgcctttatgttagcatctacagctaactgccttccttgtccctcttgtcaccctcttgaattccatcagatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggtatgggcagtcttcaggctcagctgaaaatttgtttaaagatttgagtctcttgatttttttttttttttttttttgagatggattctcactgtcatccaagctggagtgcagtggtatgacttcggctcactgcaacctctgcctcctgggttcaagtggttctcctgcctcagcatcctgagttgctgggattacagatgtgcgtcaccacgccctgctaatttttgtattttttggtagagacaggttttcaccatgttggccagactggtctcaaactcctgacctcaggtgatccacccgcctcaggctcccaaagtactgggattataggcatgagcttctgcgcctggccagagtctcttgatttctgactgcaaattactggaatgcaaattacatagattatattccatcatgtatgtagctttttttttttttttttttcaatttttttttttttccttttgagacagagtctctcttttgtcgcccaggctggagtgcaatggtgcgatctcggctcactgcaactcctcctcccaggttcaagcagttctgtctcagcctcccgagtagctcaccaccacgcctggctagtttttgtatttttagtagagatgaggtttcaccatattggtcaggctggtctcaaactgctgacctcaggtgatccgcctgcctcagcctcccaaagtactgggataacaggcgtaagccaccgtgcccggcctcagttttttttttgttcaagacagagtctcactctatcacccaggctagagtacagtggctcgatctcagctcactgcaacttctgcctcccaggctcaagtgattctcatgcctcagccacccgagtagctgggattacaggtacgcacgaccacatctggcaaatttttgtatttttagtacaaccgggattttgccatgttggccagcctggtcttgaactcctggcctcaagtgatctgcccacctcagcttcccaaggtgctgggattacaggcatgagctaccatgcctggcctgtgtagctatttttaaaagactttaattgaaacctttttggacaaatttagttttaaggaaagatatgctatgttctctacatgttgttataagaacttttctaagcctaaactacaatagatgtgaaagtactcttttttttttaattggggtaaattcacaaagctagccattttaaactgtacaattcagtggtatttagtacattcacagtgttgtgcaaccaccacctctagttccgaaacatttgtgtcacttcagaagaaaaccacatatccgtcaagcattcatttgccattctccctaaccccagtggcccacgcagccactcatctgctgcttgcctccagatttacctattctggacatttatataaatggaatcacgttatgtcactttttgtgactggcttcttttgtttaggttttctttcttttatttatttattttttgagacaaggtgttctgttgcccaggctggagtgcagtggcccagtctcggcttactgcagcctccgcttcctgggctcaagtgatcctcctgcctcagcctcctgagtagctgggattataggtatgcaccactatgctcagctaatttttgtattttttgtagagacaaggttttgccatgttgcccagtctggtctcaaactcctgagctcaggccgtctgcccagcttgccctcccaaagtgctgggattacaggtgtgagccaccgcacccggcccataatgttttccaggttcatcctttttgtagcacataccagtactccattcctttttattgctgaataatatttcactgtttgatacactacacattgtttttgggtttttttgttttgttcgttttttttgtttgtttgtttgtttttcgagacagagtctctctctgttgcccaggctggagtgcagtggcgcaatctcggctcactgcaacctccacctcccaggttcacgccattctcctgcctcagcctcccgagtagctgggactacaggcacccgccaccacgcccggctaattttttgtatttttagtagagatggggtttcaccgtgttagccaggatggtcttgatctcctgacctcgtgatccacccgcctcggtctcccaaagtgctgggattacaggcgtgagccaccacgcccggcctaatatactacacattgtttatccattccaccacttaaaaggattcttacaacaaattaaaatgaggagggagaacttatttctcctatagtaactgtgcattaaaattttatctcgtttttatttattttttagagatagggtctcactctctcacacagggtagagggcagtggatgatcatagctcactgtaacctcaaactcctgtgctcaagtgatcctcccacctcagccacccgagtggctgggactatgcacataggctaccacatccattattataattgaaaaaatttttctggccgggcccagtggcgcatgcctgtaatcccagcactttgggaggccgaggcaggcagatcacctaaggtcaggagttcgagactagcctggccaacatggcaaaaccccatctctgctgaaaatacaaaaattagctgggcgtggtagcgcctgcctgtagacccagctactcggtacactgaggcatgaagatcgcttgaacccgggaggcggaggttgcagtgagccatgatcacgccactgcactccagtctgggcaatagagtgagactgagtctcattagagaaaaaaaagaaaaaaaatttttctgtagagataggggtctggttatgttgccctaagctggtcttgaacttaagcaatcctcctgctttggcctcccatagtcctgggattaaaggtgtgagccaccacacctggcctcatcacatttttaaaacattattttaaaaccaaaaagaggttttaaaaaagtctctatttgataaaattatttgctgggcatagtggtgtgtgcctatagtccaagctactcagaagattgaggtaggaggattgcttgagcctgggaggtagagactgcagtgatccatgattgtaatactccactccagcgtgggtgacagtgagaccccgtctccaaaaaagacaaaaaactacagttaatgaagtaaatttgagtccaataattatctgaggactgggaaaaccaatccatagggatacctgttgaacagatccttatagctttttttgtttgttttgttttgtttttgttttgttttgagacagagtcttgctctgttgcccaggatggagtgcagtggcacgattttggctcactgtaacctctgccgcaccccggttcaagcgattctcctgcctcaacctcccgaacagctgggattacaggcgcctgccaccgcgcctagctaatttttgtatttttagtagagacggggtttcaccatattggcccggctggtcttggactcctgacctcgtgatccacccatctcggcctcccaaagtgctgggattacaggcgtgagccaccgcacccggcctgttttgttttgtttttgagatggagtttcgctcttgttgcacaggctggagtgcaatggcgcaatctcagctcaccgcaacctctgcctaccgggttcaagcgattctcctgcctcagcctcccgagtagctgggattacaggcatggacccccacacccagctaattttgtattttcagtagggacagggtttctccatgttggttaggttggtctcgaactcccgacctcaggtgatccgcccacttgggcctcccaaagtgctgggattacaggcgtgagccaccatgcccccagccatagcttatttttttaatcccccccttttttttttttggtaggcctctgtagaagaatccttatagtttcaagccatagtttgtgactatgtctcctttgactttggcttgctattttgggttttagttattatggcttttgctttaaaggacctgaaggccaatgagtcacggttgaaggacattaacaaggtagctgaagacctggagtctgaaggtctcatggcagaggaggtgcaggctgtgcaacaacaggtaggtgtctccatcttggagtgaggctctgttgctgtaaggatgcagctttgttcctcttgtgtctgtcatagcccaacaagcagtgtttcataacacagaactgtggcttggctgtaggtcaggtcctctatgtgaccaaaaccattttgattaacttctttatacccatatccctcactttcacttggtttggaggggggtgggggcttctgtcttctccgtaagctcattaaatatttaatgtttatatagccattaactaatggtaatttcataagttcctcaaagaaaaagtttatatataaatacttgaagctctgctggacatttggactggcatttccatttgtccttttggaattatctcctgtgtttccaggtttggccataataagtattcttgagagatgtgtatttcttctaataataaaactggtttctctctctccttgtaggaagtgtatggcatgatgcccagggtaagtttcgggtgctgtgtgtggatcttgaacatgagaaggacttaaatcttgggaagaatatcaagccaagaacttcttcatcagaattgctgttcctgaacctcagatgccttttgtgtgtaaagatttgtggaaaactccaaaaattgatttctttttttttgagacggagtctcactctgtcaaccaggctggagtgcagtggtgtgatcttggctcactgcaacctccacctcccaggttcaagcgattctcccatctcagcttcctgagtagctggaattccacgcatgtggcaccacacccagctaatttttgtatttttagtagagatggggtttcaccatgttgtccaggctggtctcgaactcccaacctcaggtgatctgcccacctcagcttcccagagtgctgggattacagacgtgagccaccatgcccagcccagaaattgatttctatttgccattctccaaaagacaaaaaaagttggtttttttttttttcggtcttttgtttgtttgtttgttttttaagagatagggtcttgctttgttgcccagactggaggtcagtggcttttcacagctgcagttatagcctactgcagcctcgaactcttggcctcaagcaatcctcccacctcagcctcccaggtatctaggacaacaggcatgcaacacaaagcacagctctaaaaaaaaaaaaaaaaaaaaagtcttctgtctcttcagttttctaaaactttttctatagctatctttaggttcatttattacccctttgcagacaatcttatgagtacaacataaaagttggtggttttcttattaaatttctttattctctccatttcttctactggataaaaaaattggaatttttctctcccctgtttgttggcttaatttttcttaaccagccttgtagtttgttaccagccaaactatggagggaaaatgctgttttggttaatgtattagtatctgggatctcccctgggggaaactagagtcattcgctggaaaggccaggtgctttgtttcatggtcaattgcttggctgcctaaattcctctttctttgaataggatgaaactgattccaagacagcctccccgtggaaggtaagaactcctttgcaaattattgttttcaagagttttgcgagatcatgaaatatgtccttttctggtgtgcctttctctgaatattcagcttaagtctttagtcatttctggacttgtttgggctggtttctttctgaatctgttaactctaaaatgtgatgcttaatatacaaaagcagagtgtctgtcaaatgctcagtacagttaggttgcattgattacccatgttggtgcaggatatgctgcagcagggagcactgttgttggcagggtcccaccagtaagaggcggtccaaagggaaatgatgtgaacacgagaacaactacacatgtaaaggagggcaggccttcattcaccatctgcctggcctctttatcctgtggcctaagaaaggcttcagagatgcccaatacagagatgtaaagggaggaatgagatgtttccccactacagtagacatttttctggacaaatctgggtgtgaatatggcttaaccagaatgggccatccctgaccaagaatacagggagaaggtgtgtttttttgttttgttttgttttgagatggagtattgccctgtcacccaggctggagtgcagtggcacaatctcggctcactgcaacctccgcctccccagttcgagcaattctcctgcctcagcctcccaagtagctgggactacaggcatgtgccaccatgcctggcaaatttttgtatttttagtagagacagggtttcgccatgttggccagggtggtctttaactcctgacctcaggtgatctgcctgcctcagccttccaaagtgttgggattacaggcctgagtcacagcacacagccagggagaaagtctttttttttttttttttttttttttttgagacggagtctcgctctgttgcccaggctggagtgcagtggcacgatctcagctcactgcaacctctgcttcccagattcaagcgatcctccttcctcagctcccctagtagctggggttacaggcatgcaccaccatgcctcctaatttttgtatgttcagaagagatagggtttccctgtgttagccaggctggtctcaaactcctgacctcgggtgatccacctgcctcggcctcccaaagtgttgggattactggcccggctgaggttttttatgtgatacatttataactgtgattgtgtaactggttgcctgtgtaactggttgcctgtgtctcagttctagcatcttccctcctgacccagctcttcaggaatacatcacttgagttacaggcaagttagacagcagattctgactttataaaagtagatcttttggctaggtgttgtggctcacacctgtaatcccagcattgtgggaggctgccacaggtggatgagcccaggaactggagaccagcctgggcaacatggcaaaaccccggctctacaaataaaaataaaaatgttttaaaaagaagaagaaaaaaagtaggccttctcctcattagtacagtggtgagtttgacaagcaaataaaaaacaaaaagtaaaaagaaattttaaaagtgtgtccccagaaatatgaagaaagcatgaaaagctaaaaacaaaaagcctcccctcaacaacctttccgtgtccacctttgaacccgctcagtcaccttgtctgacctctcctgaggacctaggctgagaggggtctgtgtcttgtggcctccttcccccactggctctgactattctcctcattaagtagatttctaactgggccaggcatgggtatacacctttccttctattcaactttctctccttttctcactcttcccttttcttacgtagcaaaacttggtcattgatgatatgaatgggcaacagccttaccccctcaacagaatgtttctgataacataagtattctttcagaaatttattttaggtacctttataaatcccagtacctcttattggagacagtgggtccaccttctgactcctataaacacacgggttgaaaatgtcacctagggatgccatgaggacatctgcatccaagctcagccctcctgccctcctgtttttttttttgttttttttgggttttttttgtttttttttttttgagacagagtcttgctctttcgcccaggctggagtgcagtaacgtgatctcagctcactgcaacctctgcctcctgggttcaagcaattctcccacctcagcctcccgtgtagctaggattacaggcacccgccaccatgcctggctaatttttatatttttagtagagacggggtttcgccaagttggccaggctggtattgatctcctaacctcacctgatccacccgccttggcctcccaaagtgctgggattacaggcgtgagccatcatgcccttcctcttgttctttactcaaagggttgtgagcattataacctaggccaattagagtttctttccaatgaattgggtgggctgaaagatcctaagggactttatttatttgtttttatttgtattttatttatttattttcgagtcggagtcttgctccgttgcccaggctggagtgcagtggcgcaatctcagctcactgcaacctctgcctcccaggttcaagcgattctcatgcctcagcctcccaagtagctaggattacaggctcacaccaccgtgcccagctaatttttgtatttttagtggagacggggtttcaccatgttggtcaggctggtctcaaactcctgacctcaggtgatccacccactttggtcccccaaagtgctgggattacaggcgtgagccagcatgcctagccctaagggactttaggtttttagaagtagctacgttgttgaaatgtacgttgttgaaatgtacgttgttgaaatgtacgttgttgaaagctaattcactgctttattttttccctctggtaaagccgttgcccttcaacggggatacggttaaaaagaacagcaacccagtaactataattggagatgaaagtgattattagagctcctggctgttaaacagtctcagctgccagcatttgttaaatttagggtttttttttttccggaatgttctcctgtagtatagacaagaaaatgacactaatcattagtcttttaggtatttttctgtccaactagctgctagaattgtggtttttaccattcttttttcactcttcatcagataaaattaattactcagttgagtctaattgtgcactttgggtattttcatgacattctagtacttgacacttgtactgatgtctctgttaagaatgttgacagtatccctttaaggtaatttgggttaatcacagggacctaatcaatgacacttgcagctcagatctctaattgccagacacttgattagttttgccttctgctttcctccctacctagtctgctcgtctgatggttcacaccgtggccacctttaattccatcaaggtaagaagcagtgaccagctcctctgatctcccctggttttctccactatcttccttccctgtctacagcagagctcttgttcttgtcaaccgggtgacctgtgacatatctcactctattgggtccaagcatgtcctaagtaaacatcagcacattcatggccgctgggtagcttggtggctttcctggtcaagagcctgccagttctcaacagtggagcaagccttccctctgatttccagtagggcagggagctggaaggagcacagtctcagtaatgcagtgagcggcttccttgccgcctgcagtgcgaggtcctgtggcgtgtcggctcttcccaggcctgctctggcctgagagtctgctgattgggtgttgggaggcagcagactcgctgggatttctccacgcagctgtgacttaggaagcagttgctacctgccaggccccaggctaggaggtgagagtaaggaaaagtcagctgtgtctctcctgctgcctcagagaggatgcctaggtcaggtgtttgtgggtgttgaagctgtcaagcacagctagttttggcttggctcttactggaatattgtatactaatttattcagcgaggaaggttggaaacaggaaattatatatgccctagcatctccttcaaacaaagtcattttcccaaagtctgactgggggcatgacaggagagggagtgcagtggagctgatgttttgctgtcctgcaggagctgaatgagcgctggcggtccctacagcagctggccgaggaacggagccagctcttgggcagcgcccatgaagtacagaggttccacaggtgaggggtcagccctgggctgggagagggagaaacaggtgactgctggtttcctgacagcccccaagcttgctgactgagatcctagagcaactgctggctcttactgatgtttatttgtgacatggggtgggtgctcagtaaatcctgctaagtgaattatttggctttttagagttattggtggtagccacagacaaatatacaaatgtcagctaaataaatttttttaggctgggcgtggtggctcatgcctgtaatcccagcactttgggaggccaaggcaggcagatcacctgaggtcaggagttcaagaccagcctggccaacatggggaaacccacctctactaaaaataaaaaaattagctgggcatggtggtgggcgcctgtaatcctagctacttgggaggttgaggcaggagaatcacttgaacccggtgggggcggaggttgcagtgagctgagattgtgcattgtgctccagcctgggtgacaagaatgaaactccatctcagtaaataaataaataaataaataaataaattttttttagtgtcctgtaatcaaggcagttgtacttggcatttcttaacctgaatgtgtctcgcctttagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtgagaggacccaaagtcatcttctgtctggcatttttgccccagaaagagcagagtcttctgttctgcagagcatacccccttactgcaagctcattcaccactttcttcccataggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccggtacggagccatgttcactcagacttctggaacatagagccttctttgtaggggtcatttttattgtgaaaatagtacatgctcagcagggtacaatggctcacacctataatccaagcactttggggggccaaggcaagcgaattgcttgaactcaggagccggagaccagcctgggctacatggcgaaaccctatttctattataaaattttaatttaaaaatcaaaaacggccaggcacagtggctcacgtctataaccccagcactttggtaggccaaggcgggcagatcacctgaggtcaagagttcaagaccagcctggccaacatggcgaaatgccgtctctaccaaaagtacaaaaattagccaggtgtggtggcaggcatctgtaatcccagctactcaggaggctgaggcaggagaatcgcttgaacctgggaggcggaggttgcagtgagccaagatcgtgccactgcactccagcccgggcaacaagagtgaaactccatctcaaaaaaaaaaaaaaattaaaaacagaaaaaagtagtacataatcaatgtaaaatagtcaaactactgaatgccatattgttaaaaataagtctctgcagccgggcacggtggctcacgcctgtaatcccagcactttgggaagtcaaagcaggtggatcacgaggtcaggaattcaggaccagcctggccaatatggtgaaaccccatctctactaaaaatacaaaccagccgggcgtggtggcacactggcacacacctgtaattccagctactcgggaggctgaggcaggagaatcatttgaacctggaggcggaggttgcagtgagccgagatcgcaccaccgtactctagcctgggcgatggagcaagactctgcctcaaaaaaaaaaaaaaaaaacaagtctctactttcctatccaagtatgggcatactccctctcatctccttgccatatgacattatatttttccctagacatatatatatatatattttttttttggggggggaagcgtttcgcttttgtgcccaggctggagtgcagtggtgcgatctcagctcaccgcaacctccgcctcctgggttcaagcgattctcctgcctcagcctcccaagtagctgggatcacaggcatgcaccaccaagcccggctaattttgtattttttttagtagaggcggggtttctccatgttggtcaggctggtctcgaactcctgacctcaggtgatccacccacctcggcctcccaaagtgctgggattacaggcgtgagccactgcgcctggttgtctttttcttctttttattgaggtaaaagccacgtaacatacaattaactactttaaaatgtgcaatccaatgacatttaatgtattcacggtgttgtgcagccacccctctctagttttggaacattttcattgccctagaataacattccttaactaatcaccccctcttctctcttccccacccactaggaatcctttatctgctttctatgtctatggatttgcctcttctggacatgtcatataaaaggaatcataccatatctgaccttacacactcagttttgtgcccttgtggttgtacagctgtgagaaactggatcaaatgtatgcccaggcctagggcttcaagggttaatcctaaagaaaggctttttcttttttttcttttttttttagagacagggttgcaccacattgcccaaactgatcttgaattcctgagctcaagcgatcctcctgcctcagcctcccaaagtgctgggattacaggcatgagccaccacgcctggccaacaaaagctttttcatttgaagctatcaaagacttaattgtagctagaacttgttattctggagggtgaaaagatcttaattataagcctactgacttttcctctgagaaattcggacttttaaaaaaataacaagaagttttttaacactttgcccaaagacctagcctcattcagtagatcagattaacccaagataactttctgaggcaagaattatgtcattctctgttttcctgggcagaagatctccttaccaggtaatataatagctatttttctggggtgctggtttccagggacctcatgtcttggatcaatggaatacgggggttggtgtcctcagatgagctagccaaggatgtcaccggagctgaggcattgctggagcgacaccaggtgggtggacctgcctgctgagtagcaaagacgtggctgctctgcagggccctagaggcctcattcccaccctttgtggtgagtcggtggttgacgtcagagtgggcatctgctgccagttacctaatcccttccctccttttggcaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcaggtgtgtgtgctcctggtttctgaccaagtgtttccttgctgaagggcctcattttctcacctgcctcttgccctctttagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggtgaggcctctggaccatggagttggagtctggatttttcctgattgacatctgtttcttggcttatatagtcactgttatatctccaaggaatacctgcgttgtctaagaaaaatatgtacataaataatctttaaaactttatagattctggtatttctgagattttaataatgggggtgccacaggaaaaaaaaatattatcaaagggatggaaaacaaatgtgtgggtaggtaagggaataatgaacaaacaacaaggaagatgtaaaactgtttgatttatacgtcactttgctgtaaatctgacagcattttcctattatcaggcttaattttgttctgttctgatattctaacacctgccccacctgagtgacctggagacttcttgagttaaactctactctagtaatgaatgaaatcaagctttcttttggcattttacactcttgcttctaaagtgtcagtgtattctgatcctgccaccagctagttctcagtcacccaaaataactatccttttctcaagactggcagtccaggcagggcccagccacaggcccaccttgatctcatgcctttgttttctgacaggaagagaagattgctgctctgcaggcctttgccgaccagctcatcgctgccggccattatgccaagggagacatttctagccggcgcaatgaggtcttggacaggtgggtgtcctgtggcactgacatagtcaccagccctgagaggatgcatcccctcatacgaaggcccaggcctgttctgtctccccacttccttctccacggtaagatatgctcatgttggatctcatggtttcactctttcaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggtaagctgaagtgactgggtgttggtcttgatgtagccttatgttattgagtagattttgttaaataaagcatttataaaacaatctccttgcacccatgggaagtcagtgagaaatatttcagtaagcccagccagtgggaaagccctagtcaagtttcagagccatttaaaagttgccttcctcatttgtctccattaaaactatttctgctgtaataaaagtctatagaatcccccttctattactgttcccaaatgctgagcttcctgggggaagtatgacaaaatgagtttctatttaatagctgatatgtgtgtccacatcagtgtactgaactcttgttcttttaatctgtttttgtagctttccaagctgctggtaagtttttaatttttttaagagttgtagttaaatgagctccagtatttgtgttactctgcgtagattattgttattattgtggtcacacggtttgctggtgtctcttcatccatccttttcatttctaatcatccattacactccattcaagtgtccctgtgggatgtggctttttctgttgtaattagcctgcaacgccttactcccccttctctcccccagtttatcacttaggcaaattctgtacagtgtttgatttgcggggcagtaattgaccattttctttcaaggagtgcttccttttgaagatggaacatcagcttcagctttttctgtgtagacattggctcagacttgctatgagctcatggtgttcggtggcctgggttggggaggccagtctggtgtgagggttttaatgcatacccactctggcatccagaggtgccagtcaggagaggaacagctagagaactgtagagagacggatggtctattaatacctccaaatcttcaaggaacacaaatgagaagttaagataaaagcagacatcactcaacaggtagtgaaaggagacttcagtcaacatgtagctcaaagttacttaagcgggtggaagaaatgaagatagagaagagagtaaatgggatttgaaccaaagggtgatcagaacaaggaacagaagaagagggtaatgggacttttgtcaggatatctgagtgtttgagacccttttccttcttggctttgggatcaggcggtgggagaacgtaacaaggacatttcatgttagtgctgaattgagccagatggctccatcctttgacagttgctgcctctgaaatgaaacatttgatgcagaattccccaacactactgccttttagttgttttttttttgccccccaaataacactcccctgagaccctgcatttcttacccagccaattgtttttcccagaattgtggcatagctgctatgtccttgcaattgtctcttgtagcatttcagtaccttctgtttctttatggattcataaaaaccatatcaggcgcccaggatcaggagcccatccttctcctagccctttcatttcccagtaaaataaattccttcctgcagtcaagcctgggttctgacagtatcccagtgttttgattaatgacagctacctaaagataaatcaacaaagccaatgtctgtagtagctgtagatttctcctctgtcaacagagggaaaagactgaccatcaaatattattttgctggttattacaatttatgttatgaattttgcttaatggtgatttctgctttagataatgaaatgtccatatgtatctcattcattacagcctgtctccaataaggagaaagccatggatggaaattgatgtacaagcagattcaaaactgaagttggccattgccatcttctggaaagtgttaggaagtgtgtaattctagggcttcactcccaaatagctagcatagctactgcaagaattgattttttggccaggcttggtggctcatgcttgtaatcccagaactttgggaggccaatgtggctcgattgcttgagctcgggagttcaagaccagcctgggcaacatggcgaaaccccatctctacaaaaaatagaaaaattagctgggtgtgatgtcatgcacccatggtcccagctattcgggaggctgaggtaggaggattgcttgagccgaagaggttgaggctgcagtgagctgagattacgccactgcactccagcctgggcaactgagcaagaccctgtctcaaaaaaaaggacttccagttcatctactcctgagctagtacatttccttcctcctttgctaactccccaagagatgaaccctaaaatatttcatacaaactccaattgccttctgttaaaaacgttggcatttaccccagttctttatgtttgctgccactccctgcctctgagaaccccttccccctgaaaagacataacctagcaggaactggtttggaaaaaatttttttggtatttttagagcaagcaccagaagcaccaggcttttgaagcagagctgcatgccaacgctgaccggatccgtggggttatcgacatgggcaactccctcattgaacgtggagcctgtgccggcagtgaggatgctgtcaaggtatggcccaccagctcccggtgcccagggaggaagatgaccaccgtcactgtcaacctgatataataacttggacatacagtcttaagacactaaatggattatagaagactttaggctgaattacagatggggaatgctagtgagaatggctcctatgagtgttttccattctcttctcttagaagttctcaaattgagctttaggagagggacgattcttcatagatttcatctctttttggctcccttctgttccccaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtaacactgagtggttcctcttcctaccagtgggggatttctagtcatttggcacagtgggtccatcagtgcccaaaaccacgaaaaggcagggctcaccagacaccccttttgacagaaacccttattatatatgagttgcatgctgtaagggatttatgagcaaagggagtgaatgttaagagagctgacttgtagtggcacttggactacaggtcactcacatccatagggaaggcaaataggaagagattatgggtagttatatggcatgcagctctaacaagcctatgccaggttagaaaccaagatagtagcatctgggaagccagagtcagtcatgtattctccatggagaatgtttggaaagcacagactataaaaacatagaggttttggccaggtgcagtggctcacgcctgtaatcccaacactttgggaggccgaggcaggcagatcacttgaggtcaggagttcgagaccagcctgaccaacatagtgaaatcctgtctctactaaaaatacaaaaattagccaggcgtggtggcacgctcctgtaatcccagctactcaggaggctgagcaggagaatcgcttgaacctgggaggtggaggttgcagtgagctgggatcacaccattgcactccagcctgggcaacagagcgagacttcatctcaaaaaaaaaaaatttttttttttaataattgcgtaagtttatcatagagccatgccataatgtaaccattcccatattgttggacattgaggtgttcccagccttttggtgtatatattttgctgtagtgaatatctttgaatattaatctttgtccacactgctgattctttcctaggggggtttccttgaactaggattgctgtgcattttgccttagctgtagtatttactatgaatagactctggagtctaggtttgactgaccgagtggagagagtgtctcaggccgggcaggctgattggggtggctaggaatcacagtaacacattgtgatggagaagtattcaactgtccaagcaaggccctggaatagccactgggcaacctgaattttccagaatgctgagtatacaccacacagtagcctttgctttttgtgttttcattgccaggtggaggccctgctggcatccgaagattatggcaaagacctagcttctgtgaacaacctgctgaaaaagcatcaactgctggaagcagatatatctgcccatgaggtaagcaaagggaggcgggccaggcccgagtgcctgggacacagctctgcctgactcctaaggaaaacaagcgtgtttgagaaaagagagtgacttctttcacttaaagcagccattctcaaaggttgtggcctcaggatcattatacacttggcagttattgagggctcttgagagatttttattatgtaggttttatcaatgctcaccattattaaaaattacataaattttaaggccaggtgcagtggcttacggctgtaatcccagcactttgggaggcccagacaggcagatctcctgaggtcaggagttcgagaccactccggccaacgtggtgagacctccgtctctactaaaaatacaaaaattagccgggcgtggtggtggctgcctgtaatcccaggtactcaggcgactgaggtaggagaatcacttgagcccaggaggcggaggttgcggtaagccaagatcgcgccacggcactccagcctaggcaacagagcaagactccatctcaaaaaaaaaaaaaaatgctgaattcaggttgtggtgttttgcattggatgaaaattcagttttacacaggtaggtaggtagaaaagggaggaatattttgattcgggtaagtgtgaataattttctttgatactataccaaagtcatagtttcttaaagcttagctgtggtcaggtacagtggctcacacctgtaatcccagcactttgggaggccgaggcaggcagatcatgtgagcccaggagttcaagaccagcctgggcaacatgatgagactctgtctgtacaaaaaaatacaaaaattaggctgggcatggtgagtcatgcctgtaatcgtagcactttgggaggccgaggcgggtggatcgcctgagctcaggagttcgagaccagcttgggtaacacagtgaaaccccgtttctactgaaatacaaaaaattagcagggcgtggcatgtgcctataaatcccggctacttgggaggctgaggcaggagaattgcttgagcccgggaggcagaggttgcagtgagccgagattgtgtaactgtattccagcctgggcgacagaatgagactacgtctcaaaaaaaaaacaaaaaaaaaacacaaaaattaattagccaaacgttggggtatgcacctatagtcccagttacttggaggccgaggcgggaggttcacttgagtccaggcaggaggttgaggctgcagtgtgtgtgtcatgatcacaccaccgcactcttggatgacagagcaaggaaaaaaaagttgttggggggttagttgcaaagtggcccctgaaaccttgtcagtaaactttttatactggattatattaaaacccactggtccatcttgggctttgaatgtagctcttacctgtgcatgattttgcaacatcatgcatggctcatttggtaaatattgcttcactgagttatgcctgttctatatgttgacacatgtgattatatgatatcaaaacattgcagttaataccaccaccaatttcattagaaaaatcttcacatattaggaagccttcaggctcctggtggtgggtgtaagttttctaaaattctaactttctcataaaagtttgaattttatcattagtaacaaactgtcagtattctttgaagtgacaggctcactttatttattctggaccgagtatctgtgagataccaagtctgaatgagcatagtttgttcggtggttgttctttcaagtacaaaagaatggctactcagtaaaattaactttcactgcctttttaaggacatttttaagtgaaacagcatttttttttcactgtgagtgggtggcagtgaagaatccacttctgctagtagtttgccactgccttgatttgagctaaagcaccagcatgtcccctcctccattgcttttgtactatcagtgcaaatgtccacacggtaaaaaataataatgtcttataatgttatgaaaatagtgtgagttgatagaatgccagaggtccacataacagactttgagaatatcaacactccacatctcagtaaggaattcctgagttcttatgttcaagcagatagctgtgggagacccagtttctgaccctcttatgtcccctgccccaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaagtatgtcttctcagccctctagaaggccccttacgcctgtaatagtgggcagcaggaaccacaggctgactgttgagtggtgaggctggaaaccctgctggactgggatcccagcttgggcacacagtcgtgggatgcctcagtgtcttctgctttccgggtttacagtgatgataattggcggtggtggtgatccatgctggctacataggccctgtctagaccctgccttttagattcccgtgaaagttagtgagtttgtttctgagcttctggagaagatcacttctccaaggaaggagttgctttttttcttattctctatctgtccccgaaaatgtcagtctactgattccagttgatgtggcaggtaaacaaacatttttttttctgagatggagtctcgctctgtcaccaggctagaatgccaccatgcctggctaatttttgtatttttagtagagacagggtttcactatgttggccaggctagtctcgagctgacctcacctgacctcaagtgatccacccacctgggcctcccaaagtgctgtgatcacaggcatgagccactgcgcctggtcggaaggctttaaggaagtaaggaattaagagagaggattttgttcttaaaagacgtttgtggccgggcgcagtggctcacgcctgtgatcacagtactttgggaggctgaggcgggcagatcacttgaggtcaggagttcgagaccagcctggccaacatggtgaaaccccgtctctactaaatacacaaaaattagccaggtgtggtagcaggcgcctgtggtcccagctgcttgtgaggctgaggcaggataatcgcttgaaccagggaggcggaggttgcaatgagccaagatcgcaccactgtactccagagcaagactccgtctcaaaaaaataaaaaataaaaatataaaaattagctgggcatggtggcacgtgcctgtaatcccagctactcaggaggctgaggcaggagaatgatttgaacctgggaagtggagatttcagtgagccaagatcgtgccactgcactccatcctaggcgacagagcaagactttgtctcaaaaaatatatatattacttatatagctgggtgtggtggctcacgcctataatcccaacactttgggagaccgaggtgggcagatcacttgaatccaagagtttgagaccagcctgggcaacatggtgaaaactcatctctaccaaaaatagaaaaaattagccaggcatagtggcgcacacctgtggtcccagctactccggaggctgaggtgggaggatcacttgaaccggagtggcggaggttgcagtaagcagagatcatgccattgcactttagcctgggcaacagaatgagactctgtctcaaaaaaaaaaaaagtgtgtatatatgtatatatataaatatctttgtatatttacagacatatattgatatattaatacatatttagtatacatgattgatatatattgatataatttgatagggctcctcagggcagcactagtgatgcctcccatcctccagtgcatccccaaccctccagaatccggacacacagcagggctcatagatgcatagatggacagaggttcttggtccctactcatttgggaagtagaggcttttgttgttcagaaaactggcaaggattttcccagaaagattagtagatgtctgtgaggtccacagttgacctgatgtccccacttgaaagcagggaggtgcagagactgactgtgctgtttcccatctctcattcagggagaagaagctgctggtgggctcagaggactacggccgggacctaaccggcgtgcagaacctgaggaagaagcacaagcggctggaagcagaactggctgcgcatgagccggctattcaggtaaggaggccgccttctggccaagagggcagaggtgtttgagtgggccccaggggacagacaaaccccttgcgcttatttcactgaggtccctaaagtgttcatgacccctcagtccaaacctggagaagtcccaaacttgatgttgaggccttttcctgggagcttcgagacagaagcaccagaagagctacctgctgttaacctcctcgtccttgcctgtcagggtgtcctggacactggcaagaagctgtccgatgacaacaccatcgggaaagaggagatccagcagcggctggcgcagtttgtggagcactggaaagagctgaagcagctggcagctgcccggtgagtagtcagaggcaggagctcccgggaacaagtggaaggccagcacccaagggcagactctgagctgtgggggtccagtgggccctcctactgtctcctggacctttggcctcacatgtgccatagtcggtttgctccagagccacctcctacaggccatgctgaggtggtctcattctgttcatctggacccactgtatgagtccagaatcatacatgtttctgtatgagtccagaatcacacatgaatcacacatgaatcacacatgattctccagaaatcaagacatgagagtctggaatcacagagtgggtgattcatgatgttccatggacggcctgactgactgtgagggctcaccttttttgtgaatgtttttgtttttgtttttgagacggggtcttgctgtcacccaggctggagtgcagtggcacaatctcggctcactgcaagctctgcctcccaggttcacgccattctcctgcctcagcctcccgagtagctgggactacaggcacccgccaccaagcccagctaattttttgtatttttagtagagacggggtttcaccgtcttagccaggatggtctcgatctcctgatctcgtgatctgcccgcctcggcctcccaaagtgctgggattgcaggcatgagccaccatgcccagcttttgtgactgtttttaagcatatgttaactatcacaatcaaagctggaggagattatggctgattttcttcctgtctcctgtaattaggggtcagcggctggaagagtccttggaatatcagcagtttgtagccaatgtggaagaggaagaagcctggatcaatgagaaaatgaccctggtggccagcgaagattatggcgacactcttgccgccatccaggtgagacagaaaccaaaggtgtcacctgctttctctcttggcaactgcctgctggtcatcatttccctgttggtttgttagagggccctgctcttactaggagagcacacagggccagcagccaaggcctcagtagttggttttagccctcaagatctcacactaggggacatcacccttcagtaaacaaaattggtatggctttgtcagtctcagttcacgggccctgtcattcaccaggcagcgctgtgggcttgagtcttcatatcagtttcctggggctgccataaataagtaccacaaacggagtggcacgaacggagtaccacagacagagtggcacagatggagtggctgaggacaacagagatttattgcttctcagttctggaggccagaagtctgaaatcaagaagcaggcaggaccatgttctgcaaacctgtaggggaggatctttccttgcctcttccagtttttgctggcaccaggcgcccttggcatgtggcagcatcactccagtctctgcctgtcttcacgtagccatcttccctctgagtctgtcttcacttggcatcactctgtgtgtctattcacatttctgtgttctgttgtagggacatcaggtctattggattagggtccacgctaatgacctcatcttacctttgcagaggacatttgcaaagatcttgtttccacattcatgggtaccagaagttaggacttcaccatctcttgagggggacacagttcagcccatcacatactccctaaattggttaactgttgctacataacaacccgcctaaatgtagtggttgaaagcagcacccatttcttacttccaatggatctgtggatcagcggcatctgcagctgtcactggaggtccttcacgctcctgcattcaggcagagcgtggctgggctgagagatccatcacacactggcagctgagcctgattgtcatccagcctggacatctctgttcccctccacatggcctgttgtcctcaagctggctagaccaacctccttcagcagcattcagacaggcaaaggcaggagctgcaagatgtctgcggcctcacacatcatcctcactgccttctggccaaagcaagtcccaaggcagcccagaggcataggtggatagattcccctctggaaaggagatgctgcaaagtatcatggtcagatatgactaaattcctgcccccagatgtggaagcaggagtgtgcactcccaggaatcgagttagctttgagccaccttcctcaccatgggaagcatcctcccgctggtcagggtgattcaggtagaatttagatggtcagtcatttcccatcctctgcatagttgagttccctggaagcaaccaaaaaggcatggtctgcagtgcttaaattgtactaaggaaaagacctggggccaggtgcggtggctcacacctgtaatcccagcactttgggaggccaaggtgggcagatcacctgaggtcaggagtccgagaccaacctggccaacatggtgaaaccccgtctgtactaaaaactacaaaaattagctgggtgtggtggtgcacacctgtaatcccagctacttgggaggctgaggcaggagaatcgcttgaacctgggaggcagaggttgcagtgagccaagatcacgctgctgcactccagcctgggcaatagagcaagaactccgtctcaaaaagaaaaaaaaaagacatgacttggaaggccttttctgagatgtgttcaagttaaaccttaaaaatgtgtcgtttttgtttgggtgtatatcttcagcttgctttgtgtcattcttgtggtcctcttgggggagagaccataagtcactgttgatggatgacaaagggtttgacccttcccaaaggtccaaagactgtccctgctgaagcctgtcccaccactgctggttactctcactgcctcactgcctcctgttttccttccttttatgattctctatttattaatgttcctctttattatcctcttccccagctagactgtaatgtgtgcatggacagggaccatagcagttttgtcactctctgtccccggggcctagcccacaacacatagcaggctctcaatagtgtgccttggctgcttctactccagggcttactgaagaaacatgaagcttttgagacagacttcaccgtccacaaggatcgcgtgaatgatgtctgcaccaatggacaagacctcattaagaaggtgagtccagcccattggtaagacctccatcgcccactgggacacccacgtgttggtaccacagaggtcccccaaagttcacttcctgggatgttcaccaaaccaaggtctgcgtggagaccagcagcaattccattcctgtgtttcgtgacaagttggatatttccccctttttgaagccagtaaagttattctgcagtgcttattttttctgcattaagcaacagagacactggcactcccaaatgctgctcttagtttatttctcaagcaatacagtctctttatagggacagtagaaaatgcaaataagcaaaacataaaataaaaattacccataaagccccaccctgacaccacacattagatctttgtgtctgacctgccagacctttcttttctctccacaggtttagagctaccagctagatcaaacagccgcagactcccgtttaataggatcatatcactccataaattatcaaaaacctcgaggctgtacagggcattttagaaatgaatctacttcattcgcagcccttttgggagaaaaaataaaggggcttggtgctttctcagcagcagcgaagccacatccctcccacacagaagctctagactgaaggcagtgtgtccgtgggtcgggaattcaccagcaatcactcaggtgcagtgacgcacctggagtgcctcaggacagaggttttaacagctatggtttcctgtcacacacacatcatgagtaagatttctcatcacagaggttgcactcagcagtcatggccttcagactagggtttgatccataggcagcaacaatgtagctaaaatccacttcactggagagcttttcttccttgctctgatctgcaaataaacttgcgtgaaactaatttcagctacagccatgtatagatgtagacgtggctcctgcacacttaaccccctgacacacacccagacaacattctctgttcttcaagccaggagatcaccagtgtgagtgtccttcagcctcctggcaacgagccagctgctttttttttttttttttttttttgcgacggagtttcgctcttgttgcccaggctggagtgcaggggtgtgatctgggctcaccgcaacctccacctcccaggttgaaacgatgcttctgcctcagcctccctagtagctgggattacaggcatgtgccactatgcccggctaattttgtattgttagtagagatggggtttctccatgttggtcaggctggtctcgaactcctgacctcaggtgatccgccctcctcggcctcccaaagtgctgggattacaggcatgagccaccacccccggccagcgagccggctgctttgtcctcagcgacagcctgtttcctctttgaatttatctttcaattcttttttctttttattttccccctttccacaggtgttaaagaatttctctttaaattcaatgtgacttgtagtatggtttatttatttatttatttatttatttattttttagacggagtctcactctgtggcccaggctggagtgcactggcgcaatctcacctcactgccaccgccacctcctgggttcaagtgactctcctgcctcagcctcctgagtagctggggttacaggcgcctgccaccacgcccagctaatttttgtatttttattagagatggggtttcaccatgttggttaggctggtctcaaactcctgacctcatgatccgcctgcctcggcctcccaaagtgctgggattacaggcgtgagctactgtacccagccaatttttttatttttattttttgagatggagtcttgctcttgtcgcccaggctggagtgtagtggcacgatctcggctcactgtagcctctgcctcccgggtttcagcagttctcccacctgagcttccctagctagctgggaccacaggtgggtgtcaacacacctggctaatttctttctttttttcttttttttttttaagagatggggtctcactatgttatgttgcccaggctggtctccaactcctgggctcaagtgattctctcgccttgtgctgaaattacaggagtgagccactgcacccagccctgtatgtgtagtattttaagtgatatgattcagtttttttctatcaaaaataatactaatgaatatatcatcttaacttcaaatttcagcccattcgttttttttgtttgagacagagtcttgctgtgttgcccaggctggggtgcagtggcatgatctcggctcactgcagcctccacctcccaggttcaagcagttctcatccctcagcctcctgggtcactgggattacagatgagtgccaccaaacctggctaattttttttttttttttttttttgtattttttagaagagacagggtttcaccatattagccaagctggtcttgaacccctggcctcaaatgatctgcccacctcagcctcccagagtgctaggattacaggcgttagccactgcgcctggcccatatttctttagaattaattccttggaccggctgggcactatggctcacacctgtaatcccagcactttgggaagccgaggtgggcaaatcacctgaggtcaggagttcgagaccagcctgaccaacatggtgaaacccccatctctactaaaaataattagctgtgcatggtggtgttcgcctattagtcccagctactcgggaggctgaggcaggagaatctcttgaacccgggaggcggaggttgcagtgagccgagatcacgccactgcattccagcctgggcgacggagtgaaattcactccgtctcaaaaaaaaaaaaaaaaaaaaaaaaaagaattcctaaaagtagaattgtcagtacgtgtatttgtgtgaagcctttgaccgcattgctcttacaaaagccttaccctatcattgtttacccagcagtggacaggggagcaagtggcccattttatagaagtttagagcctttccagggagggcatagtcaggtaaccacagcaggtaaggctgaccagtgtgtgcctctctccatggcctagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgagcactgtcagcaaggcccggaagagccttcccagagctgctctttgtctccttccgtgtcattggttttcttctgcagagaagaaactgatcaattgtgggcatggcagagaacctactaccagggcagaccactgactgccagctaggaggagacagtgtcctgaggccagaactgccacccggaactgggctggcaccagggtcaataaacaaaagcctgtaaacgctgctgcacgcagagatggcataatgtgacgtcatggcatgaacaaagttggcacagcaaaggcaccactagctgccctggtcaggggcgccacccagctcctgggtgagggaaaactgggtccggatatcggggtccacgtgtcctgggtagtagtaatagcaactgaactagaagacgggctgcagggagctcgtcatggcacagatggaggccaggcctgggtgcagggaggggcctgctaatgtgggttctgaggctgtagttaggaagattgggatttatctgtacacaaaaaatggtttgtctgggttttgatgtttttcctttctaatccatctccactgaggagggcagtatattttccacacttcgttttctaggtgaaaaggagaacagcttgaagacagatgattatggccgagacctgtcttctgtgcagacgctcctcaccaaacaggtctgccctggccccttcactggttgaaatgtatgcagatagcatctgtgagatgactggtggcgtctttcactgaggcatttatcttctgttagcccctggggatcagcaggaaaaagatcctgtcctggtcctcagggagcttccagactaactggggaagcagacacagaaccaggcatctctgcagcagcctgctgggtgctgacgggactgggcactgcaggagcactcactcagttttcagcaggcgagggttgaaggggcaagttctcctaagcgaaatcatgaggggtgaatgaaaacggtcagggagagaggcagggcgagtgttctgggcagagctggcagggatccctggggcgggagagcggaaggctggggtcagggaggtgggaggaggctgccgcagtgatctgcggtctgaaggagagcaggaaagggggcatgtgtgactgagtctcagcagtgtccaggtggacagtttggcttgggcatctgggggacatgctggtgccatctgagcctaggaagagcaagttccagtcctgtggagtcaccacaaattggcttgtcactccttgttcaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtgaggatggggccacgtgaagcttagctggcccacagctcaaggaaggacgcccaccttctgtctgcccagctctgccactcccccttgaggaagctgtgagctcagtgcagagctttcaaacatgggtgtggctggcatcaattaaaaccagggcaaatgagagggccctgtgagatcgccattcagaagcacgcaggacagactagagacaagggcaaagggtaggaaggggaaaaaaggctggtgaagacttgaagggggagcaggagacaggagcagaggggagctaagctcccagcaggctgtgtgcgcctctgattcccaggaaccaccccgcaccccacctcctgcactgcgtcggcacgtccagccctggcgactccgccaactcagtctcttctgcttccaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggtacacctcccgctgccctcaggagctgctcggcctcccagagccctctctgggccctgctcagagcccacacttaactgagtcacgacaagacgagcaggatggaggagcatggtttcatcagaagtttcatttctttttgtgttcttgaggcagggtctctgtcacccaggcttcagtgcagtggtgctaccatggctccctgtagcctcaacctcccaggctcaggtgatcctcttgcctgagcctcttgaataactgggactacaagcacgtgccaccacgcctggctaattattttaatttttgtagacagggtgttgctatgttgcccaggctggtcttcaactcctggcctcaagcagtcctcctgcccaggcctcccaaagtgctgggattacaggtgtgagccactgtacccagccagaagtttccatttctgacagtccagcaactccctgcttgactgaccagtcgcttccctccaggtccgcctcttccttgaagcccctggggggtgggaacagagaaagaactaccaagtgctctgagccggcctcatgtctcccagcctcctcctctcatctttggggaggttccttgtggggaggccaccaccaccctgagcccatctgtgaaggaggggctggtgtcactgccacagcagcgcacagcatctgcccccctttggccctcaggagagggagctggagctgcagaaggaacagcggcggcaggaggagaacgacaagctgcgccaggagtttgcccagcacgccaacgccttccaccagtggatccaagagaccaggtgccagcccgctggggccggggagcagcagcatgtccctgctgtacttaagccctggggagcttccagccccaaggaggtggtggtgctttgtgtaaaaccagaggcagcctgggaataaagctgggctggcaacgcctggtcgggctctggagccgggagtgggggcataggtggagcagcctctcagtgctgcatgtcccagacatcaagttgttagagatcccggattgagtgggaccatgcagggcgcgtggtcagccccagccatgacttggtgacagacgatgcagggtctgtgcgttgggtactgatgttcttgcttttgttttcctttctttcttgtgtcttctctctgtccccccgattgctgctgttgtccggacaccaccttgtctcccggctgcttggatctgctctccacaggacatacctcctcgatgggttaatattgttttcttccttctctgggcttgtcatgtgggggtctcgtgcgcttgcccctcgtggcctggcttgtggaggatcccgggatgggccttcctgcccagggcgggctgcacttcccctcccacccttctcgtcacctgatgaggagtgtgtgccttgccccatagcccatggtccctggtccccgatagagccttcaagccagggggagccgtccttgcctcactgggcgattccaagggctcactttgggtagggaaggtgatgaagcacgaaggccagagctggagtccagaggccctaagaacccccgtgcctgtccagccaccgggctctgttgggctctcacctctgcttccccagcgagtccaacagtggtcagtgggcatgaagcagatggcagtgctgggggctcaggcagggtacagtaagtccacagctgagaagggctgggcactgacaccccctaagtagctgaggctgccactttactttcctggggtcagggagggtaacaagactgtccgccctaatagaaggcaaaaatgcacccgttatgtgatagacaggacgtgggaggagccccagggaggagcagggctgggctgtcccgcccagtcccggcagggacttctctgcttggcctggggcctctgcctggccgggtcacctttgtaatctgccaagcctgctgtgaaagccagggctgctgggactggagtggcttggcctgcactcctgaggctctgcacccaggcacatcaagcctgtataggcggccaggggagaaatagacccatccagccgggccacacattctgatggcagagcagctggggacgtagggatcgcagtttccggcctgtgcccgtaggacaccctggccacctgactcccctccctgccccatgcctgtgtctgctggtcttgctcttgtctccgtgaggtgccacgctcccctcaccttatggctcctcccaagccctgcccatcttgcccattcctagtgtgagctgcctggggtgaaccactgggcctgctgcctccaggtacccgccgggcaccaggttgcccttgcctgcgccctgccagcttgggctttgtgtgtgtctgttgcagtgtgctcttgcctcccctccctttggtgtattcatttggtttcttttctttgaatagcatagcatatcgtcgggtcattcgtgtctatcagtatgaagttggggatgatctgtctggaaggtttttctccttatttctcttcttacctcactgtggctttactgatgcactcttgacatccccaggcggctccaccctgactaacctgccgccctcggctgcttgggaaggaggggtctgtcctcccactgcaccggcacccagcctcctgcccccaggtcctggggggcattttccccggggggacatggcgtgactgtgagtctgacctgctggggtaggaggaagcctggtgccttgccttgctagagcactttgaacctggggagattgcagagctaaccctggctcgccgggttttaaaagggtaggttggggtgaatgtgggtacaggggagcctgggctaaaaccccaccaaggccacacgcaccgtgtgattcgtccctgcacgtaaccctaactcgtttgttgtctttgtttactggtagcctctgtgacctggcactgtgttctcttgggaaggaggctccccagagcccatctgctctcagaacttggtcctagagaggaggctccctccctggctgtgtctagaggatggaaccgggatctggggtttagtcacagccatctctctccttttggcacagttggtcgtgatctcccagcactccacttgtgtcctttgtctgcagggtcgtgctctcattccccctagaatggggctccctccctcaggaaccttgccgggacactccagggtttctgtggggaggctgtcaggttctcagcctcccctctgccctgaggtctcctgtctgtcaggtgtcagggtgtgccatcccccacatggctgcagagaggatgctcagacaggcctgcagccaccctgcacccatgggggaatttaaactccattcctgagtcatcctggccttgggagcaagacgagtgggctcagccctggcccacaccaaggcagcagcttcccatctctaaaacgggagaaatgctccctgccatccctcgatccctggggcccattaggtaaagatggccagttgcagttaggtttggtttccttaaaaggaatgtgaggttgccaggcattgctctctctgagagaaggttcattctgagctctcggccagctgggagcaggcccctttcctcactgtccttccacgtttaggtcctgtatggtggaagagtcggggaccctcgaatcccagcttgaagctaccaaagtaagtgcccgtggggctctggcccagcagagacccttcacccagccaccccccagggtaccccttcccttcctggcttaaagtcaggaaccagatgtgctattattgtacccttttcccttggcctaaagcagtctagggctcttcactatctctctctcttttctttctttcttcatggaatctctctctcgcccaggctggagtgcagtggtgcgatattggctcactgcaacctccacctcccaggtcaagcaattctcctgcctcagcctcccaaatagctgtactacagatgtgtgccaccacatttggctaatttttgtttatttttaattatcttttgagatggagtttcactcttgttgcccaggctggagtgcaatggacgtggtcttggctcactgcaacctccacctcctgggttcaagtgatcctcctgcctcaacctcccaagtagctgggattacaggcgcccaccaccacacctgggtaatttttgtatttttagtagagacagggtttcaccatgttggccaggcaggctggtctcgaactcctgacctcggctgatctgcccgcctcggcctcccaaagtgctgggattacaagcgtgagccaccacatctggcctagtttttatatttttagtagagacagtgttttgccttgttggccaggccggtctggaactcctgatctccagtgatctgtccacctcagcctcccaaagtgctgggattacaagcatgagccaccactcccggccgagggctcttcactttaaagaaagtctttggggctgggtgtggtgacttacacctgtaatcccagcactttgggaagccgaggcgggtggattgcttgaagtcaggagttcgagaccagcctggccaacatggggaaaccccatctctactaaaaatacaaaatattagctgggtgtggtggcaggcacctgtaatcccagctactcaggaggctgaggcaggagaatcacttgattctgggatgcggaggttgcagtgacccgagatcaggccattgcactccagcctgggtgacaagagcaaaactccctctgaaaaaaattacttgggcatggtggcctacacctgctcaaagtccagcatgggcaatatatagcaagaccttgtcttaaaaataaggctgggtgcagtggctcatgcctataatcccagaactttgggaggccaagacaggcagatcacttgagcctaggaattcaagaccagcctggtcaatgcagtgaaacatcgcctctactaaaaatacaaaaattaggcaggtgtggtgatgggcacctgttagttccagctactcaggagattgaggcaggagaatcacttgaacccgggaggttgcagtgagcgtgattgcgccactgcactctagcctaggcgacagtgagactccatctcaaaaaaatttataaaaatctttggccactgcttcctggagtcctcgccgtacttgtccttggcgtgcactgccctctggcaggtctaccagctgctttggaaccctcacattgaaagtctctccctctattgaggtggttgggatttcttcagcttcaccccatcccactattcctattctagaatgttcttgttttacgaggtctcaggccaggcctggagcaggaaccagagggcagtaagtggctcctgggctggtgactgagctgagggcccccgtctgagcatctgtgctccccacccctgcagcgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggtacccgggagggctgtgggccaggctcagcccagagcagggggaggaaaagacacagtcacctgctgtgtggagggtctgttccctaatttctgtttttcttccaggaacacaacaggtgtgactgaggaggccctcaaagaattcagcatgatgtttaagtgagttcagccttactcgccctggctgggtggggggtgttcggcagcagggctgcctgctgagccgccctcggctttgtgctgcagacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacaggtaaattaattaaggccaggtgctgtgagcctctgcccggggcacccacctgccctccctgctcaggctcttgcttcccccgctcctagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagccaaatttgtggcagagctgagtctggggtaacaggccctgcgctgggtattctccccatttacaaatcaaactcagtatggacagaagtcccggatctgcttgtagaagcagctccgagcccccagcatcctgagacctgggaggtcgggtttgaagtgggtgcagctggctcaggcaccaggtgccatctcttaccccacagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 24 - DNA, 56346 bp, Homo sapiens
  source 1..56346: mol_type = genomic DNA
gcttataacctgggatgggcacccctgccagtcctgctctgccgcctgccaccgctgcccgagcccggtaaggagccctcggcccctctcgctgcccactccctagccgagagcacccgcttcccgggcccagaggaggaggcgtagaagacgcccgccccggggcccgcggaggcagagggcggaccccgatcgccactcgccggggactgggaccgaggcaggagggaaggggctcccgatgctcaaacgcctggcaccggattccaggtttctggagcgtgggggacgcggcgggggcgcgagtccccgggggcgcgagtccccgggtccgaagagcggctcgggttatttgttccctgcgcagccgggtcctttctggactccttgtcggatccggcttcctctgtgtcgtgaagcccccacatggagacctggggagtccggagcgtgtgggggggctcccgattctctctccctctctcggactcgccgtctgtctccacctctatttctctgcgtaaaaccaggagtccagcccctctggggcttggacgtatcgctttccccgcagcctcagtttaccctggacagatgggcatggtggccctggctcccttccctgcagggggcggcagccacctggccctccccggtggggctggcggcctcgcggcggggtttcctgctggcctgggctgggctctgtgggaggggcagtgccaggaatattttctattcgggctgctgttgcctttggcccctgggcggctgcgccctccagggaggcagggtcattgtgaaagagaggaaactcctctcccaggcggccagggctgttcctgaggagggctggcctggcctcagtattcttctctgagaagtggagagtccactcccgagcagccgagtcaggctgcaggtctcagggcaggaacagacctgttctctccccaggggtagatcaagacctaggggacttgggctttgatcctcccgctcccagcaagcacaaacccagtgatggggagagctggtgaggccttggctcagcctccagattcccaagcttccttttcattttcttttctttctaaaaatttatcagagatgtggactcgtcatgttgcccaggctggcctcgagctcctgggctcaagcgaccctcctccctcgggcctcctaaactgctaggattacaggctcgagccacccaaagtgcctggcccccaagcttcagtctgttagagctggctggggctgagggctcaggaaacatttgcagatactgtgcggctgctaagggctctgtagactgttgggtgctgggcctgggtccaattgcacaataactgtgcctggggttaggttctgatgagagggagggagaagcagccacacggactgggaagcttggctaggagcaggaactggaggagtctccattccaaactccctctccctcccagaccccttaggcccaaggcctagggcggggaagtttgggggtgggggcgggaccctgtcctggcggggccatctgtgcaccatgctgagaagtaattctggttctgctctgtgggggtggatcaagtgaatgaatagtgactcctgcctgctgagcgcctggccggtgcgggggcagacacgtcgtgagagggaaggggaggccccactctcagcacagtctccattcctgagtgcttgggaagcaggcccagggccgcaggagccttggggtggagccaggcccaaaacagcctgctgcacaagcgcttccccctcccaacccgggcccatctcatctttggcctgctgggaggccagccaggtcaaccagatgcctcatctgagcactgactacacagtccctgaagtcagtggcttgcctgtgggcaccaggcacccatgtggaaagaggtaacttcgctggaattcagagtctaaggctctgatttctgatgtagctttgggcaaagttgatcttccagggcgtggctccctccccagacttggggtcgaccaggcacccataggcactttgatatgagtggaacgaatgaatgaatgtgcccttcgtccatcaccaaagacaaaccgagctcagctgagttagaatgtcagcgaggggttgcaggggaatcttccacggggcagtaggcctgagctatagcacacaggctctccagagaaatagtgggcaggttggccatgactcactggggggctggttttctggaaggtgtgtagagtgaaggggagatctgaggtctcctaggagccagggagtggaaggcctagtgcagggaagagcaagtggcctgcagtcaggctgggtttgaagccgctagcttgtgacctcggctggccgcttagcctctgcctcctcctttgtaaataggtggtaatggcagtctccaccttgagaggatgcacctgtgactgtgaacatagtagccgctcttgttgtcattccagctctgacgttttcaagtagcacgagttttccttagtgtcaagtgagcgcccaggctggcctgtttgctggaagctggacagatggctgtggctggggccacagagaatgccatcccaatgaaagccaggtggctctggtaccttgacgcgaggccaccttccctcctcccaggtgtctcttccggggaaggagggctggagggcagtgggcatttgccagggagctggagaaacctgccgtggccctttctgggggatgtggtgggggtggagctgggactaggggaggctgaattcagccaggatctgcctgccaggcgcagctcccaggaagaaagcccaatgtctgggagggtcagaacccagagggctgtcaggttgtacagatgaggaaattgaggcttagcaagccaggaacttggctgaggtcagccatagcagcggtgcacagagcttagtgggcacatacatgcttggtgcccagctctgggctccttcccccagcatctcacccaatccttacagtcgccctgtggggagcaggctgtttgcacccctattttgcagctgagcagttatgctagagagctgaagccactcaaacccatgtctggtggacttgacctctgtcctgtgcctggagtgagcgctcactggattgcagctgtggttccttctctccctgtcacttcctcccccgacatcaaaccctcagtttcatttagtttttgcctcgggctgcaaatgcagcttagggacctgcggaggctgagggaggggggtgccccacccgctgctgggagggcaggagcaacgctgctgtctgattgcatcattttcccaagcccatctgcccagctcatttctctgcatgcatacactggccccaacacccacacacgtgtgcatgcacacaggcacacatgtgcaagcccaaacacatcacacacatgcatgcacacacattgtgtactctcaggtacgcacccctgggtgcacacaggtgtgtgcgcgcgcacacacacacacacacacacactgtctcaggtacacacgccaggtccatgcattgcttcacactgcccagccccagaggctgaaggcctcagagcccacacctgcccagctacaacctggcaggcaggaggggctcactggtttcttttggtttatttaagacagagtttcactctgtcacccaggctggagtgtggtggcacgatcttggctcactgcaacctttacctcccaggttcaagcgattctcgtgcctcagcctcccaagtagctgggactacaggtgtgtgccgccacactcagctaatttttgtatttttagtagagacggggttttgccacgttggccaggctggtctggaactcctgacctcaagtgatccacccacctcggccgtccaaagtgctgggattacaggcatgaaccactgtgctcggccatgagagcatgtgtaggactccacagcttcagggcaccccagccctctttttgcggtgaggagctgacctccagagagtggaactagtagcattgttctaagtgcctgccacaggcatctgggagatggtccctgtttccatggagctcatagtgggggagagggcagttagaatacagcatgatggccggatgtagtggcccatgcctggaatcccagcactttgagaggctgaggcaggcagatcgcttaagtccaggagttcgagtccagcctgggcaatgtagtgaaaccccatctctacaaaaaatacaaaaattaggcaggtgtggtggcatgtgcctgtagtcccagctacttgggggtggtggcactgagctgggatgggaggatcccttgagcccaagaggtggaggctgtggtgagctgagattgcatcactgcactccagcctaggtgacagaatgagaccctgtctgaaaaaaaaaaaaaaaaaaaaaggatacagctctgatgggcaggaggcatggcgggtcactgaggcgatgcaggtgatccagctgtttctgtggagctgcccctccgtgtttctgtggagctgcctctcttggctccaggtgcctctgggaggaggcaggagcaggggtgactctcagagctgggtgaatcttgggccagcatcatcagatcacacttgcccaggacttcccttccttgagtctccagtggtggtcttgtacctatgagcagggggttaaggagccgagctgatctgagttggagtcctggctctgctgcctaccagtcaaacgagatgcagggcaagttcctcagcccaagcctcagttttcctgactctaaaatgaagagaaccccagatggaagggcttagcctaagacggacatgtctattcccttgattgtggtgttgatgtcacgggcgcatccgcacgccgaaacttgctaaattggacacaaaaaaatatgcgattatttttgtagttgatgaatgtgctgattgggtattctcgtgtgtgtgtgaggtgccaccctcaaactttgttatgatgttggcacattacccatctgatatttaaaaaatgcaatttatgatatgtcaagtagacctcaatagagctgttttaaaacatacaacagaatttcccgcaacccaaccacaccacccgcgccatcacacgcaaacaggggtaggcttccacatatttcctgaatgccttctggagcagggggcaggaggcaggaggcaggacaggtggctctggggctcctggacctcctctgctcagtgaggctgctcacaggagattgggcggctggaaagtaaggtttagggcctctgggatggcccaggctacctgcaggcagctgagtagctctgcttttgcagagtggttcactgcactgtgaaaacagattccagacgccgggaactcacgcctccaatcccaggtactgcccaccttaagtcctccctgcctgccttcctccctccttccctccatcctgcatggccaattgcctggctgcagttgccatggataccacctgctggctccagggttagggctggctgagtcaccagcaactcaggggcagggggttgaatgcccagtagggacgttgtgggcaccgaccagaaccatcttctctgccccagctgcatggtccatgaggtgtttccccttctaagtccaaagggcagcacaggcctgtgagccccggctgactggcaggtgggaccgtgcagcatgcacgggactgaattctcatgtgacggagctccaaagtccacctggctacacggccaggctctgcagcagaggacgggaggcctgggaaaggcacttcctctccccgagcttccaggcacacagagagtgctcaggatagcgatgcctgcatcactgcaatggtgatggccgggtgacccttctgggctccacttccccagtagtgtctaataaagaccctgggtgactctgaccttgtgacgttggtcagactccagtggaaacgttcccaggcagaacaaacatgccctgtacatttgggaaatgcgggatgctggggccaggtgtccacggaggctggaaccaggaggcctgggcccacatctgcccctgctgcttgttgatccgatgaccctgggcaggtgacctcgtctccctaaccctggtttcctgttcagcaaattggacacagtgaagacgcccaagcccagggccacaggaggcatgtgggggaggggggtgcagggcgagcccaagggcagcccaggattcagggagagccctcggggaagaagcatggctgcaaagatcaggagacaggaggccttggcgccttcgggaggcttcattgtgacggagggtggggcaggatgggagaccgcaggcacttcccggctgcagagggcctggctgcagagagccctcgtgcccatctgtccccccgggaagggccgctggttgcagaggtcttaggcctctgcctgtctatcgccttccctccctgggcctcagtttctctacctccacactgggggaagttggtctctgagcccctccaaactgggcattggcagagttgaattcagaggcgctcacatttggagacacgatgtctaaaattccagccagtgaaggttccatggggttgcaggtaggagagggactggggctgggcccctgccccacagcatccttctccacctgcaggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgaggtcagggttcccgggggtggcaggcactgaaggtgaacatcctgttcccgaccttcagtggcagcttgcccaggagacaaggctgtccaaggccaaggtcggggctgggctgtctgcaggggctggcggggggcactggctgtctcagggtcactcaggttgttcctcgactcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcagcctgtctgctcaccgtcactcattcaagcctggcctcttctctcgaagcctgtcttgaactggaactaggaaaatagcttctcgttgtactgcctcactttctccatctgcaaattggccatccttgagatgccttccagagccaggtgatggaggcgcggggagggcacagaagtgaacttggcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactgaactcaaaccaacttacgcaaaaaggaaagggaaaagacaattcttggctcacacaactgagaactccaggggtaggatggcttcaggcagggctggatccaggtgcttctaagatctatctccaactctacttggcttcattcttggcctctccacagggcaggcaaggctcatggtcaccctcatagcccacctttcccaaaaaggagggcttacccccagtagggcccatggggacccaccacgcattagtccctatggctgcatcatggggtgcgaggcttgggccatgagcctactccttcagtgggcgggatttcttcctctccatccctgtggaatggggtccacccaggaaagaaggttctgtttccagaggaagtgagcctgggtctctggacagacaaaacttagctcttgccaaaagtggcttgtttgccggcatattggcatgtctaactgcgcccaatgcccttgtcattcaggttggggaaagtgaggcccaggggaagaaatactttgctcacagtcacctggtgggtgagagcacagctttgaggggctgcaaagagcccagggtgtatccatctcactgtaggtagcacagcggggcaatcagagctggagctgggcgtatagacccctgggctaccacctgggggatttaaaagctgaatgtgattcagataagcacctgcagctgggctttggcaagattccagggtctggtgagccgaatgaagggagtgagggctgaggccaggatctgggcagcaggccagagtccaggcagcaggaaacatggcagtgtctagacaggggctgtcagaccccgaggtcagggcactggccacagggacggagctggaagttcctgagcacgggcttctctgcctcccgcctctcagctgcctcaggatggccaaggcatggcctttgactagggaggagagctggaggctaggaaggccctgacaagctaatctttgcactggctgagaaagagttttctggaaaagacagatgagtttcaggagaaccctagaccttccagcaatgacagcagatggttgtctcccagcagcctgtgtggccagggccaggctcagccaatgctccaacccatggaagccaccagccatcaccacgctacaatccagctcccaatctcacctcctggaagaatctcacctctccaggccttgggctttgtcctttttccttcttactgtgacttggccatggaatggaagctgtctctgtagcagggggtgggaggctgctgcatgcggatggtgtgaactcagggctccccccaggggctgacggagcctctccgcttctgcttctcaggccaacattggccagaaggaagacttcgaggaagccaggaagaaggcactgaagcttggggccaaaaaggtaccaggcgggaggcagggatttgggctgggagtggggcggtgatgtggagggcagtggtggatgctcctgccccagggatcccatcccttccagtgtgtcttcttgcttctaagagtatgagatcatcctgctctcaggtgtgtgaaccctcttgtttttctgcctcccccacgccctcttccacccacccaccttcccatccaggtggagtgtctcttccccacccacataccttcccttctcttttatctctctgtccatctatgcacccactcaccctcttttatctctgtttatctactcgtccacatatccatccatcattcatccctccattagctatccatcgatccatccatccatccattcagccatccatccatccatcacccacccatccattcacccatcatccatccatccatccatccatcacccacccatccattcacccatcatccatccatccatccattcatccattcatccatcatccatccacccatccatccatcacccatccactcatccacccatccattatccatccatccattcatccatccatccatcatccatctatccatctatccatccatcctccgtccattcatccatcatccatccatccattcacccatcatccatccatccatcatccatccattcatccatcatccatccatccatccattcacccatcatccattcatccagccatcatccgtctatccatccatcatccatttattcatccatcatccatccatccatccatcattcttcatccttccatgcatcatccattcatccatccatcatctacccatgcatccatccatcatccatccgtctattcatccatccattcatccatccatcatctatccatccatcccattatccattcacccatccatcccttcattatccatccatccatccacatatccatctgtcattaatccctccactgtctatccatccattcatccagacagccagccattcatctatccatcccccatccatccatccatccttcatccattcaccgtttttctatccatccattcatccatccatccatctgtcatccatcatccatccttctgtccatcatccccctacctgtccttccctcttttatctctctgtctacccattcttccattcattcaacagaatcagagaactccaattgagtctggtgccttgattgtgaatctaggcatgtggcaggcagacccctgtcccatacagggcatttatgatgaacagtgtcatcaggacccctgctcacatgtgctcactccccatggagaagcccttgccacttgtgccccttcatttgggagagtgagcaggggacatagcagggatgatgtgcaaggccaccagcccacctgcagggtcagagctgatcccctctgtggggtgcttctgcagggttgccagggtaattagcatgttaaaatgaacacgggagggagtggatgccccagtcccaagtcacctactggccacaggcctggaactagaatgtccctccttggttctgtgcctcccgagtgctggagagcagaggggttgtctgagcagtagtccaggaaggggagaaagagccctgagtgttgaagattcgagtgcgctttcagcagcgcaggagcaggctttgtgcacggcttcagcttttgtcctttattctagatgagcagttctcaaaacttgtggtcttgggaatcctctacactctaatttacgtggcgtttttaatgtttattttcttgcatataacattaggatgggccaggcacagtggctcacgcctgtaatcccagcactttggcaggctgaggcaggcagatcacctgaggtcaggagttcaagaccagcctggccaacatggtgaaaccctgtctctactaaaaatacaaaaattagctgggcgcgatggtgggtgcctgtaatcccagatgctcgggaggctgaggcaggagagtcgcttgaacccaggaggcggaggttgcagtaagctgaaatcacaccattgcactccatcctgggcaacaacagcaaaactctgtaaaaaaaaccaaccaaccaaccaaacaaacacaaaaacacatttatcctaatgttttttatatatccttagtcccaattgctttcttttctatgcctttttatttcattttttaaaaggatttttttcaaaataattatagacacaggaagttgcaaaagcagtaccaagaatttctcgactcttaaaaattattgaaggccttggctgggtgcggtggctcacgcttgtaatcctagcactttgggaggctgaagtgggcagatctcttgaggtcaggagtttgagaccagcctggccaaccagcctagtttctttagtagagaaaccccacatgcctgtagtcccagccactcgggaggctgaggcaggagaatcacttgaacccggaaggcagaggttacagtgagccaagattgcacctctgcactccagtctggatgacagagagtccatctcaaaaaaataaaaattactgaaggccttagagagcttttgtggattacatctgttgatatttatcacattagaaataaaagctgaaatgttttaaatgaacagttcatgttaacataagtaacattacacttatgaaaaataactattttctcaaacaaaaaattttagttaagaatcttattggcttccatttttgcaaatctctgtaatgtctggcttgacagaaaacagatggactcttgtagcggttttctgcattcacttgttttttcgtttgtttgtttgtttttcttttttagcctcccagggcttcctcgctatgtgatgccttgttttattgaagtttatgaagaaaactgggcaacacagtgagatcccatctctacaaaaaataaaaaacttagccgggcgtggtagcacatgcccgtagtcccagctactcaagaggctgaggtgggaggattgcttgaacccaggaggttgaggctgcagtgagctaggatcacaccactgcactccagtctggatgacagagaaagaccctgtctcaaaaaaacaaaaaaaaagttttcactcagtgtctccctgaaaagtcattgggaacccctgggggtctacatttcaagaaccattcctctggatcggggtttctcagtcttggccttgttcccgtgtggctggccgtcctgtgcacgggaggattttagcagtatccccatagcctttacccactagatgccagaattccaccccccacctggtagttgtggcaaccaaaaatatctccagatacttccaaatgcctcccctactcccacccccaacagggacaaaaccgtctctggttgggaactactgctgtgagatcttaggtgacaactaagtttcatcttgttggggctgatttagaagccacatccagtttcacagaacggtgcatcaggattgattagcaggctggccgcggtggcttgtgcctgtaatcccagcactttgggaggccgaggcagctggatcacctgaggtcaggggttcaagaccaacctggccaacatggtgaaaccccgtctctaccaaaaatacaaaaattagcaagccatggtggcatgcgcctgtaatcccagctactcaagaggctgaggcaggggagttgcttgaacctgggagacggaggttgcagtgagttgagactgagccactgcactccaacctgggcaacagagcaagacttcgactcaaaaaaaaaaaaaaaaagagagctattgattagcaatgtctgccatgagtgcaggagggagagtaacagtgcagtgtgctgggattgatgaatgatgtctactacagatgcagaagaagaagcaccaggtacagcgggggtggccccgtataggtctcagctagctgaggcccctggggctctgtatgccagatggcccctgtccttgcctacttcttccttctgggctcctcttcccgtaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcacccctcgagcggtttcctggtgtgcctccggggcagacttggtgcaaggcagctacatggctttgtttagaccccaatgagaggggtaacagctcgcccctgcgctctgtgcactgtggcacctgaacgcccattctgagtcctcacctccaccttctgctgtgggagcgatgtcaccccatttggcagacttgctgctgaggcctggggacattgtccaaggtcgcattggccaaggtcactgcgtgagtcccccaggggacacgcaggaaagtgttgaaaaccctgagttggcagagtagggttcaaaggcagctctgctgctggcttgccgtgtgtcctcagccagggcccttctccccttcctgaacctcagtttcttcatttgcaagatggggctcatgccatgtcttagtttcccagggcgagggtaacaaaatgtctcaaactggtggcttagaacacagaactgttctgcctcatggttctggaggcctgaggtccatagtgagggcatgggcagggccacgcagcctctgaaggtgccaggaagcctccggctcaggcctctctccagcttccagtggcctctggtgtcccttagcgtgtggctgcgtcactcctgtccttccgtcctccatcttcccaagctgtcttcttcctgtatctctgcattgtcttccctctgcttgtctgtttaccttccccttgctacaggaacccgtcttggattagggcccttcaatgacctcatcttaacttggttactttttgtgtgtgtgtgtgggggagagggacaaagtctcactctgacgcccaggctggagtgcagtggctcgatcttggctcactgcaacctctgcctcccagattgaagcaattctcctgcctcagcctcctgagtagctgggattacaggtgtgtaccccaccacacccggctaattttttgtatttttagtagagacggggtttcgccatgttgggcaggctggtcttgaactcctgacctcaaatgatccaccagccttggcctcccaaagcactgggattacaggcgtgggccaccatgcccagccttaacttggttatttctgttaagaccacatgaggccacattcggagggactggggttaggacttgaacccattattttgtggaaacacaaatcaacccatcccgtaccccttccctccgggccgtgtgtcccagtgcagactgcggggtccccgtggggtgcaagacaggaagccccctgcctgctgctcttcggaaggcagtccttgagaaaccagattcctgacaatgttggcaactgtcagccgatgtttttataaagacccaagtcatgagctctcagtcagcggacagcatgccaagagcctggtacaggaattgactgtttaccaaccccacagtcagaaggctcggaaactccccagtgacggggagctcactacctcgcctgcccgggctggtcagggtgctgatggtgggaagtcctggctcactgtgggaggtcctggctcactgtggtgcagggacacacacagctaagatgatgatggaggagacgcggttgatttgagggtggcctgggagacagccacccaccaggatggcacctgtcatgtctttgaaagtccaagtgttcatttcttcaccggagcactggttcagcaagcttgcactgggtatctgctgggagttgggtgcttgctggcattggcacagtgctaacttcttgggctcattgcgtaccttcagagagcccatttcctggcaagagaagagaaaatggatgtgtgatgaggaatgggagtggggccaggggtctgtgccagggaactgcgggagcagcaggcaggggctgaggatgagtctagaggagtgaataatggcatggaagagtgtgagaggcagagggaacagcctgtggaaaggcttagagccaagaggccctgaaggacagtctgtctggggctgtggagcaggagctattgctgtgggggaggcaatagggccaggactgggctgaggccatgctgggaggtttggcttcatcctgagggcaactgattagtgggtggaaggaggtctcaggttggatggaggtggccagtgactaccccagcgagatgctggggaagagacaggggagagcttctcacagactgcggccttggtttttactgtcactccagctgtggatgatgggatggtaggaaaccaggcaaggaggtttgggcgggcctgagctgttgggcaggaccgtgtgtatgctgccatctgtgcaaaggtggtggcagaggaggagaacccagaggatcaggactgggcgacacagcgagactctgtcccaaacaaaaaaaaaagctcccgacccatctgccttaatggaaagagctggatcgtgagcttcctatcccagaaggcatacaagccgagggcaggggatcagaattctgggaggggtcctgccctcaggtctttccaacggtaccattaaggttcagtagggcggcattcaggtctggtggagtgcatgggtgggtgggtgagtatgggtgggtcggctctggctcaggcagttcccgggtccatgcggagacccccaccccggaccagcccacatttagcctgcaacagcctcccgcagccgtgtgcgcccctcctccatgtggccaccagagggcgccagaggcttgggtttgaggccttgggggccgacaaaggcgggaggaggtggcggcaccaccggggtcctctgttccccatcctggacctgcagggcgtggttctgaggagaacgccccccaagctagtgctatggccgctcgggacttgggggcgtccctgcattcacactcagaagacccaacagggacggactccggggatgccggggagtaggtgctacctggcacagccacctctttcctggggttgacaggcaaggcgtacttctgcgcctcagtgtccctttatgacagtacccaggaaacccccaacagcctctggagacaatttccgagaactgggggtatgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacaacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttttggaagaggggcctggaaatatgattctgagactctagccggggagcgagagttttgtaaatggcaccatctgtatgggtgccccagggcagatgggagaccccaggccccccagtcccagtgggaccgtgtttacatgcatgtttacacacgtgtgcacaaatatcagcatgcggacactcgtgtgtgagacactacatcctccttctccccggaaagctgccaggagctgccctggtgctggggtcttggggttcagagggggaaggattagactggcctccttggctcttgcctgagacgagggcagagtttgaaccaaggaagcgtttgtttggcctcttcgagggtctctggctcctgaacagatgggtgtccgcatggcagcatctggatgggcagacagcagcccagccgtgcctggctggtgaggcacaagccgtctttgtgttggggaaacatgaagctgtgggggaaaatagctgggccatgcaacgtcggaccatgccttaccatctaaaatgaggctgtcttttagttgctccaggaacggggccggctgggggtcagcaggcaaatgtggccgcccccacctcagtgtcctcatccgtaagatgggactaatagaacctgcctcctggggctgctcaaaggattcagtgagttaattatgcatggagctcagctgggaagcctgagtgtgaaccgttaggatgagcgagtttgctgtgtggccctgggcaagtggctgcacctctctgagcttcactttcctcacccataaaatatggctaaaaatccccctggccctgggggcctctctgagtgacagcacatagtaggtgctcactaaaggggctgcatggagggtgagtgaggccagcccaaggcctgtgccgcacacacagctcccagctctgcagagaggctgaaccctggattctgtgccacctgacgagagtctggaaaatagcatgtaattcccaccgctgcctggctgcgcccatgcagttttcacagtaggcaaaaggtccctctgtcatttccacagcgcttaagtctccctctgggctgccgagcccacggggaagcaggagacgtgcgcggccattttctctctggggacagagctgggctggcggatgcctgcgctgaccccggcctcctcctcctcggcatcagtgtggacggtggtcccggctatgtcgggggtaacgttcacagctcagtggggtgttgaggtgtctccatttgcccacagaggatgcaggcgaggcaacctgcccgagggggtggctgtggtgctggggacctgggcttgggtcccgggcctgccctggctgtgtgtccttggactggttcctttcccttcctgggcctcagtttccctctctgtgcagagaagagctgaggagcaaaaggccctcagtggtcacctagttccacctcctccctgacaccagccattgaagagatgcggaaactgaggctcagagaggtgacagggttcccaaatgtatgggtatgggggagtccaagcaccctggtgccccagccctgaagtgagcttgatttggggcagggcagggtcagcaatgtgggggccttgaggaagagactatagtgcgagctctggggctgcaggagcagggcctggccccccaggtcttgccagtggctgggcctccagctccagggggtcagatgtgtcctgcacccacccacgtgacatgtgtgccctctcctatactctgccatgtccccagacgtgcacatctccctcctgccacatgcccacacatacacgacctacactgcatgacctcacatgtgtacacgctctgcccagctctgtctccgccacgggctgtccttgtcctcacgtcctcccccagactccagaacccccatcctgtggctcctgacagccctctgttctgcattgcaggggaacgatcaggtccggtttgagctcagctgctactcactggccccccagataaaggtaggatgtggctcctccccttagcagggagcactagcatctgcagcacctgatggggaggagggcacagggttctgggagattccacaggacaggcacagaatctcctccgtggcaggggtgcccatcgggtggacagcctgctggggaggctcccttcgctggggccagctccaggggacacactttcttccccgccattcattcttcccggagaggctgtccaggtgctggggcacgggatagaaagtccctgccactcttcagccacatccctggcatcccaggtgtgggcaggcatggctctggcaccccaggtgcgggcagggatggctctggcaccccaggtgcgggtggggatggctctgaaacgtggttgctggtgtctgggatgctcagagccctccgagccccagtcagagcccccagctatgcctggctcctccccaggccacctgtgcctggtccccagcatctcttgagcctttcctggggtgggaatcaccaggatctcagggcctcaaccgccctggcccgtggcatgtcacccaggcaggagggcacctgtgggtattgcccagactgctactaccatccccacccctccagcttgaccttggacctggcctgcgtccatgcatgaatgatggacacgttccttccttcactcgctagctcatccttcatccagtgtctactgagcacccactcagctccaggggtgccgagtgcagggcccagggcagggccgagcagtgggagtttgaggcacactgccgctgcaagctgcccaatttttctagtagccatatatataatatataaatatttttatataatatgtattacatataaatacatatgttttatatatatatatatatatatattttttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttgggctcccaaagtgctgggattacaggcgtgagccactgcacccggctgtagtagccatattaaaaaatagaaaaatgaaacaagtgacatgattttaataacatgttttaccgaaaccgatatatccaaaatattatcattcctcctataatcaatgtaaaaaaataattattaatgtttacattcttttttcttctgtgttgagtctgcaagacccagaatgtgctgcatgcaggcatgtctcgctagctggctggatttcaggtgctctgaatggccacccgtggcttgtggccacctgtgggcagcacaggccgggactgagctcttttgaggccgctttgggctcaagctctggaagagttgccccctcctaagcccccaaggggctcacaggagtttccattttgttctttctaagaggaatctctttccccgtccctttaaccagctggtagctcttgggatgcgtggcctggaggtgagccgtaatgagctctaatgatctgttttgaccccagacaccaggcagctcagtggctgggacagtagctgcttgttgacttgctgccagcgaggccgcaggacggggccctccctcggttcccacagcagcttgtggggccagggtgtccagtttcgaggtctttgtctgcagaggccaagcccaggcactgagatgggattggggcaggggccaagctgctccaggagctgggagtagggctgtggtcttcccatggctgctctgaggggctgaggaggtggcgggccccttccattgccctgcaccactgtcagctccacggcccagcagccaaatgacatctccacccccacacacacatgcccccgagtcctgctcagaggcaggggcctggtgagctccagggctgagtcgggggctctttttaccagctcaggccgaggggctcaaggggaatgagcttggtccctcagccaggctcagagtcttcccccacttctttcccttccacacccagagaagtgggtggggggcagcctatgcctctctgggcccccgaccacacgtggggccaggccagcagcggcagctctgtggactctccctgggtcacggcagtggccctgtggctgaaggtgctggcaaggaccatgaaccccgtctagttcaaactctcaggtctcatctggggagactgaggcccagggaacagggacccccttctcaccccaacacaccaccattctgccatggagtgcaggctccgtccagccagccccggtgagggagtctgtgtccttcccctccttcatggggctccctctcaccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaaggtatggccgagtctccccaccacccccaacctttccctatagcccccttcccgggcacgtccctgctgggggctgtctgagccagtggcctaggccgggactgaccccatgtgatgggggattgaacttccaccccagctgcctacacacgtggcctctgtcccctgggctgaccccacagaggtgtggtcatctgccagcccgttgccagggcggagccgctctgaggccatttcccagtcccccgagccagaggacacagggctcactctctctcctgctccctgggaggcggagaccagagccctgcttgccacctccgcagtgtgtgtgtcttggtgtgtgtcacttggggggatggctgggggatgtgatggccggccggggggatgtgatcgggagctgttctcccaattccctggatactaattgcccctagcgctttccccgggaacaggtaggcgctccaagggacagtcgcagacaaagccttttatggcaccagccctttttgaagtacaagttgcaataaaacatattagaagttttgcatcaagatccttagccgctccccagggcacctttctttttagcgactcgatggcagcccttgacaaacagcctcaatcaatcaggccggggaaaagcaactcagcgcacacaccagaaaattgctcaggtttttaaatagcagtcgccaaggctggctgtgagctctcgctgcagccaaggtgccgcgtggtaggggaggcggcagggacgcagccctgcccccgccgccagcaacccattaagacctggagtgctgggagggaagaccttctccaccatctgttgttttattattaagaggggagtttacaagagcaagcccatatgttgccaaacaaattgtcaaatagcagagctattaagggagccgggttggtgaggtttctcccctggtctccttgatgatatagaatatgaagcgtgtttcatctttaagaataatgaattggagcccccacccagctctaccctcacgcctcgagtcctggatagagaggggcagggccgacccatacgttgccctttctttccgttaagtccccagacaaaagcagcttctggtttttctagcatagatgagtctcaggagcacactgctgtccttccttctcaggttttgaggagaaggtgctgagctcagcttccatcccaaataaccttttgagccggaaaagtttgccagggaaagatgagcatggccccctcggccacctaccctctcctggagatgggtttcatcagaaatgactgtggggaatctgagcacgttctagaaggaggcagaggcagtgtttctgcacccaggaaatgtcagaatgactgagcagtgatgaggcctcctccaaaattctgagccaggcaggatctgagatggatgacacaaaaatcaatggggctttcaaaaatctctgctttcaagacgcttcggtagccaaggcaaaaaggcgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacgtgccctagtacatctggctaatttttgtttttcatatatttatttatttatttttttacagacagggtctcaccatgttgcccaggctggtcttgaactcctgaactcaagtaatccaccctccttggcctccccaaagtattgggattgcaggtgtgagccaccacacccagctttggctaatttttaaatttttttttgtagagacagggtcttgctatactgcccagcctggctataattattatttttaaagccagactacaaggtgggagctagaaacaggatggtctcacgttgtctacatgttggagatcgttttgttttttctcctcaattacaatgagagtgtgaggggaggcacctcgggaccgagagaggctgggaaacacaaatctctttggtcttgggagggtcattgtcattggcccctgttgctttcctccccgccctttagcctctccttgctcctggacggaggtccgctgagaagggaggcaaaggttctttcacgccaccgcccaaaaacagaggctccacggagcctggccggctgctcttcttagcacccagctgctgagctgagtgaggagcgaggacggagcccagcaggccaccaggacatctctgctggagagtccagtcttgccttgcacagggtccgggtacccatgcctggccaagggcacagggcgagtgtgtgggctgaagagtcttcaaattctagagtagatcgtgggctgtgttttgtttttttaaatttcagttttcacgtgtaatatggtaactgttgatgagataatctacacaaactaaggctcttaggggcccttagtgattttttctttctcttcttttttttttcttttttgagatagagtctcactctgtcacccaagctggggtgcaatggcactatctcagctcactgcagcctctgcctcccaagttcaagtgatgctcctacctcagtctcccaagtagctgggactacaggcgcctgccaccatgccaggctaatttttgttatctttagtagagataaggttttaccatgttggccagactggtcttgaactcctgacctcaagtgagccactgcacctggccttgtaggctgttttaaaatgagtctcctggctttctagaaaaccccgaaaccagagcatttagcctcattttaatgttaaggtggtgatggggaaacagctgctccctgcaggaggcctctagaatctcaccatcttgggaatgagcctgagtggggtcgatcccatcaggagagagatgggagggtgacccggtgggggctgcctgtggttcccacagggatccagtggggctgaggggctgaaggggctcagaggcagagcatccagtctcgctggctctgaggggctgggtggggccccttcagtgcaccctgtgccctataagcttggggccaggagagcagtgccaggtgtccgagtgcaggaggaggctggagtgcacgagctggattccagtcgggcgtcatcaagggtggtgcgggtccccagggcgacaagcctcatcttcttcctcctcttaaggctgagtcaggtgggccttccatgcgtgacctgcagccctcttagcctgggcctcctgggcagaggtgggtgtcctcctgtaacaacagactgggccatttaggaagcgaaacagagccagagccgagtgccttggagacgggatctgctgggtgttccccttctagggtctgcagagtgatgtgtgtggctgttgcgccaggcccagggaggggtgcccccagaaggtgtgggccatgagctaaaagctctccctgcatcctacctgtcctggggtccacaggaagcactgcctgggctctggtgccaggtgccccggtccacagtgcgagcgggttcacacaagccccagctcgtagggtggtggcggggctggttggctggtgccgggagacctggctgggcatggcacctgcgtgcttgctcagtgcttcaggggtccttgagatgtagactcaaagtcttctggaaggaacctccaaggtcagcattgcagacacacggtcctgcagtttctctggggcatgtccagcaatagggtccccccagggaggtgaccgtgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacacgggattcccatcccggtcactcccaagaacccgtggagcatggatgagaacctcatgcacatcaggtaaatcccaccctccacccatccttggtcctcccgggctcattccaaaggacggccacgcgctgccccaggacgtcctggtgacccccacaccagtggtccctgccctcggggagctgagaggcctcaggcaggacagaggtcgaagcgcccggctcatgcactgccctcattgcagttctgctgagtgttgttggggagatagatcatggggacccggcctcatcaggagtatcaaggagggcttcttagaggaggtggcattcaaggatggagaagaggcccagatgtggcacaggggaagagtgtttaaggcagaggcagaggcccccccaaccacgtgcagagccccggggcagtccccagaagacaggtaaaggccccagctctttcttacaacctgcagctccacgggtgactatggtgggcccagaatgtttcaggcaggttggcagcagatgctctggcagagagtaaaaggcagaccaggctcatgggcacaatggggtgtgtgtgttgggggatggggacatgccatgtccctccccagctgaccctgtctttcctttcccctccgcagctacgaggctggaatcctggagaaccccaaggtaatcccccaaaccccatctcctcccagctggccacctttggtggtagcagctccatgccgatgctgtctgatgtatttatagcctaatttgaaatttcacgggggccagccgtggggctggggccgagccctgcctgtgttccccgacccccgcactggcccccctctgcccaccgtctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggtggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctggtttggaggcgggaaaagtgtgctttttgaggggatgcagctgggcctgggggaatcaagaagaccagctggaggggagggtgcccggggaggtttggtgaaattggggagcgccagagccccgcccaggatcccccagggcccgggcgtctgtcactctcacgcccgcgtgccgccccctggtcggtgttggctgtaatatcacatggcagccaccatgtctggggagcgggccgggggtggcattgtcctggctcagttcctaggacactggctgggagcatcctcactttatggttgaggaaactgaggcccgggcaccggctgctcagggcgagggaacgggccctggggctggtgccctccagctctgtggctcccctactgcccacggcccctccctgtccaaacctgtcactcaggagagctgccacccttgccccctgggggctgatggcccctgtgtgtggctgctgcctgctggtcacaggtttttctagttcatgctctgctgaccccacaacactcaggccagccaccctaattagccagtcagtcagctccaagggaggcagggaggccgagcctgcagggtggcttccaggcagggcatcctctcaggcccgtgggccccaagcatgctgggcaaccactcccggccattctccaagcagcctatggcctctgcaagcagcctatgggggcagagaggaggcccccccagaatagaggacctcaggattgagaaagcagagcaaggccagagggaaatcaccccctcggaccgtgcaggagggcatccggggcctggagcaggttactgagctacggtgggcaggtcctgcgccctcccaggcctcctgtctcatgagggcattgggtggagaagtcagtactaaagagaatctggattaaggatcctgctacctcacccacacttgggtcccagagacaggaaacccgagtctaaatcccaacttttcttcttattgctgtgcaacctcgagcaagttacccaacctctctgagcctccagtactccttgcccaaagtgggaaaacacagcacctccctcctagggcatctaaagcgcttggcctgtctcagggcaagccctcagtcatgcagctgggggtcccatgctacctcttcatgggaggaagggtccaaggtcctctcagggacccctctcaagaaaggctgggctgggctaagctgggtgtgagtcaggggaaacatcgttcctgctgagaggcccggggcacccagagtcccacccaggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggatgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctctacatcatggtttagttcatgggccatttgcttccaatttctccttctcggggcctgtttcatgctttctttcgccctctccccctagcccccaccccgactctctctctctctttttcttcactctcttccctcccccgcacccccccccccccacagatgacattggaagtgagccctcccgctgggagggataaatagatggcattgatacttggcaacaaactatttgtcattagaactgggcttttaggaaggagagtaaaaagaaggcaggcgctcgagccaccgcggaatgcaaagcaaatgtcattttatttctatttagttattttatttaatcggcgctgtcaggtgcctgcccgacagctgcctctgacttccgctgcggtctgcagaaactcgtcctccagtcttcccatcccctctccttccaaatgcacacactgtcagcctccacttcggtctggggctccctcaggaagtgtggcgggagagaaagtgacaagcaacgcattgaaaacagttgacagtcgggcccagcgcaggtggaggtgggagagagctgggcttgggtgggagtggggccctcgtaccggcaccctggttggaggcttgggggagtcccaggcagctggagatggggctgtggagttgtgtggtcaccccaagatccagtccagttcactttacctttttgctgaggatgagccttgggacccgtctgtgcccagggaatgctgcagttggcagggtgggccagccctgatgcctacctgtggctgtgatgctggctggctctggccacaggcctcaccctgtttctcagcccaggttactacagcagctgggaaccagcataaggtggcggaaagagtccctgtgtttagcttccaaagcatggtttggagaagccacctctcagccttggctttccctgtggtccatagaggcatcaggctgggggtccctcagggcccctcctacctcctggagtctgtcttcagggaaggttctgggttcttgttcctgccccacaaatgggcactgatgcagggatacagctggccctgagtcacatcgtaccttggaggtgggggtggaggatccaccacagtccctgtcttagaaggatcaattgtcctggtttgcccaggactaagaggtttcttgggacaaaggactttcagtgctaaaaccaggagaaatcagggcacttggtcactctaacacagagccacaggcaaatgaccacaggtgagcttccaaggcacttatgtagccccatcccatgcagaatgaggaggaggctgggccgagcatgtacccccagagtgaatttcagctgccctttccacctgcagagcatgttcccgtttgtaccaggccttccctgacattttcctgtgtgttttcatgtccaattaaaaaatatatatatactacttaaattgtaagatggccaagggcaggtatcattttccccattttacagatgaggaaactgaggctggaggaagtgaagcttccccaaggccccccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcaatacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctcccaaagtgctaggattacaggtgtgagccactgtgcccagccgtctgcaaggtttttaaagcaaagatgagacagcagttcctggatgtcagcaggtgaacaaggaccccaggcacaggatgcccacaggagggacctgagcagtcaggcccaagaggccccagtccccacagtggcaaatgtccaagccacggcctgggggagctggggcctccgaaggtgggagggaatttcgagagtttcaggcaacacgcagcccctccaccactgcatcagacgagaggcccattttccaacacgcccaagaaaaaatatacataaaggttgatgtgttttcaaatgggtttttgctttgctcttctcttttctccctgtgagtattaaccttggggaccctggggacggctcggcttgccagagcacctgctggggtcacaggcagtcattagctttgcggtcagtgcagaataaaccccaatcccgagccggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcagaaccaagcgcctccaggtctctacacgaagacccaggacccagccaaagcccccaacacccctgacattctcgagatcgagttcaaaaaaggtatgtgcccacctgttgggactcgaagggggttgacttttggggccctggctcctttcccctccctgcctgggaacctaggccctctttacccccgccctgcattcctggaagctagagttcaggcaggggcttcaaggtaacgcacagcccacctccctggacagtacaacccatggaccatggatgcctctaggcttgggaggaacatgccctcggctacccatcactcgggttcatgggcaccaggtctggaatgagagcgctctagtccctgaacagccactcaactttcctgggcctcagtttcctcagctgtatctgaggatgaaagagtgcctgctgttttcctggggtagaatgaggcctgcaagggagcgtccagccctgggccctgaccccggaaggtgctcagtaaacggtgagtgttggcgagctggcctcatggacccctgggaccccacatggaaagccttcgccagtcttcattgagccgctctgggcctcaccctgctgaccccacgttcaaagctgcggccactcttgctcccctcggcagtggaggctgtcctgatcgctccctccttctcactgctgtcaacaagaagcgtttgctgacctggcctgagtgcctgggtgcctgagcttgggagagggcatctcttggcctggaggaaggatggagaagcgaggcatgcccgcctgggctcagagggagggctcagagggcgggctcagagggcctgaaggggtaccttttcaggaggctggagtgatcagggaggcttcctggaggaggtggtgctgggcacaggggcacccaaggaccaggcggggggctggcccattcgtccacaaagtggctgcccacactggagctgggatgagagggagagaggctcgtggagaggcctggcccggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggtgtcggaggctaagtgctttaataatctgcctcttctgggcctttcccaagagcttggccaagccagcgactgtcttccttgctccccttcatctgtcccaacctactggggggccaaagaggaccccaaaggcagccgggcccccaggcctgtttgcaggcacagagcctccctttaggatcatctctgagaagatggtgggagtggccccagcagcacctcctggctccctgcacagggctcccaggagcctggagagccgtgagggtgggaggcgggtggcaggctgcggagggtcctgggcaccaggctctggcagccctgcccgaggaccagggcagctccgcaggctgagctggagaagaaacgtgacctattgtcatgatttggggactgtctggaagaagaaaaaaagaccggaggaaccctcccctggctagtgcccattcactctctagttaatttatttgaagttttaatctaattattaactattttaaaggctaagaggctttctccagcagcagcaccaacaatgtcacctcttctcccgggcaggccccatctaaggccccagcgaaggccgataataggaccggggagggagagaaagggagagaggagaggcggggggtggtgagaggggcttaaggttcattattgggcagacttacatttaatagcaatttacaaccaagttataaaacccctggaaatgggggttaagaatggcgaggctgacagcgccttgagtgaagcccctccaagcggcgcctggctaataaagcctcgaaagccgctattgaggcctgattggcacccgatggctcgctccatggtaatgagccgggcagatgggtgggggattagccgccaactttgaacagcttttctttgtcactgtttcagctctcttgttagccccaatacatttattgctcatttcacaccgctcgagaaagtgccccttgctattcaaagtcaaccccgaacccacccactgcccccacccaaccccttccctcctgccaccccggacccagctcctcggattcagggacgctgccgacacctcgcctgctggagcgggcaccgtgtcacccccatcaatcagatggctgcgtgtgggtctggggtacagggtcggggcgcggggtccgcctgacagacgtggcagggggctgtgtgtgtgtgtgtgtgtgtgtgagcgagtatgtgtgtgcttgagcccagccacacctcggccaggcggcccccgggtgactggtgggacagaaggtgctcccggcgtaagacaatggtggagcgtgaaattcaattagttcagggcctggttccaatttcacagcccctaaatgcaaaaggggcaaagagaatgggagggtgggggagagcgtttttattgcattttctctttcattctggggggctttctcgccccttctctccctgcagcaggcctcaacctgcacagggcttttgaaggagtcatttggagtccatatctgtcacatccatttaaggcgtttcgggaggagggagagggtggggtggcgggtgcagactcctccgctgagccgggcccagaggcccactgccctctcttcccaccctaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggtgcggagcacaggccatgtcccttccccatagccacagagtttcccggaccagggggacccatttggcaggagaggctccgtggtccttagccttggaagataacaaccccaggaggtctcctgcctccaagggatcattaggccggggctctcaggcccttggctggatgggaggccaggatagaaggaaagggagcagtagttagctgtggcgctaggcagggccccaggacacagggaacggaaggaacaatgtgaactcacacctgggcaatccctgctctctctgggcctcagtttccccacctgtccagtgggcacctggactaggtgacccggctcagatgtcctcttgagtcttagatcctgaaatgctgcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcgggacccagcaaacccagagatccctgagaccctgtcccctttggacgctactacccccatgctccgtgggcgaccttgggcacgtcctttcaccacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggctgcacaggcactgggagccggccagggcctaaggacctgtcccagcatcaggcacggctcactggcccttttctccagggatggggctgtgccacagttggggctgtgccgcagttgaggctgagcttcagtgtgacatgcctgccacctcggctggcctctagcctgcctagcctcgtatccgcctgtggctgggcccaggagcagggcagttggtccccaagcaggtgcctctgtcttctcttagtagccaaagcccatgattccctttgtcagccaatcagcatttcatcttgaccacaaccctcctctccaggactcagtttccccattcatacaccaaggggatctcagctccctgagggtctgccagtgtgtgataaagccatgctgtgttctttcttgggggtcctaagagggaaagagcaaggtttcagcagttgcagcccctgaattgggcacctgaatttttatactggtggtggggtcagggcttcctgtttcggtaaatgttcaggtctctttgcttagggttgatttgaaaagataccacaaccaaatatcacctggccacggtatagtcacggccccatgtctctcaggctatttttactaagattctaaaatccaaagagagccgatcaccccatgtgggccagaagaaaagggtggtggtccggagggcaggatgcctgcttctggtctcaggtttgccctgccttgcccaacaaccttggacttgtcatctatcgctaggcctcagtttccccaagtgtaatgcggtaggcgctgggagttgcatcactctggctctgacctgtctgcgtttccctggaaaggcatggcagcatggaccggggcggggacgggcttgcctcgaaagacatgggagcgcggaaggggaggcaggctcgcctctttcttgtggctttagctccttgcttgctgttattcaggagaaacaacctaattgaagctctggggaggccttgagaacaatgttactaattagctgctcctttttatccgggcttacctttgtctcttacctatattaacatgtgattagatgcccctttgtcgcagcctgcccttgggagccagcgcggtgtgcaccctccagggagagctgggagggaccttgaggagccacagaccagcaccccatttacagatgcggaagccagggctggggaggggtgggatagagggcttgcttcaagtcccaggcactttagtggcaggaccaggactgccatctgggcccagagtggcatggagtggagggctaacagcttagactggagttggacagatctgggttcaaactcatgtatggtggcaggaactggtacactggaagtgctccataaatagccatcagtcccccgggcatgtggaatggggacagaagcagcccccatcctctgggagctgtcagtgtggcggggggtggggtgggttccagtattgcacctgtcttatcataataagggcctgccacaggcatgcccttgccatgcctgtggcaggcatcaccagtcaatgctggcattatcctgttgactccagaggtatctcagggctgcttgcaggcactaccaaatgatcaggattggcatacgtgatgaaagtgtattgccttccctattggaaagataaggactggcctgaagtcactgtgaaatggcatcctgtggggtggggcgagtcaagcagagttgagcaaaaatgaactgaaggaggtggttagtgatgaaaacctggaatgcactattctgaatgtggaatggtagctgacagcattccacggaggctggacctttttcccagaatgggggcctcatccccgtagaaggtcaaagccatgagatcaacagtctgttccaatccccgtggctccttaccacccacctggggaaagcttcctggagcccagccttcactctgccctggtactttgtgtgtgctgttggaggctctccccaaaagcacagaatttagtcagtgtcgtacagggaagaaaatcgggattctgacggcaagaacttgctgtgtgatcttaggcaagtttctccctctggaactccaattgtcaaggggccagatgaggaggtcgtatcatctccctctgaatgtcctcactcacctattttcttgctttgggttggggagagaagacaaagttgctaggtaattttagggtggtgtcttgtttttatttctctactccaaatatttcatgtgagaaggaaagaggagagacggtaaattagggcactgtggattcccccatgacaaggtttttattaagtgtacagtaatgagagaagctgttaatcgtcaattatattgagggcagaacagaaagatgctattgtccgtatctcggtgtacaaggggaacatgtcatttgtattgattttacaaagctcgtaattgaaattcgttaagggctgatttttttctctggggggcgggggcgggtagggagttgggcagcgccagtgccctgggtctggggtggcctagtcagcggcgctcagggtcagggacagggggctggggaagccgcggctggagtagctttctccgtattgtggctgttcacatgtcattatcacattatctttttaactctggaggggggctaattaagtgaagtaaatgaaatcagtggggaggagaaggggggcaaggcaggccggagggaagccgagggaggccgggaaggagccagcgcatgtccttgtgctcagcctctttctctgtctcctctctggccccagacttctcccgccgctctcccctctccgctctcctcccagccctgcccgtctcacctctgcctgcccccgccttgctcctcctccttgccttcctttcctcctccctctctccctttcctcctccctctctccctttcctcctccttcccctcttccctcccttgcccttccctctttgcacatcctcctccccattccccactctcccctcctgtctcccttcctccttactcctccactttctggcccagaaggaacaagggctgtcacccacttgcccaacgtgcccacccaccatctggaacattccagatggagaatggagggagacctgtgaagcaaaaaggttttcagccccagaggcccacccaggatggggcccgccaggcaccaggagcatagaggatggctagagtcccaccctgactggcctcccatcaccatggcaactgcttctcaccttggccctggtacctaagaggggagcccttgggctccagccaacccctatgccccacctcttccaaatcacttcttctactttcccaaaggaccagagcctttagtccaggtgccctcacctccagcccaggccccagctgagctggcggatcccactcaattctgcaaaattgctcattctgcctaacctggcagcctcagggacagatgagaagaatttgggccacagtagctgtttggttcccacctctttctgcttggtccactctccccccagccacccctggccacccctagatccttgcccgtctccccactccccgctgcacctttcttggcagtaattatggtgtgattgaagctgctccacagagaactgctgacacctctgtctttttcctgtaaacacggggagatgaaaatagacacttggagctgctgtgtgtgtcactccaaagatgtccgttgtctcttccacggcaacacagaggctcagctgtcatttcctccttctctctgcgcagtggtttgtatgccgactgtcaaaagccccaaattcatagtcttttagcatcaggtttctgtcactgttttttttttccagaagaaacacacagaaatcatctgtaccccctacccctgtggagaggagagggaagagctttaaacgcacacacacacacacacacacacacacacacgtgcgcgcgcgcgcgtcggcagcaacctaaaaacaagttttttgatccgtcacaattaacactttcgaagaaaaggagcaggaatattaattgcactggtgtgttttgtggctgcagcctttccccttgcccgtgagccctccggaggctgcctgggagggtggcagccaggaagccggtgctgggggctcaggaagaggagggttctgcctggcctctgcccaccagacattctctgctcccggtggcactggcctcattttcctggggacacctgtgatgggccagtagctggaggaccttggacaagtcacagctcttcctcgagccctgaaccccacctgcgccctcccctctctggactgatgggaggcgatgctgtggcctcgaatgttctcgagacaagactgtcagtaagtagggcacacctggaggacgctctgaacacttacctttgaggtaggtcccaaaggaagttggaatgtcagagcagcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtagtttggactgccctacagttggccgagctgaggacagaaaagcagggaggcgggcctgggtgtctaggagttgaaaatgaggagggctcctgctaccggcctacccaggatggcgccattacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttctggtaataaggtttctaggctgattgaaaatttgctcctcgaactttatcgttatatctgccattttggagacagagatttcctgtttctgcacacactggtctttctggacacactgctgaaccattcccctttctggtggcttttttggcactgtcatgtttgtgtgcggtcatcatgttttgttttgtttctctttcagacagggtcttgttctgtcaccgaggctgtagtgcagtggtacgatcatgactcactgcagcctcaacctcctgggctccagcaatcctcccacctagcatacaccaccacacccagctaatttaccatttttttgtagagacggggtctccctatattgcctgggttggtcttgaactcctgggctgaaacgatcctcccaccttggcgtagtagctaggaccacgggcacatgccaccacgcccagctaatttttttaattttttggtagagatggggtctcactatattgcccaggctggtcttggactcagctcaagcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctactctgcagaaaatgatgacggacccatttgaactgttttacaagagtcacggtgaggcctgaggaactcccgagggatttgagggcttggatctctgcataaacttggagagaggccatttcctaatcagaggtcacaactagattcagacggtggacatgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctggagctgagatgggagaccccggggccgggcccattccccctccagttggctgggtggtattaggcaagccacccccctccccaggcctcaggttctcatttgtaaaactggtgtgtgggactagatttaaggtgagtccagagtttgcagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcctccccagatccccggtaggcttcagagtcaaaaccaatatccttcatggtttttttttttttttaatttaaaactgtggtaaaatacatgtaacataaaatgaaccattttaaaatgcgtaagcgtgccgctcaacggcattaggtcctttcccagggctgtgccactgtgactaccgtccacctccagaacattttctttttgcaaagctgagactctggccccatgaaactccccattttccctaccccggcccctggcagccaccatttctggctgtatgattttgatgactcgagggacctcgcatgagtggaacatacagtgtttgtttttgtgcctggcctttgtcacttagcgtcacggccttatgttgatgctgtggcatgtgtcaggatttccttccttttttttttttagacagagtcttgctttgtcacccaggctggagtgcagtggtgtgaaatcagctcactgcaacctctgcctcccaggctccagtgatcctcctgcctcagcctcccaagtagctggggctacaggcatgtaccaccatgcccggctaaatttttttgttatttttagtagagacggggtttcaccatgttggccaggctggtcttgaactcctgacctgaggtgatccacctgcctcggcctcccaaagtgctagaattattacagtcatgagccactgtgcccggcccccttccttcttaaggctgaataatattccatcgtatggatggactgcattttgcttcttcactcatccctcgatggacacctgggttgcttccgcctcttggctattgtgattaatgctgctatgaacatgagtgtacaaatcctttctgggtttttttcaagcagccactgtagaaagatgttagtaaattcccaggataactgagaacctgcccttttagtgatgtaacgtatggtggaagaaaggaagctctcggggtagaatccatggagatgggggagctatggcccctgctccacccagacagcagctgcagggcaggcttgcccaagggccagctctgaagttgatgcgagaggtcgcactcctggggcaagagggggcctgggctgtgtgctgtgggcggtcctgcctcttggtgccccactgtcctccaatgcagtaggaccttcccccagacccagctcagcccaagaccaggcatttctgtctcactcggagatcatctgttccaagcaggttgttttccaaatggagggactgggcctgaggtcacaagaggggacttgagcaatcccttctcccctgaccttccagggttgggcctccacggccaggtgacttacagggcagcagacagcactggtgagggactcgggggcctacattcagttcccagctccacctagagcaagtcccttctcctcttgagctcagtttccccatctgcacggtgcggtcagcctaggtgattgcccaagccctctgccaccccagtggcctctggagagacctggccgcaggggccccatgggctgaaggtggcatgtgtgtacacatgtgtacatgtatgtgcacagctgtccccctcccctggctccctggtggaagggaagaagggatatttggggctctgggctctaccgtagtcgctttaattacaggctttcaacctcgggccggtgggcacgcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattatttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccctcccctccgtatcagcaccttcctcccctgccgcccactgccatcctcatgtgagaccccaaaaggtgcaggccaaagggggttgagggaaagtgcagggcatgagggagcaaggggatgctagaacctgccttgccatggggtgtgtccagggagatgcaccggcttcccaaggtgtccggcagcttccaccccctacagtttgcatgactgcagcaatgccaggcactgggcactgtgcggcgacatgcatcaccccgcatggtcctcacaactttcccaggaggtctgcagctccttgtacacgaggaaactgaggctcagaaggaaagcataaaaccagaagtggcctagctgggtttgacccccaagtcaggctgtctccaggaagaacctggacctactccatgaacttgagggagaggctccctggaccaggaactcagccccagaccccagtaccgcaggagccagatcttgaccatgaaaccactggggtggccacagggcctgagccctgtcacacacccagcccatgtgtggaaggaccggtgggtgacagcacctgaggcgggggtgtccccgttttgcaggtgaggagcccgggtttccatgccttggaatccaggcctcctgactccaaaatccaaccctcatgtggtgtaacagaggtccccaaactacagtccctgggtcaaatccagcccgtcacctgtttttgttcagctcatgagctaagaatagtttttacatttttattttatttatttatttatttatttatttgggacggactttcgctcttgttgcccaggctggagtgcaatggtgcgatcttggctcactgcaacctccgcctccctggttcaagcgattctcctgcctgagcctgctgagtgactgggattacaggcatgcgccaccatgcctggctagtttttgtatttttagtagagatggggtttcaccatgttggccaggctggtctcgaactcctgatctcaggtgatccgcccgtcttggcctcccaaagtgctaggattacaggcatgagccactctgtctggccagtttttacatttttaaatggttgggaggaaaaaaaattttttaatgctatttcatgacaaattatataaaattcaagtgttgccgggcacggtggctcatgccaggtgaggtggctgtttctgcattgtctgtggctcccctggagcggcaaggggaggttgagccatttgagagagaccataggacccaaagagcctaaaatattgactctctggcccttcccacccacctccataacatacacatagccctgatttggggcgttacattaaacagctgccctgagctgtgggaggacaggctgctgcctgaggccgatcctcacatcttcgggggcctggacgtcaggggacctgtgcaaagttagtattagttaatcgaatagctacctgggctaagctctcctcccctcgcctctccccctccactcccagattttgtttccttttaagcctcctaatcactgtaactcatctcaggatttcgagagggctcgatggttattggctggcgttatttctccctgccattgttccttgcagctttgaagccaagtttctgcccccgttcccagggacagacaggtgcttaaataccattgtctcctgcaggctttccagcccggcgggattgcgaccccgaaaggaggattttagttacaaagtgagagagtcattaagacgtggcggaggagagagcacctggccgggctgctccggggcctccacggaggctgatcccaccgtggccgcggccacggctgccacttatcctgccatcttgctgctaggctctgagctgggcacctgatggggtattatctaatattagctgcgcagaggtgaggaaacggaggcccccaggtgaagacactcacccaggctctcctggctggtgatgggcagctttgagccggggacaggccagctgtagcggccaagttcccagttactccaacagattccaggatgctcgtgatcaaggggcacggcggcacagacaggggaaccctgggtgtagggcacagtttggctcctggctgcggtcacgatgcctctacactggactggctgggttgagtccctgctctgacagccagcgacaagccctctacatcccaaactgaggtacaatgattaggagacttaaaaggaaacaaaatctcagagtggaggcgagggagagtaggggcttcttctgggtagttatcactaatattaactttgccctggtccgctgacatgcagggccccacaaacatcaagatcggcctcgggcagcaggctgacccccacagctcagagggcctgtttgatgcgattttccccatgagggatacagacatggtatagaccagggctttgcctgatcatgttacttaacttccctaggcctcagttttcccatctgaagagtgggaataacagttctacctgtctggtgggtgaggactaaaagtatgagtatttgtaaagcacctggaacaatgtctggcagacgagtgcttattccagtgcgtgaaataactgcgagcgcccggcgtggtttcccagtgtggaggcgcggcacttggagtcttgcctctggctgggttaatggtcttgagcagggctgtctcttccttgagcctcagtttcccctcctgtcaaataaagggcaccaggctgagggcacgccagggtctcttcccagtcccgtctagctcctgggtggaaagcccaccattctgctgtaatgcttggcttcctcagagcccttgtggtctcggcacagatagggagactgaggcacagggaagccctcctgccccagcctcactcctagaggccctaggttctgtgaccactgccactctgcatctgtgtgtctgtgtgtggctggctggctccctctcctctcccaccattcccaaatttcctggtctggctgtgtgagcttcaggcagactgtctccaggagtggcaaccagggttagcctggcaggaccccagcttcaggaccctggcagggcccagaggagcatctcatctagggggtatagctcacttcttctcccctcacctccatttcttcagcaataaaatgggtataatgtgcaactcacacagaattgctccagttagaaaggatcgcatgtgtttggctgggcctagcagcacgggggaggggtccctctccagctcagccctaagccccacccacagtgatctgcaggtctggggggtgcagggtctcccccattgcagcttatgccaggctcactggcccccaacccaggctgggtccgctgggaaaagaaatctgagcagaagaaccctgtggggcagaggtagaaaattctgagataaagcccaggccagttgctcccacagagatctctgtcctatctctggctccatctcctgcctgtcttccggcctggaaacttaatgggctaattatcccagctccgtcagaaagatggccaagcccaggacaccagggcatggggggctgggagaacatcagtggccccctccacgagggtctcggggtgtgttggaaaaagccctgggccagagttaggagtgcttcatcagacctgggctcttccaaagtcttgctgtgtggccttggacaggctctttccctctctgggcctctctccctgtgtacagtgagggctggcacagagcatcatgttcaaactgcaaatgcaaaacgctttgcgctctgtgcattccctcactgcatccacacaacctctggttagcaatgttttctcactgtgcaaatgaggaaaccgaggcacagggaggttaatcacttgtccaggtgtggctgggatgcggactcacagggtgggacactggagagcaaggactcaacctctactctccgtgcttggccctcccccgcctctgcaagccccaggaccccatcccagaagcctgtcccctttcccacggaggacctctgcaggtgcccccaggggcctgggcctcccacaatagccgcagcccctgggctgacccagccctttatcagggcaggagatcatgcgccatctggccctgcagctgcccaggtgggctcaccttccaggctccatttcaggaaactctagccttgccctgtccctccccccgccatggcctgcctgcctgcctgcctgcctgccccttggtcccagcctccatcagcagaggctagagagaggccgggggcagactggggtctgagcgctacccctccctggcctttagggctctcggggagaggggagggagcatgtttctcaggcacctcctgcccccacctacacaccaagggatgttctggccatagagaaagctccaagtttatcataggaagcagagttgttacaacttgggccaacacaagtcaaatggaggctccccacttccggcctgtgtgatcctggagaagtttcttaacttctctgagcctcccttcctcacccagaaaggggagaggctaagagagtttctctcagagtgctgtctatgaggattcagggagctagcccagatcaaagcctgagcgcagtgctgcttatctatgcagaaatattctatctgcccaggaaaacagcagcaggtgcagaaaacagctcactgattccaaggggtgggctctggccaggactccagttcacagtagcccctaaggctggtgctgctcagtgctaggggctccacatgaaatattactgtgacatccccactcaacagatggggaaacagaggcacagagaggggaaggctatgcatggccatggtctgaaccaccacccagctgcctgcactggacacccatatcaccaagccccaggcagcatgtgcctctgagtcctgtctgaggtcttctgcctcccccggagattagagcctccattgggccagggatggggtccctttaccactgtgtccccagttgctggcctgtggcacttcctgaatgcctatggcatgaagcagtgggtcacttccctcctcctgacccttagggaaatgacctaggtggtcacctccttacccacaggccctttgcaaggttagagggcagggctatgaaagcatggtcctcaactcagccactggcaagcgcacattgtgccagtctcgcgggaggcagtcatggtctgcatggcggggtaaaccatggggcacccttcctgtgccccaggtctccctgtgtcctcgcggtgcaggaggcctccctagtggtatcctgttttcctccctgtaggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgaggtaggtgccccacacctcattctgacccccacttgggcacagagcctatcttttgactggatcctcaagacatctgtgcctgagcacatgtcaggcaccatgcagagcacagagtgatggtcacagaggatatagacaccactatgctcccgtggaacttacaggctagctgggagaaaggcatggatcaaaccattaccagaatgtagaattagacaaggtggcagcgggctgtgaggaatgcaggatagtctggctgggtataataactgggattggctaggaggggtggtgcatgcctgtaatttcagctactcaggaggccgaggtgggaagattgcttgagcccaggagttcaagaccagcctaggcaacatagaaagaccttgtctcaaaaaaatatatatacacacacacatacatatatatatatatatacacatacatatacacacacacacacacacacacacacacatatatatataaaataattggggttgtgaagaagctcctttgctattcaaacaatagcagaaggagttaacaggtgaatggggggaggggtggaagggcaaaagtggccagggggaaggagctgaagctagatcttaaagggaagggcaagatcagatctgtgcatttagagggtcctcctggctgctctggagaacggatttgagtaggtgggaggtggaagggcacctgtggaaatgcggtagcttggaccatgctgatgattcctggactagatagcagcaggcgaatgtgacacatatctaggaggagggattgaaatgacttggatgtggagggagatggagggtccagaatcaccctggtgtctggggtcgtgagcagctgggtgcagtccctgggttgaggaaatgctcttgaggaaggatcatgcatttggatttaggtgtcatgagtatgggtttcttttgagatagctgggaaaaactaactggaaggccgccggacacttgggtctagagttgaggagaacccaggctgaagaccctggagcatcataggcattttgatgttctctgaagcgctgggccaagagagactgcctaggggaaagcgtggagtgagacaagaagggaactagccaggcaagatggtgcacacctgtaatcccaactctttgggaggccaaggcaggaggatcgcttgaggccaggagttcaagaccagcctgggcaacatagtgagacctcatctctactaaaaataaaaaaattagctaagcgtggtggcatgtgctcgtggtcccaactacttgggaggctgaggtgggagcgtctcttgagtctgtgagatcaagggcgcattgagccatgatcatgccactgcactccagcctgggcaacacagcaaaaccctgtctcaaaaaataaatacataaagtattagccaggtgtggtggcatgcacctgtagtcccagctactcaggaggctgaggcaggaggatcacttgagcccaggagctggaggctgcagtgagccaggattgcaccgctgcactctaaccttagtaacaaagctaggcactgtctctttaaaaaaaaaaaaaaaaaaaaaaaaggaaacacaactggaaccatgagatttctcattgatggaccaggcagaaggtggccaaggaggagcccctggaggggcaggagggccctggtgagccagggcaaaggtggcaggtaacgattggccactcctgtgtccgccccgtggatgagagtgacctgcaccaagggacgaggtgtcacctccagaggtcacctggccaaactagagatggggcaggcccctgtgggacagacagcccccactagacgtgggtcccctaaggcccagcttagctcaggctaaggccagcccctccctcctggaggctggttgggaattaaagtacgagtcttgtttggcagtcaatattatttttttctttcccttctccttgccatgttgagtttctccccgcttcaatctttctaaacactttataagccataaatacaactgagtcagtttagatcagttggggtaaatgtcaaattatcttctctctttctctctctggctctttcttccctccccctccaaatcaacagcctctaataatctgtccaacccttcattaagccttacagtctcactcagggagattaaatgaataaagtaaaaagggaaaggggaaaaaagagagaaaagcaggagcatttattctcactgtgtctccgaccatttcccttttctttttgatttctacatcgctgacttgaaagcccttgagtgacagcgtcacagggaccagcgaggaagccgtgagaggtagcagagctggaaatgccgtggctcagtaggtagaaagtaacgtaattatagagcaggtcagagccactcgaatgagcaaaaataaaagcacagaggttttctgtagaccgtcaggggaggtaaaaaaaaaaaaagaaaaaaatcattgtaaactctttttccacctccccgctcacttcaaaccacaattttaaaaagaggttttttagttcctgagaaacccctcttggaactcccagcagcctcgtgggacaagtttgtccctggatgtgggccctctttgcaggggctgccagggcagctgggaagttcccaccttggggaacgggatggggagagtttgttgtgacttgtgagagatggaggtgaagggacagatggacacagaggtggggggattctgtgtcctacgttctccctgggctgagtataggggccagtggggctgaggctcggtttctaaaacaaggtctgttgaagggatctgaggaggttggtggtctagtttggtctagctcttcctaagcactgactgcacagaaaggggtggccagcaaaagtctggtatctcctcctcttccagggaatgcaagctcctagtggcttcagtgcctgagccctggaggggccgtggaggtgtggaggagggaggaagggacatcaaggaggtacaggagcatgggagtgactctgcagagagttccacgcacccaccggcttcaaggcctggtgaaggtcagggcccgggtcctgaacaaatcactggggccaggcagatgcagagacctcatttgttcttgtaaaaagtccactgtctacaaagaaccagtcagagggccagcctcagggtctcaaagcagcagatcctcctgcctcccaacaccgacccccgctacccctacctcgagaaccttgagtcagctttgtcccaaggctggaattctgcagacaagggtctgattcagagcaggacatgacaagggaccccatcctctcagaggctcagaggctggccttgtggagtaggaggcatctgagtccacgtgccctaagtgcttagcacaaccataattaatgaaggcaatgggtgattgattgcttcggtctggcccctccctgtggacaccactcttgctcttccttccttggcacctggcccagcatctggcaggcagcaagggcttaataaatgcctgaacaaatgaatgagtgaatgaatactgttagtactagtgggtgctcaccatgtgccaggcaccagctacattatttcatgtggggccaaatgtgacactgagagctaaccaccatcacgcatttcacaagtgcaaggctgaggctccgagtgcaggaatactggcctgggctctctggtggcgggtggcggaaacaggacgcaaaccccagtcagctggctggagtgactgccatggttaggaaggttgggaggagcagctaagggtggagagccccaaagcagaaggctggtgagtctgagaggtggaaactgtagagaggtaaaatctgctctgctgagtacagcagcagtcaacccagcattttccatgacacactggcagtgggtgcccaggtttcaggatggattaggtaaggtctaactggttggacacatgaggggaaaggtgacttggtgggcccatctcgctgtgaatgctggaggcctccctgcagcttgcgaaatgcccttgtgctattgcaattcacaccccaaggcctcctgagccttcaggtcactgcatgccatccacacagtcccaagggcacagctggcttggacgagttacccatttacagacagagtgctctggttggtggaattcatagggctagttctggggtggctgctcctagcctcctgccacattgtgtagcagggaagaggctgctgtgtgctccactagggctctccaacctttgggtgggtgcctggcccagaacagggttccctgagttgtacagaaattcaatggaaagccgacgtgcagggagggtttggacccacacaggggaaatgccctggcatctgggaggtggggctgcttctggccccagcagtcctcccttcaagcagaggccagggccaggctgagctgacaagcttctactctccttgcagcatgaacgtgcagggtgattatgagccaactgatgccaccgggttcatcaacatcaattccctcaggtgagaagctcagggccctgacgggccttcagagcctccaggtgtaaagggtaggctttgagagcccccaggtgtaaagggtaggctttgatgcgaccttgactgctgccctgccctgccctgccctgccctagacaaaccccactttcctgtccatctgcccatagcatcctcagaagcatgctttgatagccgacagtaacagagggtcctaggcattggggtcctaggttcctgtgtcccaccgggtgcctctgatacttgccctcccctcccgctaagccacagggactccactatgagctcctttgcagggcaggttaaacaaggaaatagcatagaggtggagagaagcctttgttttctgtcaccatacctgagctgtaggtctagctggaagccatcctagccacgtggatctccatggcccaggagggtggtgcacgtcatctgaagtcactcagacctttgatcctctgtgagtcaccagtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttacacaaaatttgcaactccccgggaacaggctgagtggttaagtaactttccaagggtcacacagctaggaggtggtggagctgagtccggagggcctgtcctgctgtgggttctccatcaccagctcccttctcatggggattggagtctagaagaagatgcaagtcagtctcctcttgctaacaacatgccctgggcacagagccatcattttctcccagagccagtctcttgtccctggaggcacctcatgccccgagagatgttgaagcccgcccatctgcccagggtcctctcccttcccctccgtcacctccacctcccctgcctcctgcgccctctgtttgtattttatgactctataaacccttttaaatggcccagaacaaacagggcttacatagtggcctcttcatttctcctattgccagttaaacgctttgtcttcaacaatgacaaacaatgttttccccctaagataaattaattacattatcctgattggagggcaggaggggccagggcgggagagggaatagaaaaaaaggcaacttcacacacatcttaacaaacagctgccccagccaccccagctctgcctgaattaattgaacccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttcta

SEQ ID NO: 25 - DNA, 23753 bp, Homo sapiens
  source 1..23753: mol_type = genomic DNA
agttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggtccggggggagactcgggggcctgggatcccccatttagccatagggcggggggatcaggttcagcctctgaaagtccagagcacgatgtttgggaaacggccccgcccgcggcctccgggacctggcgaaggagccccgcggggcgcccctgctaccaccctgcgcggagtcggccccgtccccgagagcgcccggcagcccctggccgtgggccgcaccggagccgcgcaaggcgactgttctgcgcctcggctcggggttcggacccggctctgggcgcggtcacgcggggcgctgcgcacggcgtccggcggccacagagcgcggccatcgagtcccgccccggcgcggcgccccctcccgggcccgcgacacacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggtagaagacaccaccggggtccgcgggtgggggtggctggaacccggggcgggcgggctcaggcgaagaggaaggcgggggagggggcggcgacccgggtctgcggttgaatcaacagggcgtgggaatggggcgggcggactggggtgggggcatgccggggtcccggggagggcgggggtcgggcaggccggagggtcccaggctgcggcggggtggggaaggggtgggggggaggggcccgggctgggtggggtggaggaggggctgggggggcgggtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggtgagatccggccccaccgagactcgctcccctctctggacagaggatctcaactgggtcccggtttccctctccgcgcctccgcccagagttgcatcatctgcaccgaaaggcggcgagacagggtctcccaagacccccgccccaccggcgcccacgcctgcggtcttgaccgcccagaagatgggggctggccgtgcacgtggccccgggctcccaccccagcccccgcgccggcggagtggaccccactggcggcgagtcctggagcgtggagcagggacgcggggtgggaatccgggggagatgcacgtttcggtgcccagcattgagttcgctgcattgtggatgggaaatggctgtttgcaaatcgccctttttggcggaccgtgtggggtggcggtaaacgctgtcgttgcgcgggcggcacgcgaggtgggtgcccgctgggggagggacgcggggctctgcccaggttgcgttcgggggatggaggttttcctgggacctcacttccctgagccccaggcgagaccgcagctgagctgtaggatgcaagcgggaggcggagcgtgggtgggagagcggagcgcgaaattctcggcttcccgaggatcttctgggcttacttgtccccagctttgtcccaaagtgtcgcttccggaggcggagtggccggcggtttccgggtctcagtagggtctggatctcccacctggaaacctagaggagtttcccgctctccgtgcgcgtggccttccccaggcccctccgggagtgctggcgcgcgagtgcaggggtgccccgggaacgtcgtgaccccaagggggtcttgtggtttaaggagcgaacggaaccggccaggcgatgccagctgaacccgccttcccgggacgcacgtgcatccggccgcccggcgctgttgtcttggggagcccgcgggttcgggtctgggtcgcctggcgagctttccgccgagcgcctctgagttctacagagccccgacggcttgcgatctgcgttcccggcagtcccttaccttgcgagagagggctccagggcgaggcgaggggccaaaagcaaggcgctgggccgcctgcgtctgccggggcctcgggtccacggctttctggaagattcggcggcggagcatgcgcgccccaggccagacagggcctgtgccagacggagagtcccttcccgtaggtgactcccgcgacccgcggaggaaggtgctgctccgctcacggcggcggcttcttacaaggttgggatagaaagaaaagcgtgggacacgaacctctgaaagcgggtgcatttttctggggaagagaagatccaacgccttcggattttcagacaagtccgtggtcccaagaccttgaaagcaccaccctccagggtcgtttgaagccgctttggcccccagtctggtgaattgcaaaggtggaggggaggctgggaagtccaggaggccaagctgaggcctgggtagggcctgtgcgcagagaccacctgaacagcatactccaagggcttccaaaggcagccggcttccgcaactttttcttttttaataggctttttaaaaaaaaagcagttttaggccgggcggggtggctcactcctataatcccagcactttgagaggctaggcgggcgaatcacctgaggtcaggagttcgagaccagcctggccaacatggtgaaacttcgtctctactaaaaatacaaaaattagccggatgtggtggcgggcgtctgtaatcctactcaggaggctgagacaggagaactgcttgaacccgggaggtggaggttgcagtgagccgagatcgcaccactgctccagcctgggcaacaagagggagactccgtctcgaaaatttaaaaaagagcagttttagatttagaaaaattgaaaaaatagatagagttcccccagtttcccctgttattaagatcttaaactgatgtcgtatatttgttactttatttattttcttttatttttatttttatttttattttttgagacggagtctcgctctgttgccaggctggagtgcagtggcgcgatctcggctcactgacctccccctcccgggttcaagcgattctcctgcctcagcttcccgagtagctgggactacaggtgtgcgccaccatgcttggctaatttttgtagttttagtagaaacggggtttcaccatgttggccaggatggtctcgatctcttgacctcatgatccgcccgcctcggcctcccaaagtgctgggattacaggcgtgagccaccgcgcccggcctatttgttacaattaatgagccaattccacgatcacataaccattgttgacattaaccaaagtccgcgcttgagtcagatttgcagagttttctcctcactgcccttttctattccaggatcccatgacagattctgttgtcacgtctccttacagagtttgagcggtgctgaactgtcagcaccatctgtccggtgagtgacggctgtggacttagtcttcctgttgaatgtggggaatcaaaggagggtgaagcggggctgagcccagtcctgggccctctgaagaaggcaaggtgggaggtggtcgtgggttccttgtccccccagaggaggggcagcagatgggacctcgcctggctttctttttgctttcttcttttttttttctgtctcatctatttcaggtgcgtgtgtgtgtttttaatcctgggtaaaatacacgtaacactgatcactgtaaccatttctaagtgtgaggcaaccaccgtgactatctccacccagaacgttttcatcatccccagcacaacctctgcacccattaaacaatcaccctcccttccccactcacctcagccgctggccgcttctattctactttctatctctatgaatttgccagacatagaggggcgttcgagagtcccaggtgcctcatcgtggaagtggaatcacacagtatttgtccttttgtgtctggctcatttcgcttggcataatgtcctgaaggttcgtccgtgttgtagcgtgtgccagaattcatttctcttagggctgagtaatattctagtgtgtgtatgagcctactgtgtgtgttcatccgtctgcggatacgtgggctgcctccacgttttgacttgtgaatagtgcagcagtgagcatgggtgtgcaagcatctgttttgttgttgttgttttattttttaaatagagatggggctggagcccaggctggtcttgacctcgtggactcaagtggtcctcctgcctcagcctcccgaagtgctgggatgagaggcgtgagccaccgcacccggcccaagcaactgtctgcttccattttttttggtatatgcctataggagagaaatggccaagcggctgcccacagggctggtgcctgtgtttttgtgcagttcttcctgggcttctctgagggagcagagcacgcctcccagagggggccgggtcagcagggttcgctggaaccccacagcatccgagcctgaaccgacgcctctctccttgctttgccaggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccgtaagtcctgcttttgatcacaagagggctgatccataacctggagggcaggagtttgttacctggacaccacacagccaggaggacatgaggtgtaaccccctgtagtcactctggattgaggagctgggggtggggccatgccgtgtagatgaggctctgagaggccaaggcctccttacgctgcagcccagcgcctaggccagtgcctggcaagacagtggatgctcagcaagtagttccagaataaataaataaatgtgcccaggtcacatgctttgcccggtctgtggctgcgtgtgcacattcactggaggtgagggaccaggatcctgcctgcgctctcttatttatttattttttatttttttgagacacgagctggagtgcagtggtgcaatcatggcttactgcagcctcaatctcccccagttaagggatcctcccacctcagcctcccaagtagctgggactatgggtgcccaccatcacacccagctgatttttgtatttttaggagatggggtttcacccaggctggtcttgaatgcctaggttcaagtgatccgcctgccttggcctcccacaagtgttgggattacaggtgtgagccaccgcgcccggcccagcctgcacttttccgttaactctaggtcatgaagacttcccgtaggcattacatatttttccataagggctgtttttctggtggcacagactgttcggtgaagaagccatcattttgtaagccctctacggggtagatagatgtttgcagttacctcattttacataactgcaatagaagatacgacacattcatttagccaacaagtctttcctcagcgccatgtgcatttcgtgccctgctcaaggcgcagaagatctatcagtggaaaagacaaatcaacaaaaatccctaccccagcatgaaactgaaatcaagctcactaagccttaggattatctttatttccttagtgtaatcttggaggagaacaaatagatcaaagaatgtgcttcttagatgtttgattcctttttttttttttttttttttgagacagagtctcgctgtcacccaggctggagtgcagtggcgcgatctcagctcactgcaacttctgcctcccgggaagcgattctcctacctcagcctccctagtagctgggattacaggcatgtgccagcacgcccggtggatttttatgcttttaatagagatggggtttcaccatgttgtccaggctggtcttgaactcctgacctcagttgatccactcgcctcggcctcccaaagtgctgggattatgattcctattttgtgtccaccactaccagcgtttatggttgttgatttacagttcagaatgggtgggggtggctgggtgtactctcagtgcagcaatagaaagaaagaagtgacagtggacaaacccagaaggtctgagtgtcaaacatactcagtgctgggagctcaggaggccaagcagatgtgtgggcagccaggaggatgggctcttgctgccaagacaaacccaagagagcagtgggtgagaggcccggtgaggtcgggagtggctgctggagggtggagtgggcagggaagacaggcccgattcctgagggctccgtgagctcctaactctagggcatgagaaggagacgatgccctccaggttgtaaatggcgttgcacctgcacctcacatactggcctcattcatcctccgaagacacccccatcctgagacgcagagccgacgccgcttgtctccagtcggagggcccctgagaatagtggcgttgcggggaggtgctgcagaggtgggtcaggagttggaggttcattctaggacagtggcgtgtcctcccaggagcctcttgggctgtggaagtgggagtccttgagataaggggctccagggctatccctgcaagtcacatcctttttcttgctaagcgctctgggcctggccctgatcacctctgcaaacttctcaggtaacttcacagccaccgaggcccagtgctgagtcagcacacctgctgcagggaggcgggactcttcccgcctggctggccagatgcccgaactgaattaatgaactaatccccggcgctgtcaccctggggcttggctttccacctggccctggctctctacacctgccaagcctggttcccttctgccgagaactgcttctgagggaacctccctggcccctgtacagtttggggacctggcaggactgccttctgctccccgggaagggtgcgattggattccagctgctcttgttggcgcctgttttggccttcagggtagctctccctgcaaatgtggcactccctccatggcacaggacctctgggagctgggttcaccccaggtctaagggtcgcctcctggggggcaggacccaaggaccctggctgttcagcaggtgactgtgctgaagagggggcccagggttagccacggggtgtcatcggagctgcaaggcccagggaggggttgcgggtctggagaccgctgtaagccatgcgtgttcccagatgagtatgtggtgagcttggtgcagatagatagggggtgtcatcagcatctccctgggggaggatggcaggggcatgagggccatttaggaaaccacctggaccagggtttgagggtttacacagccagatgctgcagggcagggcatcacgagcctggccgacagcgcctctgccggggctctgagtctgccacgtgcctgacattttctgtgcagggctagacatcccgcctgcgctttgcagccattgtccctggtctaaggagtctctgccctgacacttttttgcttcctatggtcacatgctgagagatgaaaggaaatgtcatctccagtaaagcctttctgaaaaggtggacctaaacctttgttttggagtcagtatttgcttattttaacttttttatttggaaataatttactactcacaataagtggcaaaaataatagatcctttgtacccttctcccagcttcccactaacaacatctgccacgactgtaggttcattttcaaacctgggaagctggcattggtgcaaataaaccacaggcatgatttgctttttatagatttgtatgtctaagcatgtgtgtgtatgtgtgtttcaggcgtgtgtgtgggatgtgtgttaggtgtatctgtgtacagatttgtgtaaccaccacccagataaagccagttctttttttttttttttttttttttttccagttcttcgagtgttgatttgtgtaagacaatgtctgccagggctggtactattttttttttttttcctgaataattgtggactcctctgtttcagggcaaaatctccaaaaatcttgccagatattctgaagaaaatcggggacacccctatggtcagaatcaacaagattgggaagaagttcggcctgaagtgtgagctctgtgagtgccctggctttggagaggggcttcctccatctacactgggctccgtgggcctggggggtcctggggggtcctgggatggatcccttaggcaaggccctgggatcagaaaactcgctggttaatgagtggccaagaacatatcagcttaagtttgggaaaaacacacaacagggcattgtgtcagagggtgaccaaagtgactccccagcagatggaccagggaacgaacaggtgacctttgaactgaggccggagtggaagcagcgagggtgtgaagggccgggtgagggtcaaaggcagaagcaagcaggtggggagggttagcgtcatgcctgctaaggagcagtggacgggtcctagcacgtgctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagaacgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggccaagtgagttcggagggaggcaggaagggtgccgcggagaaccccgcgacagggccagatggagggggtggagttcgagtgggaaggagagggaaccagtaacatggcttgggactttttcatcctgagatgctctaatgtcccagccgggggacctgtgagagctggggcaggcgctgggggaaggaagtcaggggtcggtgcgttgggaaccgatcgccgattcacaggaggggcctcgtgggagcctggccctcctctgcccccctctagggaaggagatctcggagctgcagcagagcagcccccttcacagagacccccaaggcagcagggccggctctgtgctcatttgtcagacaatagggacccttaactcgtacgcagcacgcgtggctggctcactgtgctccgtacaggatgacgtctaaacttggtggttgcccttgaagtaggttttggaatgcccgttttacagacagacacaccgagggtcaggttggtcacgtggcttgccggaggccaccagctctgatttctgcttcggagctggcccccaggcgctagtgagaatgatctaactgagggtttcacagtatgggacccagaggggtccgagaatgcaggcctgtagagggccagaccccgagagtcctccccaccacacacagcgcctcgtcctggttctaggggcaacacctgtctggtggttgctttcagaaattttgaggtgctgcaggctggtcccaggtccctcaaatcacatttcatgcagcccagtctctcgctcttaaaaactaaatatttttaagagctggagagggagagaggacttgcagtaaggaaggaagtgcaagtgaaggccttggccttgtgcgggaaccgcgcagggagcccttccccgggcaggtgacgccccacagggggaggaggacaatgggaggctgtagggagagtatgcgagtccccatccgatggggaagccagtgctgtggcttcaggacatcaagctgctttggcaggggccgctgggtatggctgggcataggggcgtaggggacccaaatccaggcgcctgcccgccacaagcccagctcgtgggtggggggacggggttttctgcggcgccccccagtgagggctgcttatgcctctctggttcccacagagttgctcagcgccctgcaggaccggtaggatgggctgcagggggagaagctctgataggctagtgcccaggtgcaggtgtaggggaggtgagtggagaggtggcaatttttcagaacccacagacccccaagcccgtcccccaccctggggtgtatcaggtaatgggggggtgagcaggaatcaatgggggggtggtcagggggtcccctctgtgattcatctctgcctcccagtggccaagtgtgagttcttcaacgcgggcgggagcgtgaaggaccgcatcagcctgcggatgattgaggatgctgagcgcgacgggacgctgaagcccggggacacgattatcgagccgacatccgggaacaccggtgggtgccaggcccagagggggtggccagggctggctgtcccctacccatgccgagcctgccgggacccgggggggatggctgagctgcagccgcatgtgctggcccgcctggccgcctgctccctggcatcttgcacccgctgccggcctgtgtcccaacctagcttcctttgaccagcattcggggccagtgccgatgctctcggggcgatggcacctggcagtgcctggcacacaagacgagcacccggagtctgctcttcctgtgcctgtgtacccggctgggcctggaggaaccagatctcctgtcctgcgccgctgcctcctcctccttgacgtgtaccttttatttctgcctctggcagcctctctccccctgcacttgaaggcagaagcagccatgttgggcaattttggaatcccacagaaccctcttccctgggccctaagggaaccggcatcggggtgtgcccctgtgtcccaggcaggggcggggcagggcttggggggtcactgggcccctctcaccctctgtgtgccctcagggatcgggctggccctggctgcggcagtgaggggctatcgctgcatcatcgtgatgccagagaagatgagctccgagaaggtgggtgggcgtggccaggggcggggtcatagggcaggggatgagggtgcctgggccaggcggaaggtgcaggccaccgctttccctcctgcaggtggacgtgctgcgggcactgggggctgagattgtgaggacgcccaccaatgccaggttcgactccccggagtcacacgtgggggtggcctggcggctgaagaacgaaatccccaattctcacatcctagaccaggtgaggcacctggggcctggagacaggcattccctaggagggtctcggtcagggatgtgggggtgactgaggtgtcaggggtcagctcacgggctctgctctctttctatgcagtaccgcaacgccagcaaccccctggctcactacgacaccaccgctgatgagatcctgcagcagtgtgatggtgcgtccctctgtccatcttgattgcatttatccctggctgcctgggagtgtacacatctcttgccctctccttggtgaactcctattcacccttcagaacccagctcaaatgttccctctgtgaaatgcttttctagagcatttctctagaacaatttcctccctccgttgtgccctcttggcctccgcctgtggtttacctgtaatagcaaacacagggcatggctgtatttgtttacccagcaatctctgcaggtctgcaggggctcctcctgcagataatgcagacagcgagtctgttcagggcccaggctggtgctgggctcacagcttggacttcatttgggatcatgccctgactcggcatcaaattcatctgcagaacagagctggtgacatctgcgatgagctcactctctgttacaagcatgaggccggctccttgggcccttttccagggactcggtgccaaggcctgtgggggttggtactgaggttttcccaagagatccctttagagataagttgccaagaggttggcgccctggcttcctattgggaatccggtgttggcatgggctggagtacaccctcagtccgtgcccaggagccgggctgtaaggtccaggcatttggttgtttgggctttatgtgtgagaactctctcatttggcaaaaacagtcctgtctcagcatgggtgcccaagctgctccgtctcgctgagtctttccctgctgtgacttctccaccagatgcccgcgctggcggccagcagtgtgagcgcccagcgagtttctgcgctgaagcctaaaagactgattccatttcctgtgtaaattcagttaactcactcacaccacgcaaacatccaacagcccacggaggtggttaattcacagcctccctctgcccgccctcagcgcctgcaccccccggacagggtcctgtctttctgcatccagccaaatgggggttttaggggtcgagtgtcactgagcaaagactgggctggggtgccccaggctgcctgtttctgaggctttcacagaccaagggcagcaacgagggctgctccaactggagaagaagtttttcttttgaactttttggttacccaccgtggtttgggctgagtgtgttttcaatgattattactatgagtgatgggctggccaggcagggacccaagaatgttatccgtccaccagggaagctggacatgctggtggcttcagtgggcacgggcggcaccatcacgggcattgccaggaagctgaaggagaagtgtcctggatgcagggtgagtggtgtggccgggccggagaggggcagtgcggagtggccccggcttctgagctgaaagctgtcattcctcacggtctgctcagcacgctgtctcccgcggtatttctgcgctgcctgggaggtgtttgggaagacaagggtgcttgacacataagggaccagcagctcgtgacccgaaggagctggggctgggtgctcgctcaccggccagtgtcttggagaaccttcctgcgctgagtggggggtcggagttccaactgggggcctctgaggatcagccaggagctctaagtcctctggtcctgagtctgcccctcaactggggcttgtgggagttgggagagggttcctggactcggggttaagagcaggtctgaggacgggtgcctagaaaggtcccgctgatgagacaagggcgttctctccctgttgcttgcccttgaaaaagacgtcactgcccagcaatgccctttgtccccaaaggctctgctgctccgccgcagggtggtctgtctggactgtcctgggggccccgctccgagaagcaccccggggaggtcagttcctcccaggcacctgcctttacttctgagcgccctgcactgaacatttaggtcattaccgctttaatacttggagcctgggttcttgggtttctcatcctgcctctgaggctgggaacaggccaccacccacaggcagatcattaacaggcagttgttaacggcggtattggccactcccataatagaatatcgaggcatgtccaggcggggcttttgctggccttgagccctgaagccgcgccctctgcagatcattggggtggatcccgaagggtccatcctcgcagagccggaggagctgaaccagacggagcagacaacctacgaggtggaagggatcggctacgacttcatccccacggtgctggacaggacggtaggtcgagtccagagcccggccacagtgccggtgcagcctgtaactcaccctcacactggggagcctggctgaccctgggccccaaccagcttctccactgaaacagaagggcaagccccgcacgcatggtgagaagctggtctcgaaggtcgagacaaagtagactgggggacgatgtccgcacacgtggcctgacctcaccaagggatgtagcccaggtggcacaggcagggagcagggaaaacgtgtgaaaattaaggccccggaaaagtctgttaagagccaaaaagctgactttggcctgagggagagcagagaccgaagggccggtgtgggtcacacggatgctcagtggggctggcgggcagttttgctgtctgcaaaacgtgttggaactggaaagtctgcagacgtgccgatcccagggggagaggctggggtgagacctctggggtcctaccgcctagacacggggtccaccatgaggctgttcaccctcttggtcacgtgggagcggctcccacgctgacgggctgtggtggggtcctgctcaggtggtggacaagtggttcaagagcaacgatgaggaggcgttcacctttgcccgcatgctgatcgcgcaagaggggctgctgtgcggtgagtgggtggcgggcacgggggtatggggaaggcagagatggctagggggcactggggatggctgggggcgcaccctcagtcagccaccgacctgcatgtgtaagacagcagttctgaggagtgtcactgcggcggccacgagcctcaggtgttgtctgcctgcccagtgtggtcacctgctcaggtgagggcaggaggccatggggcggggcttcgagctgccttccagaatgtgtttctagaacaaggctgaagctctcatggcacttattgtttctaatcaagtccaccagggcccctggggcggtggctctgcattgacggggcccatggccgggactgggtgctgcgagcaccctggagcagctggggaggggactggagcctgaggctgtccagctcgaccccgctcaccttcctcctaccccgtgcccctctgcccacctgcttgggggtggacagaccaggtggccgctggcaatgccactgactagccacacaggcagcagaggccctgtagggaccacagttgatctagacctctggggactcggagagcacacaccagcttctaaaacgcaggcagggacatgtgaggtttctacatgtgcattccgtgtgtcatgtcactttgggggtggtgacagggaaagtggaaggaaaccagccctcagcatggccaagtcccccgttagctgagccccaaactagagattggaagaaagtcttgattgaaaaaccatttcccagccaggcgcgttggctcatgcctataatcccagcactttgggaggtcgaggcgggtggatcacctgaggtcaggagttcaagaccagcctggccaacagggagaaaccccgtctctactaaaaataccaaaaaaaaaaaaaaaagtagccgatgtaatggtgcatgcctgtaatcccagctactcgggaggctgaggcaagagaattgcttgaacctgggaggtggaggttgcagtgagccgagatcacgccattgcactccagcctgggtgataagagcaaaaactccatctcaaaaaaaaaaaaaagaaaagaaaagcattttccagatgaatctgtcacgaaaggtgacttggtgcccataatcgttgggctctccctgtctcagtctccctgctccccatgttggtggagaaacaagcccctgcctttggggctggaaagcaggtccatgggccccgttacagaggagggtgcctctcttcctgtgggggctcctactgcagacttagaccttcccgactgctgtgtgcaccctcaaactaagcccagagaagacgcctctgactctgacttcagggctcctagggacagctggtgtcactgtgagccttggtctcttgtttataaagcagagcccagtgtgcagtcaggcagcctgcaggcgtggtgctgggggctccgtcctcgtagcatcgctggctctaggctcagggccaggaggtttgccaggggccgcagccccactgcaggcatttccctggcaccagtgcccaccccagctcattatgaagccccgagtggacacagaaactccatggtgcacaaggaagaagccgatgctcacggagaagtggggtcctcccagcccctctccccgaggcaacccctcttgacggatccttcggagtgtgtctgacatgctcccatgcgtgcacgtgcacaattcatgcatacgtgtgcacccacgcacgctcaccctggcgcgtctgactcgtggccctctctgcaggtggcagtgctggcagcacggtggcggtggccgtgaaggccgcgcaggagctgcaggagggccagcgctgcgtggtcattctgcccgactcagtgcggaactacatgtaagacacggcttccctcccaggtccctgctcctctccatcctgccacccttccctggatgcctctcacgcctcacctgagaaccggcagccagaactgggaggggaggaggccagcggggccctgtgagcaccgcctccactctcctgcccacgtgccctcacgctgtggggcttcccagcctcttaatgctgtgaaaatcaatgcacactcgcagtgacagccctgacaggaggggcatgaaagacggtggctccctctctgtccctcctgtcccttcctctctggtgtctgtccccctcactgctctggggtccgtgagctccaacgggtagccctggccacatggactgacgtcctcttgggccgggccctgtgccacctcctatccaccctgactccctctgctgcttcccccaaactccagattgggaccgagtgctgcccaggtggccccctaggacttgctgtgactgttttgcccagaggcccctcggacagtaacgccacagacctcgctggtcaccgggcagccaggctgagactggcgctgctctgcacctggtctccggaggcggtaccagggcgggtgtctacagacccccatgccctgtcccctgcacctgcagggtttcctccatggcctgcaagctgcagcggctacacagctcccgagagctcagctgcccttggagggccaggcctggctggtgggtgcccccagttgggttccccagtgtggggtgattcacatctggtgcccagggtcaagatgccctgtgcagggctcctgcccacccccgtcagtgcaagaacaccatctccccacatacttggccagcctgccatgtgtacctgtgcgtgtgagtgtgtgaggggcagagagcgagcatgagaggacgtgtttatctgagtgcctgagcgatggctgtgtgcatgctcacacacgcttgttggccatgggggcgggaagtccagcccccaggcttccccctggggcttccagccagcacttgggggtctctgctgcaccagtgaggtccaggagaggggctgggcaggcagtgcgtgccactcagcaggggcgggggcccggtggggccctgcggggactcggtgactcccccatcccgcaggaccaagttcctgagcgacaggtggatgctgcagaagggctttctgaaggaggaggacctcacggagaagaagccctggtaagaccgctcggccggagacccgctgcctgtgctggccctgcccagtgtgacaggcaggagagcactcccccgtggcctgtgctggccctgcccagtgtgacaggcaggagagcggtccccgtggcctgtgctggccctgcccagtgtgacaggcaggagagcggtccctgtggcctcctgctgaggtgctgccggcgggggtgcgagagcgtttgtccttatcctgatccccccgacctgccctcttccctcaggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcggggtcagtctcagcccctgctcagagctcagtcctgggttctgtctgcccagctccaccccgtcagtgtcactggacagggcagccatgcagaccctgcagctgggctgataggcccgcctgggccgcctcatacagacgttcagggcattggaggccccttgccggtccctgagcagcctggggcagggctgccgtgctcactccaggccctcagacctcagcccacccaccctttgtgtgcaggctgtcctgggcccacctggaggtcaggggagagatgccccgaggacatgtctgacagcagaaagccttggcacacatgcccagtgaccactgagagccccacgtcgcggaaacctgacggctggtcacccttgaccctggctgaacgggtccaaggactcttggtttctttctccccaccagggcccagactggttcctgccgcgtgtaggctcgtggcagaggacttccatgtgtggccagagagcgctcctccctggggcagctgagcgtgtgccccaccgtcctgggaggggtgaggtatgagcgctgacccctgcctgcccccgtcccacagggtaatcctgggaatggtgacgcttgggaacatgctctcgtccctgcttgccgggaaggtgcagccgtcagaccaagttggcaaagtcatctacaagcagttcaaacaggtacccagtcacctacaggcagctcaaacagatgcgcagtcacctacaggcagctcaaacaggtgcccggtcacctacacgcagctcaaacaggtgcgcggtcacctacaggcagctcaaacaggtgagcggtcacctacaggcagctcaaacaggtacccggtcacctacaggcagctcaaacaggtgcgcggtcagctacaggcagctcaagcgggtgcgcggtcacctacaggcagctcaaacgggtgcccagtcacctacaggcagctcaaacgggtgcccggtcacctacaggcagctcaaacgggtgcccggtcacctacaggcagctcaaacgggtgcgcggtcacctacaggcagctcaaacgggtgcccagtcacctacaggcagctcaaacaggtgcgcggtcacctacaggcagctcaaacaggtgcccggtcagctacaggcagctcaaacaggtgcgcggtcacctacacgcagttcaaacaggtgcgcagtcacctacacgcggctcaaacaggtactcaggcacttcgggaccccagagggtgccagagtactccagcctcgaaggcgggacaccgcgcttcccgtgtgggggtgctgggtcctcgaccctcaacaccacttaggccgaagctggctgcacccctcaaaccatgaagctgagaagcacccactttacaagtgcagcagccggagagcaggctctcatcagtgcaggctcatccacaccagccgtgttttggggacttaaggaggtcattcgcgctcagaggctgtcccgggcaccatgcggcgtctgccggggtctttctcctgcccagcctcatttgcctgtgcatgcacttggttatccaacaagagctagaacattctgggagaagcccacggtggctccttgccgggctggtcagactccgtggttgtcctgagacacccaccctctgctgccctgagggtggcccaggaaagtttgtgtgaccttccacacggatcccctgggacatgcaggtgtggctcttgacactggaaaggctgagggttctgcccaaacctaggagtgaattcgacttctttcccatctcacacacacacccgagacgtcacccgaatccacgtatttcccacgttcggctgccactgcctcccgggtgggctttgcaggacccaccatcgcatcccctctcactccacagaaaactcgtggggccatgttccccctgccactgaccacgcttcccttgcagatccgcctcacggacacgctgggcaggctctcgcacatcctggagatggaccacttcgccctggtggtgcacgagcagatccagtgtgagtggggccctgctctgtgcgtggggttctcactggggtcaggccaccaagcctggcctctgccatgggcagcagctgggccccccatcccctgcggggtgttaggggagtgggtggtgccgaccttcagtgacacccagtctttatgcctgggcctcccacatgccctgggctggtgggctgtacctgtgattcctgcagggacccctcatcaggccacactgggtagggccctttgtccagcatgcagaggctcaggagtccaggccccttgcctccggggaggccagcagtcttggggattctcagggacaagcccagaaacatctagaagggtttcaagtcctgaccctggcattcggagggctgctctgaatggaagcctcatgtgggtctcacaggagccactgatgggctgtcctcagagccccgctcccagcaagctcatgaggttttgcaactcctgagcgcatccccgggcgtccccaccacatccccacaggccaggagagtcgctcgcaggttttgggtcatagatggcagccctgggcctggggcccacaggaagagttgggaggggccctggagcctggagcctgcccacccaccaggcctgtgtgcagggggtgagcgctcggtggctgaggctggtccgtgagggccccaagtctaaccccatctcccgtccttggctctgcagcgcaggaccaggcctgggcaggcgtggtgggggggcctgcaggtaggtatcacccacccctcagaatggctctcaggctcagattcacagcctccccatggcaaatggaggccttccagggtcctggacccacccccaagcttgggtaggagggatccccctcttaatctcacatttacttgtgtttgaacatctcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctcatctgtgttccctatcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaattaaccatcacaacagccctgtctgggtatgtggcatgggagcctcggccagcattaacaccgggtctacgcttgccaggagaaagcaggaggggtgaagacagaatcaggccagagatggaagctgtgtgctgcccatggtggcaaggggtttttgtctgtttttagagacagggtcttgctctgttgccgactggagtgcagtagtgccatcatagctcgctgcagcctcgacctgctgtgctcaactgatccttctgcctcagtctcccaagtagctgggaccacaagcgtgtgccaccatgctcgactaatttatttttaaaaatattctgtagagacagggtctcaatatgttgcccaggctggtcccagacttccgggcttaaatgatcctcccaccttggcctcccacagcgctgggatcacaggtgtgagccactgtgcccggccctgtaagcgggtttgaatttcatgcccacaccggctctgaagtcatgagtgcctcaggagctcagccggtgggccagggaagggtgtgtcctgacctgcggtgggtggagcctggcctggggcccaggggactcacgtggtgggtagaacctggcctgggggctcatggggctcatgtcagaagaacactggcttggccaggcacagtggctcacgcctgtaatcccagcactttgggagccgaggcaagtggatcacttgaggtcaggagttcaaggccagcctggccaacatggcaaaaccccatctctactaaaaatacaaaaattagctgggtgtggtgatgtgcacctgaagtcccagatactcgggagtctgaggcacgagaatcacttgaacccaggaggtggaggttgcagtgagccaagactgcaccactgcactccagcctaggggacagagtgaggccctgtctcagaaaaaaaaaaaggaacacagccttcgccgctgggctccagccaccctgggcccccatggtgcacaggtgccccaggccctcaggagcctcctgccccgcagcagcccacccagcctcccacggcacctgcaaacccactgcctcgttctcccctcagaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 26 - DNA, 39013 bp, Homo sapiens
  source 1..39013: mol_type = genomic DNA
gcagcgcccaaagatgacgtgttctgccagcgccacgtcatgaggaagtgccggcccactgaagccgtggggacgcgcccagcggagctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagaggtcacattgcgttataaaactctgggtggtaaaagattataggcttagaccagtgtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggtgagcaatggcccagagcaccggttggccttctggtcagttggataatcttatataaaaacctgttattaaagttgatgatgttaagtgcaattcatgatgttaagtggaatttagcaaggaaaccaaagagtcttagaatggtaacttccaggtctacatttctggtagacttttgtcctaactctgatattttctggaagcccaggcctcttaatgtcactgggcagcctagactgctaagtattctttatagagaactgaaatttgtttccctggaacattgatccattgttccatgtactgtcttcttgatttaaataggttaatctttgatatattctttgatctgtcagtagagctgggcccggtcactcacgcctgtaatcccagcaatttgggaggctgaggtgggcagattgtttgagctcaggagttgagaccagcctgggcaacatggcaaaaccccgattctccaaaaaattaaaaaaatagcagggcttggtggtgtgcacctgtagtcccagctactcggaaggctgaagtgggagaatttcttgagcccaggtcaaagctgcagtgagtcatgattgtgccaccacactccagcctgggtgacagaacgggactgtctcaaaaaaaagagttcagaacaagactctgtctcaaaaaaaaaaaaaaaaaaagagtttgggctctagacgcagacaaacatgggtgaaattcctgttcttttttttattttgagatggagtctcgctctgtcgcccaggctggagtgcaatggcgcaatcttggcttactgcaaccttcatctgccaagttcaagcaattctcttgccttagcctcccaagtagctggggttacaggcatatgctaccacacatggctaatttttatatttttagtagagatgggattctcatattggccaggctggtctcgaactcctgacctcaggtgatccacctatctcagcctcccaaagtgctgggattataggactgagccactgcacctggcctgaaagtccagttctatcatttagtaatcatgtgactttaacaactgtagaattatcatgagaatttatgagacattaatataaagcagttagcataatgtctagcagttcttaattattattaggattgtctttcagacatttgaagactattatctcctatcttccccaaatcttccctcagctttttctctaggaatcacagcaatattatatctgcctaagacaggtttgagattggggccagtcagcttggttttgtttttcaaccacaggctgtcaagcagcaggtagtaatgaatttatgagtcagtaacctttatacaagccccacacatgctcacaaacaaatgccaagtgatctcaagcagtccaggaaatgggaagtatctccttggggaaccactgcagtggtatgtttggaagaacaagctgcataacttgaatggattttgggggctggaaaggctgtatgtgagacagaagtagaaaaaggagaagtgttgatgaggaagcagtcagggaagagccctcccaggtgaggaaaaataggctaaggagtccatttgtgttatgggagacaactcaaagctgctccaagccaaataagggttttgttttttgtggtttcttttttgagatgcagtcttactctgttgcccaggctagagtgcagtggtgcagtcttggcttactgcaacctctgtctcctgggttcaagcgattctcccacctcagcctccccaagtagctgggattataggcaccggccaccatgcctggctaattttttttttttttttttttagtagagttggggtttcaccatgttggccaggctggtctcgaactcctggcctcaagtgatctgcccacctcagcctcctaaagtactgggattacaggcttgagccaccacgtccggccccaagtaagttttgtttggctcaaaaaaagtcttttttgtttgctttgaaaaacaatttttttttttcagacagagtctcactctgtcgcccaggctggagtgcagtggcacaatctcagctcactgtaccctctgcctccccggttcaaacaattctcctgcctcagcctcccgagtagctgggattacaggcgctcgccaccacgcccggctaatttttctttatttttagtagagacagggtttcaccattttggccaggctggtcttaaactcctgacctcgtgatccacccgcctcggcctcccaaagtgctgggattacaggcatgagccactgcgcccggctgaaaagcaaaattttaataaaaatcctgatgtttggttttcttgcaagatcaccagatccagcaatgttgtgccccagttcctgtgtgtcagcagttggctagaggtcaggaattagtgcctttttttttttttttttttttttttgagacagagtcttactctgtcacccaggctggagtgcagtggtgctatctcggctcactgcaacctctgcctcccgggttcaagccattctcctgcttcagcctcctaagtagctgggattacaggctcccaccaccacacctggctaatttttgtttttgtttttttcttttttccgagatggagtcttgctctgtcgcccaggctgcagtgtggtggcgtgatcttggctcactgcaacctctgcctcccgggttcaagcagttctcctgcctcagcctcccaagtagctggtgttacaggcatctgccaccacacctggctaatttttgtatttttagtagagacggggtttcaccatactggccagcctggtcttgaattcctgacctcgtgatctgcccgccttcgcctcccaaagtgctgagattacaggcatgagccactgtgcccagccctaattttcacatttttagtagagatggggtttcaacatgttggccaggctggtcttgaactcctgacctcaagtgatccacccaccttggcctcccaaagtgctgggattacagacgtgagccactgcacctggccctatgagttccttttttctgtggaaggtaccatcttcatttgactatgcccatcaaaatttttcctggccagacacgatggttcaaacctgtaatcccagcactttgggaggccaaatcgagtagatctcttgatcccaggagttcgagagcagcctggccaacatggtgagacccccgtctctacaaaatataaaaaaattagctgggtgtggtggtgtattcctgtagtcccagctacttggggaattgaagtgggaggacctttctcctcccgaaaggtggaggttgcaaatgacctgagataacaccaccacactccatccaccttgggtaatagagtaagactctgttttgtttgtttgtttgtttgtttgtttgtttgtttgttttgagacagagtcccgctctgtcatccaggctggagtgcagtggcgccatctcggcttactgcaagctccgcctcccgggttcatgccattctgctgcctcagcctgccaaatagctgggactacaggcgcccaccaccacgcccggctaactttttgtatttttagtagagacggggtttcaccgtgttagccaggatgggctcgatctcctgacctcgtgatctacccgcctcggcctcccaaagtgctgggattacaggtatgagccactgtgcctggcctgagtaagaccctgtttcaaagaaaaaaaattttttccttttgctttctagttggagaccaactaaaccaagcctgtatttaagagcatatggttgaaagattaactctggaagcagatggacatcagtttgaatccctatttgcctcttcttaaccgcgtgactgggccgggcgtgctggctcacgcctgtaatcccagcactctgggaggctgaggcaggcagatcacaaggtcaggagatcgccaccatcctggctaacacggtgaaaccccgtctctactaaaaatataaaaaattagctgggcatggtggcaggtgcctgtagtcacagctactcgggaggctgaggcaggagaatggcgtgaacccaggaggcagaggttgcaatgagccgagatcgtgccactgcactccagcctgggcgacagagcgagactccttctcaaaaaaaaaacagaacaaaactgtgtggcttatgcaagtcactagaactctctgagcttgtttttccacctgtaaaatgaagataatactatttactttacagacttgtatgataagatgaagtataagaagcccagcatagtatttggcatgtagtacgtgctcagtaaacacgtaaataaaaataagtaggccagctatggtggctcatgccttttttaatcccagcacttcgggaggctgatgaaggaggattgcttgagcccaggagttcgagacctggttaacatagggaaacacaccatctttttttttttttgagacagagtctcgctgtgtcacccaggctggagtgcagtggcacgatctcaactgactgcaacctccacctcctgggttcaagcgattctcctgcctcagcctcccgagtagagtagctgggactacaggcatgtgccatcatacccggctaatttttgtatttttagtagagactgggtttcgccatgttggccaggctggtctcgaatgcctgacctcaagtgatctgcccacctcagcctcccaaagtgctgggattacaggcgtgagccaccatgcccggccgaccccatctcttaaaaaaagaaaaaaaaaaaaagaaaagaaaagaaaaaaggataggtaggtgtggtggcatgtgctggtagccctggctactcagcgggaggcagaggtgggaggatcacttgagcccaggaggccaaggctacagtcagctgtgatcataccattgcattcccacctgggtgactaagtgagatcctgcctcaaaataaagtaagtaactaagtaagtaaactttaatgtctttttactgagttaaaagcacaaagtacccaattcccttcgtcagggttttcatcacatagcccaaacatatcaccttggggtgtagtgtcttcctttatccctgaagaatatgagacctgttcatcatttgtcttcctattccacaggcaggcccaatgccgaaacacattgcattcataatggacgggaaccgtcgctatgccaagaagtgccaggtggagcggcaggaaggccactcacagggcttcaacaagctagctgaggtgggtgtgtatggcagagcccaaagtgaacagtctgtggagaggtagattatagctagaaaaccaggctctgagtttgctgtggttggagagtgttttttgtatctgtctctgtgttttattgtttgcttgctagctatagatctcatcttgacattggccagacgtggttgcttttgcctctaatcccacactttgggaggccaaggcaggaggattgcttgagcccaggggttcaggactagcccgggtaacatagtcagaccctgtctctacaaaaaaatttaaaaattagccagacttgatggtgcacacctgtgcccccagctactcaggaggctgaggtgggaggactatctgagcccaggaagcttgaggctgcagtgaatagagattgtgcccctgtactctagcctgggtgacagagtgacaccatctcaagaaaaaaaaaatgacattaacaaagaagtaatcatccagtgaatgaccataaaatactggaaataagaacaaaattgcctcttcttattttaataaatcaatagtttatattttatgcctcatccaatccttattgtatgctctacgtgacttaacattaataaaattgcatctgtagcttcagtaaccttattttcacttaacattttggttttgtttatttgtttgagacagtctcactctgttgcccaggccagagtacagtgcatgatctctgctcacggcaacctccgcctcccgggttcaagtgattttctgcctcagcctcctgagtagttgagattgaacacccgtcaccatgtccaactaatttttttgtatttttagtagagatggggtttcaccatgttggccaggctggtctcgaactcctgacctcaggtgatccacccccttcagcctcccaaagtgctgggattacaggcatgagccactgcacccggccaacatttggggaggcattttttaaggtgtatatataagctttctatctgtatctttcaatgactgtagaacattttatcaagaggatctgatataatttaactgctccactattacttgacattacaataaacattataaatagtactgtttcagcctgggcaacatggtgagatcctgtctctacaaaacaaaaaaaaaaattagccaagcatgatggtgcatgcctgtggtcccagctacttacgagactgaggtggaaggatgacttgaaccctggaggttgaggctgcagtgagctgtgttcacgtcaccgcaatccaacctggtgacagagcaagaccttgtctaaaaaaaaaaagtactctttttggataaattcttagaagtgacatttctggacgaacattgagtgactactcattctgctttgccaaggctgaggggtttctcaggacacaggtctttcagtgctaaaactggtgaaagtccccggcaaaccaggacatcactctacacagaggtcatgaacattttatggtataatgcatgttataaattggaagacattaagtttaacaaaagaatggaatatgacaatcttggtgaaatttttaagaagaatggagggccgggcgcggtggcttacgcctgtaatcccagcactttgggaggctgaggtgcgcggatcatgaggtcaggagatcaagaccatcgtggctaacacggtgaaaccccatctctattaaaaatacaaaaagttagccgggcgtggtggcgggcacctgtagtcccagctactcgggaggctgaggcaggagaatggcatgaacccaggaggcggagcttacagtgagccaagattgtgccactgcactccgcctgggcaacagagtgagactccgtctcaaaaaaaataaataaataaaagaatggaaatatggtctgtagttcacaggtcccagtgtcctagcacagggacacagtttgatgccagggccgtgatatttttttccttgagtgaatggcagtgaggttctcaccagaaccttgtagaagtctttacgtttgttgactccagcttctcttttgtaactgagaggcagttttgcctaatgcttaggagcttgagctctggagtcactcagaattcattggcacccctgctttgtcactgtctggctttgtgacctgcagcgagttatgtagcttccctttgcctcagtttcttcatctataaaatggggttagcaatctctatctcagtagattatttgaagataaataagatggcacaatgaaaagcatgtagcacaggccctgacctaaaggaagtactcaaaaaattgaaacttgttattagcaactgtattgactgatgtcagtggtgggttccaacccagatgtgccatccacagtggctgccttgcaaggtctttagggcctgaggctattcaagtgtcaggttctcactggcaattttcctaagatgacagtagatttgtttgcttgtatgtttgttaaggggttagagaggcagctcttcagcttgtttcttctgttctgtttgaatgtcttctgttgtctacgtttaacctcccgctctccatctctcaacattgtcctccacctctcaacattgttctccacctttagtggtacaggattagagcagccccaaaggactaagttttcttctttttttttttttttgagacggagtgttgctctgtcacccaggctggggtgcagtggcgcgatctcagttcactgcaacctccgcctcccaggttcaagcgattctcctgcctcagcctcctgagtaactgggattacaggcctgcgccaccacacccggctaatttttgcatttttagtagagacggggtttcaccacgttggtcaggctggtcttgaactcctgacctcgtgatccgcctgccttggcctcccaaagtgctgggattataggtgtgagccaccacgcccggcctgtttttttttgagttgaagtctcactctgtagtctaggctggagtgcagtggtgagatctccactcactggttcaagcgattctcctgcctcagcctcccaagtagctgggaatacaggtgtgcgccaccgcacccagctaagtttctgtatttttagtagaaatggggtttcaccatgttggccaggctgggcttgaactcccaacctcaggtaatctgcccaccttggcctcccaaagtgctagggttataggagagacccaccacacccagccagtttcatttctttttgagttataatttcatatggtgaactgcacagattttaggttttgacaattgcatttatttatctaacccatacccctgtcaagatataggacatttcctgccgggctcagtagctcatgcctgtaatcccagcacttcgggaggccaaggcaggcaatcacctgaggtcaggagttcgagaccagcctggtcagcatggcgaaaccccatctctactaaaaatacaaaaagttagccagatgtggtggcacatgcctgtaggcccagctactcgggaggctgaggcaggagaatcacttgaacgtaggaggtggaggttgtagtgagccaagattgcaccactgcactccagcctgggtgacagagcaagactccagcttaaaaaaaaaaaaaaaaaaagatgtaggacatttccatctctccaaaaaaattccctggtgccccttctcaatcaacttctgttctacctcctccttttcctctctaggcaactaccgttctgatttctgtaactataaatttgtttttcccattctagaactccatataatggaatcagacagttgaggatttttgacatattcttcaactctgagcctgttttatcatttgtaaagtaggcatgaaaacagtagtgtcattttaaagtggttgttcaaagaatcaaatgaaattatgtgaaaaccctttgcaggctattaaatgctacacagctgtccagttgttgctttttttcttttaactcagcctctcaacctaccagaataatgaagttatgctgtgagtaataacaccttgtgtttttatattgttcgttagccaccttgtaagggatggattgtgatcccatattacaggtaaggagacttcaacctagagaaattaaatgatttgattccagtcacataagtgcatgctggagtcagggactagagcctatgtctttacactctcagtgcagagttctttcttgtagtgcacaatgccatcagcattcactaagatcacatttttcagtttcttcaatggtggttttctgcttatttgatgcattaattctgacataaacactgatgttatcctagcttcacccagctttggggaggagaaaagtctgtctcctatctccaactctgagtcaggaccaaaaagtatctcttatttccccttcccactcttccttgtatcctagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtaagatgctatcagaggggagagcatgttcttccaccacccccagccttatcctaacccttgaaattctgttatctgaggcttacttaagggacttgcaactctttttaatgttagttagatatcttgggtggcaaatatcagaaatacaagatagtctttcattctttatttctaactttttaataaaaaagggggcatttatttgaggatattgaggggtgtcacatgatttaagaacaagtacagccagcctcaagcaaaactgaaaccaggaattaaacccactaggtagaacctctgtattcatttatttccacctctctctgcagaccagttttctcttgcttcaaaagagcagcctggaatcaataaaatcccttaattgggatccctaaattctatcagatttctaccccagagccaataaactatggccaaggaagtggagttaaagaaaacattgaggaagtcattttctgctgcacagtgaaccctaaaaagttactgtactccccctgcatagtcttttgggagggataggatgatgcataagagacatttatggggaagcatcagtaccattcttagctgtcagtaagtttaggcttaacttagggaataaagccagagaggggcaaagacaaatttcagtggagactgcttgcttcaaagtatggagcccttaccagccagaattgcccgaaagtcttagttacaactgttgtgtgcccagctcctacctgtaccaggaagatgagagaacagtgagcctagaactccagtgaagatgagcctagaacaatgggtggtagggagggtagccaggcttccttctgtctatattaggatggtgagactctgggctacagacattgctccccggtccccagcagagcctgtgtggctcagagtttacacctaaggagccggggatggaggcatggggggcatatcccactaatcttacctttttaaagtgtttactatatgccaggctttgagcctaaaatatattcttactcatcctgtaatcacattataccatgacaaagatattattagccaatttttagagagaaggaaagtagttaaccaaagaagttaaggcatatatcctgggtcacacagctatcagacaggcagagccaaggtgcacacctggatctttttgactccagagctgagctatcatctactacactgtgctctgagagacagaccatattacaattcctgcaagatcaaaacgcatggcagaagagatgctaatgagattgcgctgatcagttagtagtagagaaaatggtcttcgtttatcatgaagtcctggcaaaagcaagaagaaactcagaggtgcttttccattaatgtgccacagaaccccaaggtctgaggaggtgtagaaagaacctagtgggaatggggtagggggtgctgagttgcatttacctattttatgtgttgggcttctgtgtagaatttgatttgaagaaagggttctttggctaaaagaaggtgggaaaaccactggcctgattctgtttcatcagttgggaaactaaaccctagtaaagagaagaggttgagcaaggtggctcatgcctgtaatctcagcactttgggaagccaaggagggtacattgcttgagtccaggaatttgcttgattccagcctaggcaacatggcaaaaccccatctctacaaaaaaatacaaaaaaattaactggggatggtggcacatgcctataatcccagctatgtgggaggctgaagtggggggatcactgtgatgagcctggggagtctgaggctgcaatgagctgtgatcgatccactatgctccatcctgtgcaacagatcgagaccctgtctcagaaaaaataattaaaaataagtaaattaaaattttaaaaaacagaagacaagagcttacacatggtcacacatcaaactagtggcagaactataccacaagctagcaggaggagctgaatcaaggtcttctagtatactgccttcaattaatctcccattttccaaatgtgaagcattcggtttcttcatagcatttccagatgagagaagctggctgaattcattctcactgtatgcagagtttgggagttattgtatggaagcaatataatgtcataattaagaagacaagctctggaggctgactccctacgtgcaaatcctggttctccatcagctgtccaaacaaattacctaacgtccctgtgcctcagtttcctcatctgtaaaaggggaataataagggtatataactcagaggttggtgtaaggatggaatgtgttggtacatgtaaagcacttagaccaatatctggcatttagtaaacatagaatgttagctgtcaccattatcataatatttcactagaacataacaaaagtaccccataatacagctccttcccttgaggagtttactcacttctcaaatgggacaaacttcacagatacataaaatgcaactgcccaaaaaggacacatgaggtcgtgtaatgtatagtaaagagtttgggttcttgctggacatggtggctcacacctgtaatcctagcactttgggaggctcaggcaggaggatcacttgaggccaggagtttgagaccaccttgggcaacatagtgagacctcatctttacaaaaaatacaaaaattagccaggcatggtggtgcatgcctttagtcccagctacttgggaggctgaggcaggaggatcgcttgagcccaggatttggaagttaacactgaaccatgagtataccactgcactccagcctgggtgagagtaagaccctgtctccaaaaaaggggaaaaaaaaatgtagtttggggctgagcgcagtggctcatgcctgtaatctcagcacttgggaggccgagacaggcagatcacttgaggtcaagggttcgagaccagcctggccaacatggtgaaacctcatctctactaaaaatataaaaattagccaggcctggtggtgggcacctgtaatcccagctacttgggaggctgcggtgggaggatcgcttaaacccgggatgcggaggttgcagtgagctgagattgcgccactgcactccagcctgggtgacagagcaagcctccatctcaagaaaaagaatttgggttctcaaatcagacaaactgggtttcaatcctgacaaagcacttgatggctatatgaccctgggcagtccctatctgactgtcctgtctgagccttggcactgaagtaagtttctttcagagttgttgaagggatgcaatgaaataatgcatgtagaacagggtctgacacacaggaaagcactcaaaaaactggtggtcagttattacctgagcaccttgctctctccagctcagcaggggccctatcccaatgctgcctcttttccctgatcagggagaaactgcagaagcatggggtgtgtatccgggtcctgggcgatctgcacttgttgcccttggatctccaggagctgattgcacaagctgtacaggccacgaagaactacaacaagtaagttctcagatttccctatagggagctgtttcaatctttgattccctgctggctttagggagacgtcctgggctttccttggtctggattggtgcaaggggcaatgagagagtaggttgagcagcttagagactttctccgtctgcagggcacaccagacatgattctgcaataacatgttatatgtgtgtatactgacacatacacatagtttctctttcctcctttctctgcccagcccccaccaaataagtgtgtgtgtgtgtgtgtgtgggtgtgtttttacttgacagggaatgggatcggaatacagcagttcttatccctgactttgaagacagatccttcaagaaattcttgttctgttccactcctttaacctatggataggatgaccttgggaggtcatacagatgtacaggggaatagagttcaataatccaaactctgtgatgtgtagctttgaaatataacgtgtattttggcagtggacttgttttacatcaaatctccttcctattttcctttgtttgtgccaatatcacagtagagtcttcctctgaaagccggtgtacagtagaaggggagagggttaggacggcaataggagctatttggtggctgggcacagtggctcacgcctgtcatcctaggcaggtggatcacctgaagtcaggagttcaagactagcctggccaacatggtgaaaccccatctctactaaaaatacaaaaattagccaggtgtggtggtgtgcacctgtaatcccagctactcgggaggctgaggcagaagaatcgcttgaacccaggaggcagaggttgcagtgagtcgagatcacgccattgcacttcagcctgggcgacaagagcaaaactctgtctcaaaaaaaaaaggagccatttagtatttgtcttattataaaactagttacatgtttattccaagaaaacttggaaaccacaaaaaactcataatttcacctttcagaggtatccacaattaacatttgatgtgtatttgtttttctagggaaaggctggaagggcttctctgtaatcagtgacttcaatcatcagtccctgtccccctttggtaaattattctcttcttccctcctcaggtgtttcctgaatgtctgttttgcatacacatcccgtcatgagatcagcaatgctgtgagagagatggcctggggggtggagcaaggcctgttggatcccaggtatcccgagttgttttgcatggtaattgttaaggaaaacaggcctgggccagcatggcagctcacgcctgtaatcctagcacattaggaggccgaggtgggcagtccacttgaggcaggccaggagttcaagaccagcctggccaacatggcaaaactccctcttttcaacaacaacaacaaaaaagcaggcctgtaccaaaccataaagcccctctgtgccatgtacttggccagaggtctaattaggggagcatgtggaaagatttaaggggatctcccaaatttagagattaggattggcttattacaacctgcttcagaactagagttcaccacacaccaagaaaccccagagaaagagcaaagcagatgacaaagccatgttattattcctttacaaattataccctcctggccctttggtagtgtttttccaagaatgacttttcatgaatgcagtttgttggggctagagttctttaggtctctcatgttctagttccacacaagattcaggtgtttttcttttcttttttttttttttttttggtgaggcaaagtctcactctgttgcccaggctggagttgcaacctccacctcccaggttcaagcaattcttccgcctcagcctcccaagcagctgggactacaggtgcatgccaccatgcccagctaatttttgtattttcagtcgagacaggtttcaccatattggccaggctagtctcgaactcctgacgtcgtgatctgcctgcctcagcctcccaaagtgctgggattacaggcgtgagtcaccatgcccagccgattcagggatttttcaaaaagaaaattattaattattgtcaacatagtggaatcctaattattaaaggtggagagacttttgaagccatttaaatatttggtccctctcatgttattatttatgtaacttttaatatatttgtaaactaacagcaatagtaaaataatagtagcaaaaaataacccaggagatgtgttgtgttctgtatttcattaagtcattaaccttatgtgtgagagattcaaggctgttgtccattgtgtagatgagaaaactgagttcagcattgaagtgacttgcccagggtcactctactagtaagtgccagagctgggactcatatctaaagctgtttgattttagggttcttatcctttacctctattatgtgggatcttgggaagcaggaatttttctggttcccttcccgattcgattgacctaggaaactagattaaaaatcaaaaagttacttggtgagaatagaattagataaaaaggagaggagacagtttttgaggctattttatgaatgcctctccttcctaacagctgggtgacatttctctgtcacatagttcattcattcaacaaatattttatttttatttatttatttttattttttattttatttatttttttgagatggagtctcgctctgtctccaggctggagtgcaatggcgagatcttggctcactgcaacctccgcttcccaggttccagcaattcttccacctcagcttcccaagtagctgggattacaggcgcccaccaccgtgcccagctaattttttgtattttttagtagagacggggtttcaccatgttggcgaggctggtcttgaactcccaacctcaagtgatctgtctgcctcagcctcccaaagtgctgagattccaggcatgagccatcactcctggcccatttttatttttattttgagacagggactcactctatcgcccaggctggcgtgcagtggtgtgatctcggcccactgtagtctgtgcctcccgggcccaagcagtcctcccacttcagccttccaagtagctgggactacaggtgtgtgccaccatgctcagctaattctttttttggagacagagtctcactcttgcccaggctggaatgcaatggtacaatctcggctcactgcaacctccgcctcctgggctcaagcgattcttctgcctcagcctcctgagtagctgggattacaggggcatgccaccatgcccagctaatttttgtatttttagtagagacggggtttcactatgttggccaggctggtctcaaactccccacctcaggtaatccgcccacctcggcctcccaaagtgctgggattacaggcgtgagccaccgcgcccggcggttttagacttacgttacagtggatagtggtgcccttcaccatgctaggtaaccctgagagaaaatccagttgaaaagggtcagcagtttggttttggatatcctgtacatgttgaacagagatgtcaggtcaacagttcagcgagggattggtatagtcaggtcaacagtcagacagagatgtcaggtcaacagttcagacagggtttatctctgtcgccagtatggaagccatctgtgtataggttaacttgagcaaagaggggatgagaaagctaaggagagtctgtctgtctatctgtgtatttatctatttagagatggtctcacactgtctcctgggctggagtgcagtggggcaatcaaagctcactgaagcttggaactcctggtctcaaaggagcctctcaagtacccagtactacagacgtgcaccacctacccagctaactttttatatttattttttgtaaaaacagggtctgactttgttgcccaggatggtcttgaactcctggcctcaagtggtcttcttgccctggcctcccaaaatgctgagattacaggtgtgagccactcagccctgcctgttaaggagtgtagagtgagaagaagaaagagcctaagatggcatttttgaggaactctaccctttactggctgggtagaggagaataagctttataagcaaaaacacagaaaagcaggaagaaaaccagggcagccagcattacataagccaagaaaagagggagtttgttggtgcaagttgggaaggggtagggcacccatggaaacaatggtgtcaaatgctgtagagaggtcaattaagatgtagagtgaaaatcagctgttgttaaaacaattaagagactggtggagttagcagaggtagagagcaggcaggaagatgagacagaaaaggggtatagaaatagaagcatgttttcaataaaattcttagtttggaggtactttcgtagttcattatatttttgtgctttataatgaatatgtttcaaatattcttgtatgtatgaaataaatattaaggcacaagggttgacactagaatgaaagaaagccatttgacaagcagatctaatatgcattatgcctaggactctgatcttgactcctagtccagcatgctttaccctcataccacattacagtaaccactaccttatctcctgcttcttgtccagcaagtttttccatatccttctctgtcctgcatggtttagtaacttgcctctgtggggttagttatgcagacagggtgtgggttgggcagtatcaccagggtcaggaggccaatgtctcaacccaccaactcctgaagcttggtgtgctcagactgggctaatcagggcctgaggcgttacactttatattattcgaatttagacaaacctgcatttataacaaagtcagtgcgttaattacaattaggtcctatgcttctaatagctggaattttcctgatttctcactatcaccatccaactcctcatttttctttcttccagggtatgtatgtagatgtgtgtgtgtgtgtgtgtgtgtgtgtgtgtgtgtgtgtgtgtgtgtatttttgtttttttgtttttctgagatggagtcttgctctgttgcccagggtgaagtgcagtggcacgctctcaactcactgcaacctccaccttataggttcaagcagttttcgtgcttcagcctcctgagtagccaggattataggtgcacaccaccacacccggctatttttttttctttttttttttttttgagacagagtctcgctctgtcgcccaggctggagtgcagtggcacaatctcagctcactacaacctctgcctcccgggttcacgccattctcctgcctcagcctcctgagtaactgggactacaggcgcctgccaccccgcctggctaatttttttatatttttagtagagacgggtttcaccatgttagccaggatggtctcgatctcctgacctcgtgatctgcctgcctcggcctcccaaagtgctgggatcacacccggctattttttgtatatttagtagagatgggatttcaccatgttgaccaggctgatctcgaactcctgacctcaagtgatctgcccaccttggcctcccaaagtcctgggattataggtgtgagccatagcacctggcctgtttcgttttgtttttgagacagggtttcactctgttgctgaggctgaagtgcagtggtatgaacatggctcactgcagcctagacctcctgggctcaagagatccttccacctcagcttcctgagtatctgggaccacagatactgctaccacatctggctaattttttgactttgtagagacagggtcttgccatgttgtccaggctggtctcaaactcctgggctcaagtgatcctcctgccttggcctcccaaagtgctgggattacaggtttgaaccacggcacctgaccgaggtatatatgtatttttttagcagttaaattaatagattgttttgtgagtctggaaattatagaagaaggaagtagattgagaccaaaggatagttaataaattctattccaccgtgttaccttgaacgggctacttgattccctgtaggcctctgtctttcttataaaacaatagtgttaatagtaattgctaacacttactgagcatttactctgttccaagcattaagtattccacatacatttatccttagaccctataaggtagatactgtttttatgcccattttaaagatgagaatactgagacatggagaggaaaagtaacttgtgcaagttcacatagttggcaaacctgggggccaagatttcaacctggcttcagagcctgtgttctcattcactgtggcatattgacttcctcatagcaaagctgaaatgaacaataaggcagtaaaaaagaaaaaaattagatggacatggtgacttatgcctgtaatcccaggactttgggaggctgaggcaggaaaatcgcttgagccctggagtttgagaccagccctggcaacacggcaagaccctgtctctacaaaaataaaacagttagctgggtgtgctggcacacacctgtagctacttgggaggctgagtgaggaggattacttgagcctagcaggtcgaggctgcaatgagctatggttgcgccattgctctctagcctgaacaacagagtgaaaccctgtctgaaacacacacacacacacacacacacacacactcacttttgacataaatatttataacacatgaaatcacataatgaatagtttacactctgaatcatgcttttatcattcaatgttacgagtacttttcatgacccgtgtttttaataattcttcatatcattatttataatggctgtaaaatatatcttgtgttaatttctttaaccagtcttctatttgttgggtatataggcagtttaatatttcattattacaaataatgccacaattaaatctttgactgaacttgcctgcattttttattgtttcctcaggatctgagtttgaaagtgctcatttcaccttattcttgccaagattttttaaatgtaaactgttctgaccaggtgcagtggctcatacctgtaatccagcactttaggtggctgaggcaggttggatcgcttgagctcataagttcgagaccagcctgggcaaaatggtaaaatctcgtctctaaaagtacaaaaattacctgagtgtggtggcatgcacctatagtcacagctacttgggaggctgaggtggaaggatggcttgagcccaggaggctgaggctgcagtgagccaagatcacatcactgcactccagtctgggtaacagccagatcctgtctcaaaaaataaaacaaaaaaataaacctattctcataggtaaaaactgatattttaccgttatttaatgtaaatcatttccgaaaagtcttcacgtagacagctttaactcaccattccatttagtgatggatttttgttggccaaagtctacagatgttccattttgattttgtcagtttcatctttccaccctagagttaacccctttttttttgtttttgagatggagtcttgctctgtcacccaggctggagtgcagtggtgcaatctcggctcactacaagctccgcctcccgggttcacgccattctcctgcctcagcctcccgagtagctgggactacaggcgcccaccaccacgcccggctaattttttgtatttttagtagagacagggtttcatcgtgttagccaggatggtctcgacctcctgacctcatgatctgcccgcctcggcctcccaaagtgctgggattacaggcgtgagccaccgcgcctggccaacccctttgtttttttgagacacagtctgctgtatcactcaggctggaatgcactggcacaatatcagctttttccattaagaattctgcccactgcagaattcttactgcatacctactgcctaaagtaggtagaagaaactctttgcagataaattgtaaactcagagagactgagtctctgaagtcacactgcaagttggtgggactgaaaataattttttattattattctttatatagcactttatagttcccaaagtgcactcaaatctattatttcatttgatttgaccctcatgataacctataaggtggataggacaaatgggccctgtttttttttttcccttttaattacatttattttaatgctgaatttactcctgtgccataagtttttgtttcttcagtttctttgggatatcattttcttctgggcaacctcctcttctggtttaggaacaatctgttccttttcagtaaggatcatctcaatgtggcagggagagctcatggatgggttaatccaaccatgagctctgtaggtccagcggcacatcttaggtgctttgttcacttggatatgctcaatgaccagagaatctacatttaaacccttaagttcagcattactctctgcatttttaagcatgtgcagcaaaaattcagcactctttttgggccactgaccttgtgtccagccccactgcttggcctgggcacacctgccagctccaccattgtaacgtcggaatggtacgcactgtttctgtaaagtgacatctttcaggtacttcatggcttttcgtatatgcatacccttgatggcctgggcagtttcacgaatattcttaaagtaaacacgaagattggaacctcttgatttgcatgatatcatgaggttctccgggttaagtgaatagtgaaccattttcacagattacctcaggccgcttagggaaagagcaaatgggcccattttaaagataagagaatgagaaattatatggattgtacagagtctcacataacttggagaattaagaccatgctgccaagacaagattgtcagattaccagagaaatctgaaccagagcccttcttattgctcaattataagtgaatactgtttcctctgtgatgatgatacggaaaagaaagctctctctgtggtttgccttaaaggactgagagagatgagcaacttggctgggtgcagtggctcacacctgtaatcccagcactttgggaggccgaggcaggcagatcacttgagctcaggaattcaagaccagcctggccaacatggtaaaaccccgtctttactcaaagtacaaaaattagccgggtgtggtggtggctgcctgtagtcccagctacttgggaggctgaggcaagagaatcacttgaacccgagaggtggaggttgcgggagccaagattgcgccactgcactccagcctgggtgacagcgcaagactccatctccaaaaaaaagatgaataacttgcctaaagacacacaactagtaagtgtagagtctggttttgaacactcagcccagatctttctgctttcctgaccatgcgtccagaaacatgttcccaccaagaaatttttgtcttctggaccctttccaagatgtaactctaactacctggacattctgaattctgcttctgggtagttggtaggacaggtaaacagcattcttggagccaacagacaccagccatgcaaataccctctttctgtggacaggatagttttacttaagataaatgcttccactcaccagttttcttcaattctatctcctttctgaccatctctgtgcttgggaaagtagctcttatcaaacacaggagaactgatcatattgctgtttatttaaaatccggtgtaatgtggaatttttgcaatgtttcaggatccatatgacttaaataagattttaaaaataaattagctgagcatggtgttgcacacctgtggtcctagctacttgggaagctgaggtaggaggattgcttgagcatggaaggtggaggttgcagtgagctgagatcacaccactgcactccagtctgggcaacagagggagaccctgtctggaaaaaaaataaaatatgttttctgtttttttttgttttgagacagagcctcgctctgtcactcaggctggagttcagtggcataatctgggcttactgtaacctccacctcctgggttcaagcgattctcctgcttcagcctcccaagtagctgggactacaggcatgcggcaccacacccagctaatttttgtacttttggtagagatggggtttcaccttgttggccaggctggtctcaaactcctgatcgcaggtgatctgcctgcctcagcctcccaaagtactgggattacaggcatgagtcaccacgcctggccaaaaaaagttatttacataaattcaaacaataacagaagtacataaagtaaaaagaaatagtcttttcttccttacttcttatccaatccactgttaatagtatgatgtatctttttagactttgttctttatgtatacttatatgcacgtgtgaatgtttgaatgtgtgtgtatgttttatactatatattctctgaaacttgccttttacatttaacattagattttggacatctttccaaatcagtgcatttagatttatctttatttttagaatgcagttgcatagtatttcatcaaatactgggccataggatgtatgtatgtattttaaaaaacaagatgtttttagcaaaagacaacagatatttttgtgggtgcatctggttttaggcctgaggctaaatgactttcagcaaattattcatctttgagcctcagtttccttatctataaaatgaggatagaaataccttatgtatctgctgagcatggtggctcatgcctgtaatcccagcactttcagaggccgaggggggggcggatcacgaggtcaggagatcgagtccatcctggctaacatggtgaaaccctgtctctactaaaaatacaaaaaaaaaaaaaaacaaattagcagggtgtggtggcgggcacctgtagtcccagctactcgggaggctgaggcagaatggcatgaacctgggaggcagagtttgcagtgagccgagatcgtgccactgcactccagcctggggaacagtgtgagactctatctcaaataaataaataaataaataaataccttatgtatcagaacatgtcaaaaaaggcaaaaaataaaaaagagaaaagaattttacattgtattctctaaaaaaaaaaaaaaaaaagaaataccttatgtagttgtgaagatttaaattcattcattaatttagcaaacattttttgagggccttctgtgtagtattggctagtgtatttgatggtattgtataaactgagaagcctatatatggaagttcaccatgagaacactacagaaagagaatactacaggatgtgtgcctctctttgtctcttcttgctcatcttagtgatatctctgagtctctgcttgataagtgcctctataccaaccgctctcctcatcctgacatcttgatacggacttctggagaagtgcggctgagtgacttcttgctatggcaggtaggtcatttccaagtactattatgtttgtgtcatggggaaaccaactgtatccacagaatggatcagagtggtccatccccactcccaaacaggctggggccagagtacttctggggaaagctaaaatctggagaagcatctctaggctgtgtctcataatatttgatgtccattcctcatctgtcgctggctttgcgaatccaactatagtgaaaacttcattgtgccgcttttcaaggaatgggacttctgtcttgcatccctgagcgtaagctcttgccttggtaacctgccagggaccctagcccctctgggttggaagcttgccttgcagttactagtccctccccttcaggataaagggccatacctatgcaagcatggtaaacaatatgcaaacactcaagtctctatcccctgttaacttggtccctggagagcacataactaggggaagtccttgttctgggagagactccatttggaagcagctcacatgataaagctccagaaattttaatggaccacaatcttaaaagtgagctaacgcagggcgtggtggctcacgcctgtaatcctagcactttgggaggctgaggcaggcagatcacttgaggtcaggagtttgagaccagtccagccaacatggtgaacccctgtctctactaaaaatacagaaattagcctggcatggtggcaggtgcctgtagtcccagctacttaggtgaatgaggtgggagaatcacttgaacctaggaggcagaggttgcagtgaggcgagatcgtgccactgcactccagcctgggcaacagagtgagactctgtcgcaaaaaaaaaaaaaaaaaaagaaaagaaataagtacaatgtgcacctattggttctgtggcccactgtgctgctcagatcacgtttgggaagtttactgatgggctgaattttaagagactacagagtcagttactcagtgtacagaattagttacattgacaaacttgaggacttactggaagaggccaaactggaaagcaaggaatctcatgtcttacaaaaaatgaggaaaggatagtggtctgcaaaagggaaataagtgacaatgtattcccttggaaaaaagtgttgagttccttctttatgctggaaatatggcagtgagtgagtcagaaatgatccctactgtcttgaaacttatagtttgctagcaaagacaaactctgaacaagtcattacaactttgggaactgataacaggcagctctaatctagccttgaaatacttgaaagaatgtcactttgaagaagaaacaaacttgttccagaaaaaatacctgggaccttagtagaagttgtagggaaggtgacattggtttagcataaaaagccaaacaggctatcggacaactagttatcccccatgaggtactgaattcctcaccactagagatatcaggcagtggctgtcaagagtgttccaaaggggattcttcatcagtgattattattaaagtacacctggctctttgctatgcatatgttatctcatttaatctaaacagtaccctgaaaattaggtattcctattatccagttttacatttgaggaatctcaggccaggtgaaattacccctgctcaaataaatggtaaatggttggagccaaaattcaaagccaggcagtctggctccagagctcatgctctcaaccactgtgccctgctgctggtacttaaaaataacaatggcagctaccatttgttcattggtgacctttatcagacagtatgtcttccagatgccctctaagggccaagagccaataacataatccagatgttatttcatagtcctaaaattggctcttagaaaaatcctggtggaaatgttgatctagtctcgttttagttctgctttaccacaggcaggtgatctggctgcctcaagtgacgcctccccctactagtgaatgaatcagggccagcagcagctgcagctacagctcaggatgcctgtaacattgtcatctctgggcttctgggtcctgcttagcctgctttttccctggaggactgaccagggatgcggcccagcaacatgttactaaatcatactctcctccctacctttcccagacctctcactcctgcctggtgttccaacccgttctgtggccagagtatacattttggaacctcttcgaggccatcctgcagttccagatgaaccatagcgtgcttcaggtaagaaagagttcagggctggccagatgggatgggatggaagaaaagattagcattgattgacaaccaccttactatataccaggcacttcctaataagatgatgataatgatgatagtagctaccacctactgagtatctactacttgtcaggcactgcgaacattttacatgctgcaactcatttaatgttcccaagaacccaatgagggaagtcttattagcccctcccttatgtaagtaagcaaacagaaatgatttagttaaggacacataatcagtaagaggtaggaataggatttgagctacaggtcttttatcttttaaagactcaggaggaaaaggcttctcagagaaactggccattattcctttaaagtattaccctaataaaagatcgtagcagtagggattaagaactaaatagcattgtctttccattgtgtaaacctatgttgtgtcaagacttgaagtttgactttcagttttcatcaccaaatcttgaaacaggttttattagcagtcacctgtatatgattaggtctctttataataatggtagtggtagctaacatatgaggatctacgagggcacttaggtgatttcatgtaagttttcttatttaacctaacaacccagcagttttggtgtcctcatttttcatatatggaaccagaggggcagagagacttaagtaactgtcccaaggaacctgaattttatctttatttatttatttattttgagatggggttttgctcttgttgcccaggccggagtgcagtggtgcgatctgggctcactgcaacctccccctcctgggtttgaacgattctcctgtctcagcctcccaactagctgggattacaggcacacgccaccatgcctggctaatttttgtattttcagtagagacagtgtttcaccatgttggccaggctggtcttgaactcctgacctcaggtgatccgcccaccttggcctcccaaagtgctgggattacaggcgtgaagagcctgaattttaaaatcaaagctggtgctgcttcttcagtctggagagataatgccaggaggaaataatgatgtgagtcagggattcttaatctccttggtattggggtccctttgaataatctaatgaaagccacagaccatctccctagaaaaatcgcagatcactcaaatgtggaattttgcatagaattgtaaacttatcatggaaacacatagaatactttttttttttttttttttgagacggagtttcgctcttgcggcccaggctggagtgcaatggcgcaatctcggctcaccgaaacctccgcctcccgggttcaagtgattctcctgcctcaccctcccgagtagctgggattacaggcatgcgccaccaatcccaactaattttgtatttttaatagagatggggtttctccatgttggtcaggctggtcttgaactctttacctcaggtgatccgcccgccttggcttcccaaagtgatgggattacaggcatgagccaccaagcccggccacacatagaatactttaagggggttcacataactgctgaaatctgcccctgaatcccaagtccataactcctgctataagtaaatcaaatcacaaagacttgatcatgtatttaattacttagtctcagaatatgaggaaattaaaagaagtttagaattagtgaaaagaaaaacagcaaaggcacaattatccactgtcagtggggaatgaatatcagatttttccatatgaccaaagctccctctaaaaactaaaactttacccttttttgatggaaaaatttctaaaatgtatcttgtacataattcattgaaatctatataccaggcacttgctaataatgatgatgattaggataatcacgtgctattttttgtttttttttttttttagcagggtctcactctgttgcccaggctggagtgcagttgtgcaactttggcttacttcagcctcccaagtagctaggactatgggcacacaccaccatgcctggctgatttttgttattttttgtagagataagtcctcactatgttgcccaggctggtcttgaactcttaagctcaagtgatcctcctgcttcggcctccccaggtgctaggattatagacatgagccaccatgcctggccgtcatattctaatgattatgataatagtaattatcatctttaaacacttcattgtacaacaatatccttgaggggtagggctgtttgctctaagttagatggtcccagaatacctgggtttgaggtttcatgtatatttttctgtgtcctccctctttcatttcctactgctgtcaacagttaattttgacagtatctctcctcttccatagtatttactgttttaaatcagctatagacaaggaaaccagatagtcaagcttgttggaattatgtatataaaatgagagtgaactggctctgcatgaagcccaaaggagcttggtgcatgagtttttgtgtttttacctctaattgggctgctcagaagtcttttatagtaatttcacgtttctcagatactttgcatatggttgtcagaggagttaactcaagtttcattcattccataagtatttattgagtagtatgaatcaggcactgtattaggcacaggagagtcaacaggtagccagagggacaagatctctacctttgtggaacttgtattcttgaggagacagaaataaacaagtaaacaaatatataagttccgattgtaataaggcagtgaagaatacagagtgatgtgctagaaagtaatgaagagaatgcaaagagactgaggttaaagtttgggtcttggaagaacaaaaaagaggtcaatgtgccaagggagaagggcaggaaatgaggctagagtcagaccttggctcatatagagccttgtaggtcatggtaacaaagctgaaggactttaatcaggggatgacgggatctgagttgcattttgtaaaaatcattcagaattttcaacgggctggagttaaagccaagagacagaactcctgcagtagtccaggtgagagaggatgcgcctcgaggtagggtggtggcagtagggaaggggaggagtgaagacgggataaaaacaaatgttgaaatagaaacaagtgaaactagctatatcaaggtgataatataactccccagagaaaggaattaattcagcttacctgaacacagttctctgctattcatctttagtggaatttcttttcaggataatacaaactgcaacacaaaattaaacattacttaagaggtttattgttagtggcaatgttggtaatgtaattatgaaactcttgtttctttttttttgaaatggagtttcgctcttgttgcccaggctggagtgcaatggcgtgatctcggctcactgcaacctccgcctcccaggttcaagcgattctcctgcctcagcctcccaagtggctgggattacaggcatgtgccaccacatctggctaattttatatttttagtagagatggggtttctccatgttggtcaggctggtctcaaacccccgacctcaggtgatctgcccgcctcggcctcccaaagtgctgggattacaggcgtgaaccaccgcgaccggcctgaaactcttgtttcttgtaggctaaaacaaataagtacaaataataatgttattaggaaccaagacacttaggttgtggccatagcaattggttgtatagttctgctgtttcctgggatggggtggaaggtgtttgaggtcaactattaagtgttccatttttacctatggatcatatttgcaaacttttttttttttttttttttttttgagacggaatctcactctgtcgctggagaacagtggcatgatctcggctcactgcaacctctgcctcccggattcaagcaattctcctgcctcagcctcccatgtagctgggactacaggcacgtgccaccacgcacaactaatttttgtatttttagtagagacagggtttcaccatgttggccaggctggtctcaaaatcctgacctcaggtgatccacccaccttggcctccgaaagtgctaggattacaggcatgagccgctgcgcccggcctatatttgcaaacttttattgagttcttaccacatgtcaggcatccttccagtattgagttcttaccacatgtcaggcatcctttcagtaaattctgtgaactgctttaaggcagatactattattattgcctctgtttttagagcaaggaatccaaagttataatagagatactgattatcttgaagccttctccagcaggagcccttggaggtcctggccaggctttctctaccccagaagcttcaaagctctgtttctagaaatcatatcaccttggcagatgcactaaggggagaatccagactaacagcatcctcaccagtttgttctcagaccagagaggtctttccaggcttttctcatgtctcccttttacagaccctgtatcatggccaaactggactcttcccagttacctgttccatgccctccagtttcctacctgtatgtctgtgctcttgccccatcacccaaattcccattttaaaatctgagctgctctgtctctaggccctgcccaatgtgtccctattctctgcaggaagccagggcaaggggctaggctctggacctagagtagcttactgagaggaaggcagcgggtggatcgtaagggaagcagggacttggctacaagttgtggggagccagaccttggtatctgaatggaccatgacagtctccaggtggtcacctagccagtcttaaaggctggcaaagggagatcttgactatgatgcagtaggacttgtcagcaaagaggcagggacaaatagagaatcaggccagggagggggtgtgcggcagtgcagagcagctgatcctcaatcacaagttgcatggatggtaggtccttgagaggtcactgatggagatgagtaaaaagtgttcacctcatctccaaggatgatattagagagggaaaagacacatgttcccacgaagcttcctgtagtacatttgtcacaatttaaacgggctggattgaacattatatttcttctgctcttcaggttgtcactatcttctcctcaggataaaagcttgagttatgtatgtatgcatatatgtatgcatgtggaaatggggtctcgccatgttgcccaggctggtcttgagcagctgggctcaagcgagcctcccaccttagcctaaaagcttgagttaatgtctcagacattcatgactttgaatattggcactgcctacatagctatatgactgtacagttacttaacccctcagagtatcattttcctcacctgtaaaatgagagaagtagcgtttacagtaatacctaccttgcaggtttgtgatagggattcagtaagctaacacatgtcaagtgctgagtgcagtggctggaacagagttcattttccaagaatggtggccaatattgttccccacatgtgtgtctcttggcctctcctcagactcctctctggaaaagcaccctgcacatcctgtccccagtacaactccccaggcaaggagactctgagggtgcttcagaacatcatgtttctggtaggaggtgcccttctctgcctgagagcagccctcagaaatgcattcctcatgctgctgacctgggctggctggttgcagcttggggaaggacttttcattggctaatgttttgaagccaaggacctgcagcctctctccaggtgccaacagagtggtagaggacttttagatttaagtactggagggactattacatcttgttctctgattctaccaaggagagaataagagcagagagggataatgcccaggaggaatttagattcataggttagaaccacatttctcaaagtgagcttcttggagcccttgcaccaagattggataaggtctgtacaaaaagtctctaaggaaagaattaacgccctcacttaccctgattggtcattatacaaggatagtagacaaatggtcagggagagaaaagttgacctctaggacttctgttagcttggatttcccaagggtaagtacttgagaagaactggaaacacctctgagattgaaagggtagattcagaccatgtggaagctggatagacaggtatccagatacaggccaccagcttttccacccctagaaagtagagcttatacacaggcacgagatacacttcacattgtcctctcaagaagttatcttagtggagaagccaagggaacttcagccatctcagcctcgctgtcattttctgtaaaatgacgagcagacaccctcccaactctgctatctgaacaatgaactgctaattcctggcagacaggggccaggctctgcctgggctacagcccccattgctggcatgcactctgatgccatctggaagaagcttgcgcctcatgaagtggctttagctagctccatatttcctccctctgttgctgagcgtcccccatcctttctgttctgccagaaacttagactacttagcccagtccacaagtggcggtgatagaacagctaacagttaatagccaagcagtaggctgaaaattcattatctcatttttcctcaaacaacccagtgaggtgggtactcttatcccggttttgcagagtaagagagagccttagagaggtgagggaggccttaggaacttctcaaaccccagtgctccaggtggacttactctggccttaacaggctcttcggttccatgcatctttgctcattactcccactgccagaatattctccctgccccccacacacctcacctctgtttgaatcctcctcattggttaaagggccagctcaaattctgtctgtccatgaaggtcactgctccgtgatgttcatcagccacacttgctttctcctctgaactgcatgacccttaccacatcctattttgcatcgtggcactctgtgtgcatggctgtacaatcagcctgtaagcacctggattgctgggatcgtgtcctgcgcatctccatatcctcaaaaaaaatcctgtatgtagcacccagggagcctcctgaccaaggcctggaagaagcccttccagcaagacggagagctctacggcaactgttcaagcccgaagtcctcatagctccacatgtaattcattgtaatagcagaagagaagtattcttgaatgcctgggattattcaggagccgggggggacagtccagaattctcatttgtcatccttattcatgcagtaaacctttattgctgagagacagcaaatcagttccctgctccatgtctgtctccagcagaaagtacctccctcacagctccattgtgagggtcaagtgaggcaacagatgaagtggttgtgcacatgtaagatattctttaaaccatgaagacagagcagtcaaggtgcttacaggctgattaggacaaaaacatgtatacaagtttatcgtaatacaaggtagaatgtgggaagggtcatcagggtataggataccataggaaaatagagtttctcacacatggaataggtttggcaggaggagctctagtgcaaaggctttgcaggtcagttagactggcaggaacagagaggatcagtgaggcacaggaaagccttggttctgctccaaagggattttccgctcttctgtatcaggagcatcctcactgctctcctgggatcacgtggtcagtcagttgagtgtttcacatgtacagggcaccccaagtgctggagaggaagaagcccagtctctgccctctagtacttgggatgataactgctgccagggagtatgatcaccacctggtgtcagagctggttgcaagaggcttgaaggctctcaaacttccaagggcttattttctaacagaaagagtggattgtgaacactaacacttattctactatgcagaatgcaataagtggcttaagagagttgaacctgcttctcagaatgttcataggggggtcatttgctggaaggatcaggctggtcttcatacaggaggcaagtctggagctctgaaaaatagcctagggagtggggaggatggtaccctcagaggaaaacctggggagatcaaaggaagtgacccaagggacatgtccccgacaagaataggacctttcttgcagcggagaatagacaataacaacttgtaaaattgctgtttctgtctaagagcctgctaatatcctagagaggattttgcatatgttatctctaatccttaaaaccactcttcaaggtaggcacaacccccactttacagatgaagaaatgaggttaggacaggatttgcccaaagacacaaagccagttgatgggggaatcagaagtcagacccacatttgtttggttccaagagcatgagaaaaactttaagaagtacagacgcttccacacaaaacaaaccaagatggacccagaattgccactgccctgcctgtacaacatgagcaccacccactgcatacctactcccaagccttttcaaatctggtacctactttccactgttccacttcacttggcccaccctgtgccccaccccctacctcctccatcccagtttcacccactcctaaaaatgatctccccaccccaatccccacttttctctagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 27 - DNA, 34457 bp, Homo sapiens
  source 1..34457: mol_type = genomic DNA
aggggaggggcggggctcggggagtgaggcaagactggagggcctgggactctcgggtacccgggccaggggaggggcggggctcagggagggagggagagactggatgacctggggcttgcaaggcggggcgaggggaggggcggggcgaggggaggggcggggctcagggagggagggtgagactgtggaggacctggggctcgcggggtcggggcaaggggaggggcggggctcagggagggaggagagactggaggacctgaggcccacgggggcggggccaggggcggggcggggctctggaagggcgggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacgtgagcagtggggctttggcgtccgggcgcggggagggagtggagtggagtggagtggagtggagtggagtggagtggaatggagtggaatgaggggcgggatggaggcttgtgccatttttctcttaagattcgttccgtgagagtgcctatgggctcgagtcccgcctcgtaactttctagctgtgcacgttgtttaacttttcagcctcattgtccgcaggtttgctgagaattaaatgcaaaatgaaatgaatcgtgtcactctcccagacaagcagagcaagcaggattctgttaccggaagctgcagcacacaggcatgctgcctactccgaggtggttgcggtgtgtttctctcgcccaagaggccaggtcagggctggtggttcatctcgctggatagcccctaaccctagaacccgggaaatgataacccggtatgcgtagcaggtcagaggggcacgcgcgtttcttggcttagagttgtgagatctaagatggcaagtgtctctgcctatagctgaaattctttcagctcctggtgtgggctccctggcattcccctactgatcagaagaaagagggcagggaaacaaactttgactaagtcagtgtagtctgattggtagaaagaagtatttgaaaactgggggtttatcagcaaatagataataagaggttccctaggttggaaaagcagattcccttggatttgttgatgatatttttggcttagatttctgctcccaactttaaaggtaaactcctgattcatctctgtaagccatagaaccccagaatcaggaaatgtttgctaaacgaggggcctggcagttggcttcttcttggaaagtggggttccctccttcccccatggcttgtcattggatgcaagtggctggccttttgtgggcctgtctgcggtaagtgctttggtctagaagagtcaacttgtggtttcacatctggccgggctgaccagatgttgcaaggatacagaaagtggacactcaatcccctggaggacacaatctgaggcacattaaatcttaacttgtgatggccaacaacctttctgcagacagagccctccctctgccctcctcaaacactttgccctcggcagatgtgtcctccctcacctttcctgggagcacaaatccattagacagaaacatttgtgagaggcaggcacaccccagtagggagctctgacttgctttctcaggggaatcgaattaatatccgttagagtgtggctaggtgttttcagacaccatgtcccgctgtttcaacatcagaatgtgcagggcagccactacagatgtctggaagagagagccccattccgctgtcctctgatacagtgctgggggtggagagttggccctttggccttccagctgaacaagcctcttctgaagctttctctgcaggcattggacattccaaccgtgatggctgccttgccaggcaagactagttgccaaggcaaaacctcccttcccccatgtcagcagtcagcctttcctaatttgagtggaataacaatgaatcctgccatcactttattcatttttttttattcagcgaatgcttatgaaccccaactctggtccagattttgcctgggctccgagttggcatcaaagacacaggagacgccttccttccatttctggttgatggactagtaaggtgtacaggggtgctctctgtgaaggtaggggtggtggcctctgagaacggggttgtagtagtgtggagctggttttgccgggtgccttgttaaagtccccgtggtctggctgtgctgctgcctcctggcctctgctttctccagccacattggctgcctttgagtctctgagatgtgctaagagcagcttcctgccttcaggccttagcacatgttgttccttctgcctggaatactcgtccttctgctctctatatgcttggccccttctcactctttgggactcagcttaaatgtcacctcctaagcaccctctctgaatgagctccccgctgcggcccagccttggttatctctcaccacaccctgtgtttccttttgcttctggagagaaggaaccacgtcactgttcccagggcctcagcagcctttgtgtaatgctggtactgagaagatgctctctaaatctttgtggcatgaatagcgtctaccctgtgtctgttcttgtggtgagagatttacagatattaattaaattctcacaataaacctactgtgaagttattgtccccattctacagatgaggaaactgaggtccagagaggcaaagcatcatgctccagatctcacagccagtaagaggcagatatggggttgatccccacatctgtcagcctcccaatctgtaaggtccagccctacggggcttagcgggttttctccctgtgtgcggaaacgagagattgtaagaaataaagacacaagacaaagagataaagagagaacagctgggcccggggcactgctaccactgagacacagagaccggtagtggccccgaatggctgggcacactgatatttattgcacacaagacaaggggggcagggtagggagggtgagtcatccaagtgattgataaggtcaagcaagtcatgtgatcatgggacgggggctcttccctctaaggtagccgaagcagagagggaaggcagcataagtcagcattttcttctatgcacttataagaaagatcaaagactttaagactttcgctatttcttctaccgctatctactacaaacttcaaagaggaaccaggagtacaggaggaacatgaaagtggacaaggagcgtgaccattgaagcacagcaccacagggaggggtttaggcctccagatgactgcgggcaggcctggataatatccagcctcctacaggaagctggtggagcagagtgttccctgactcctccaaggaaagggagactcccttttgcggtctgctaagtaatgggtgccttcccaggcactggcgttaccgcttgaccaaggagcgctcaagcggcccttatgcgggtgtgacagggctcacctcttgccttctaggtcacttctcagaatgtcccttcagtacctgaccctatacccaccggttattcctaggttatattgtactacaataaagagtaatattaaaaactaatgattaataatgtttatactaataatcgataattgtccatgatcatctgtatatctaatttgtattacaactgtatagcagtatagctacagtttatgccttcagtctcttgcctcggcacctgggtaatccttcgcccacaccaatcccatgcttccccctctatgtcaggctgggagttgggtaatgctttcctttggacaactttatatcagatatgaccaactattttaaaacaaaggcaatgcacattcattctcttgaagttagacaaatgcggtctccctccttagtttgtttccctcaagttgcagatgggaaactgaggcccagagacttgtccaaggtgataagatggtgaatgagggagcagacttggagcccaggaatcctggatctgacctgtgagccccctctagttttgtgctgaagaaaataactcccaaggttgaaagtagagggactcactctctcagactttttctgggtcctcaggtcatagtttgaagcacaagtttgaagcttctaggctttgtttgcatttgaggcagcaggcagctgcacttgtgaccccattttggaagttgcttactggtggtgactccttcttgccttcagctggggtgtggggaccagggtcagagatgtggtccaagggtctgccctgcacattccctgaatggaaagccacttggattcaggtggttcagctctttgcctaaagcagatttgccattttcaggaggggaagactgaggcccagggagttggcagtggggctgagaatgagtaactaagctctccaggcagcctcttctagggtaggctctgctgggacctcagatgaggagtatggctctggtctaccccgattccaagagctgacatgcgtggagaaatggtcatcttttctcagcccaccccagtgagcagccaatggagataaggccagccaataatcccaccactaagctcgctggcactgaaatggccaagctggtggttcaggagagctggaagcctggctcaggacagagccctgggaagttgagtctgcaaacatgccctcgggttcttgttgacgagcaaagctcagggttgtggggacaaagaccaggacttaacaaatatttaagacatctttgttgatgctgggattttgtggtacagaaaggaacttgccttgcatgttctgagcagtctggcttcctgcagctcccttacaacccgagctctcctccatttgagctacaacagagctcattaatccaagccacctggccctcagcactgtgtgttgggcactcatgctccaccgcacaactgaactaccctagtcaaggcctagaaacctggaaaataatccaacatcctggtaaggtggtaagctcctcatcactggaggcatttatgtaatgcctagggaactttgcaggggtctttgcccaggttaagtggctaggaccaggctgactgctcttcccccagtccaagggatatttgatttctttcccattcagggaacacagattatttttccttttagttctggaagcagagatggcacaagggagctggggcaggatgctgagaacatggttcttcagtccgctctgcatacagggccacctaaagggggacctgtggactcttcaatagataggctttctgagtaaatgagccaagcccagccaggggctttttctggtgctgacggtgtcgtcttcctcctagccaagaccgaggataggtgtggccattggcgaccagatcctggacctcagcatcatcaagcacctctttactggtcctgtcctctccaaacaccaggatgtcttcaatcaggtaggacattgtgaaacgacttgtccctgacctcagtggcacttactgtggatgccaacaagagaatgctccttgcgttccatttccgatagaggtaatgccatcgaaggtctcagaggttatacttggataaggctggggttgttttgagacagacaaactggtaggaggtggccttgggacaattcagggtggcttctcacctcagggcgagttcctaggtgaaaaaagtgtcagtgtctgcagtcctgggtcgttcctagttgtctatgagatgaagctcttcaggaactctggttacttttcttgtcaagctgtttgagcctctgcctgtccaagggctgtgtgggcccccaagggagggagctacgagcccagccctccagttctgtggaagcagctacggaggagtcagcctgaagtacatgttcacatgggatggacatgaatttgcttccctgtaaatggtcatctactttgatatagcatcttctcattgcatgggtcaggaaggagggtgggatttatgggtacctcttgtgtgccaggagcttcgcacacatcctctccttcaatcctcctgaccaccctctggcataggaattggaattcctatgggggcctgagcatctagatggggacctgaacttctggaatgagacatggttttcccaagctgcacagctagaagtatcagagctgggactggaactctgactcttagaacctacaagggctttttctgctatgcttcactggctataaaacctcttccttttttaaattaaaaaacctctcggctcacgcctgtaaccccagcactttgggaggccgatgtgggcagatcacttgaggtcaggagttcgagaccagcctggccaacatggtgaaaccccctctctactaaaaatacaaaaattagctgggtgtggcagtgcacgcctgtaatcccagctactcgggaggctgaggcaggagaactgcttgaacctgggaagcagaggttgcagtgagccgagatcacatcagtgcactccagcctgggtgacagaatgggaaaaaaaaaaacaactttttttttttaatagagatgaagtctcactatattgcccaggctgatcttgaactcctgggctcaagtgatcctccacctcggcctcccaatgtgctgggattacaggcatgagccatcacacctggcccaaaacctcttcttaactgatgtgaaaggaattagtttaggctgtgatcactctgcagactggagtgtgcctctactggaagaacatggccaccttcaactgtgggccgggccaagcttagcacagttgctgtgccaggtagcaactcctgggcttggacaattgtgtgcaggtgcacgagggcctgaggcaacgtcaagagaggatatgcttttctccaggttgatgaataaatgacaaaactaagagcagaggtcctgagagtttgagttagcgggagagaagtggcaagggctggcaggctggctggccttccattggaaggagggatactccctgggttttcctgtacgtgatcttttttctccctgttttggtcttagcctacactcaacagcttcatgggcctgggtcaggctgcctggaaggaggcgagagtgttcttgcagaacttgctgtctgtgagccaagccaggctcagagatgacaccgaacttcggaagtggtgagaagcacgtggtcataggggggatgaggggatgcagcaggggaggtgaaggctgtgtggttatcagtgccattctgagtcacggcttggcagccttagtgtggccaagtcagacctgccctcatccagcccctgcctgagctgcctattgatgggagggctttgggaggactgggattgccttggcgcctggaatggagctgcccaagctaggccaggccaggcccattggccctctctcttactcaggctgtcctcattagcatcatctgtgacctcatctggtttctagagtaggaaagagtttccacttgtctagtcccatttcctagggtagaatatagaaacggcttcagtgggtggatgtcctctcagctgtgaaaggttcagcatagctctggccccaggccagccagaaggtgcccactggagattgtggataatcttggggatggtctgggctgagcccgtgggtgggaccgcgctttgctgcctacttgactttgaagcccctggttctgtgtttcagtgcattcatctcccaggcttctgccacgatgcaccttccagccaccataggtgagtgcagtctcttcaccaagataagaacggagcagcttcgtgggccaagagggctggccaggtgctttggttctgcatctgtgtggagggtccctgctggtggggggagatggaggaggggctctggggctgttacccgctcctcatcactgacctttcccagcatccaggcccggcattcactcaggctattatcttgcctcaggtagtgagttgcagactgctcaagttcatgactagccgcatggctccctgcacagcaaattgctttccttcccccaaaggctatgggacaaattctctgagctcagtctgtgagtcagcagttttgaggatagaggccagagggctatgaagggccccagtttgagcacgtggcaggatgtctggttggagtgtcattcaggaagttggagctgttgaaactctcaacctgaagcagagagagaggctggctcagcctgcggcccaaagcacagccctcttccttgtgcacaggtctcctctgctgggctacctgggcacctgtgagctgaggggccagttgaccctgcccctggggtacactgcctctctggaacagctcctgctgtccggggagagtcctttgctgctgggctgcttgggctaagctgactggaggatggggttggggacaggggccgagtcacctgcctcctcccagcccctctcactccccactctcatacactcatgggactgtgctatgttttggcaaaccagctgttgtgcaaaccatatgtctttcagggatatcatgtctggttgactgatggtgccctttcttgtttttttttttttttgttatggatttattcttttgaaaaatctctcagctattacttctgtgcaatgggactgaagatgggaagcagcagctaaggctccacctgccctgtggactgttcttcctctcctcacccttcaccatgactgttgctagtctaggctgttggtattgatgaatatccagcattttttttttttgaggagacatttaggaagataaaacaggcagactgtcccaactggtttttctttcagatttttaattctccgaatggtagatatgcctacagcttgctggctagcccattcagttcatcataatcaacaagcactgatatgcatctgcagtgtgcaagcccttgtccttggcactcgggcagagtccaagaaaatgaggactgggctggggctgtcctggaatgtccacagtctagcaaagatgtgcacacacataactggagcaccagtgggaagcgaagcctgccccagaaggattcaggggaggggatttggagggggaagagatcctgctagagagagcagggagggcttcagggaggagcgggcctcaaagagttgccaggatttgaatacacagggacaagggagaagtcaatcagtataggcgtggtgagggagcctgtgggaactcgggaatggcagttgtgtgtgggaaaagtggggagcctgagaagggaggtggtatcagccacttggtgttcacattccactgtcagtttcagaaagtctggactcctgatttcttatttgtttctcagctgagggctctaaaaacaaatcttcagtgaggatattttatattgcatttggtgctgccattgctggctgcaggctgagctctggatgtgtaaacagtattgtgtgcacactcgtggctccagtgcttggaacagtccattcttcctgaggcatgtgggttgctgatgggatctgttgggtctttcctctgcaggagactacacagacttctattcctctcggcagcatgctaccaacgtcggaatcatgttcagggacaaggagaatgcgttgatgccaaattggtatgaactgggccaaatgtctgcataagttcaaagtctttcttttcatttccagcagcatatttgtctcaggagctgccaagttcttcttaaagtaaactggggaggaaaagcagttatgatgttgcaacctctggaagcagtggtctcagcttctggtctcctgctcagcttggcttaggacttgctgtgggatcgaagggcaagtcccttaaacttccttggacagcaggggttggaattagattcccttaatccctatgctccttctggagtctttcatttataagctgtgtattattgtactatgggcaagtcttagactctagcatgctccatacttacattttctgatgaatgagaatcctcaaatgtgcccagtgctgtatattcctcaacatgtgatcggtttcattcatttgtttgatcctcgtagtagttctctgatgtcacaaggccatgattgtaagccccattttacagacaggaaaatgggctcagagaaggatcaacttgcctgagcacaacagggccacagcctgtctcccagcccccagatcaggccattgaccaagctgaggatgcagagctgggatccttgccctttgttctgtgttgtcccctggatgtgatggttccttggaactgaagagggcctggactcagtggcaggcatacactccaggccccagtgccatcagtcacacacaggagctgggttagggacggggctttactctctctcgagtgagtgtctccagtaggctatgccatgaggggagggtctgttagaaccaagatgaggaagaaagaaagggagagagagcagttccaagccagagatgttgaacaacaaggccaaggttgcagaatgaggcaggggtgaatctgagaccagaacccaggctccaggttccaggcttccacgtgagatgcgcaaatatttgagaatcttgcactgtacaggctccaggctgtatttgtccccagccagcttcaacttgtctatctgatgggctgagtgtctatatgagtgtccttggcagtgatgacccagtggactgcccagccccagaagagctggctgtcacctgtgtgccaggatcccagtggccaaagggcaggggcaccaggaagtgagaggagagccgggacctgggaaatgagtgttgactgtgtctgaaaccgagtgtgggggccgcagccatccttgccccatgtccttctgcagaataagagtaaacaggccttctctagccatgtttgatgcaagatggcccacagctgtgactttttagctttatgtacatagtctttattataaaggtaacatatatttactggaattaacccaaacactacagaaaatatgtaaacatttacaattaaaaatgtgtctactctttgacctgcaatgctcactttcatgcatctatcctacagaaataaaagcaccagtgggttgtatccaagagcaaggatgttaattagcagagtttctagtggcccagaactggaagtaatctgaatgcttatcggtggaggaatggttgaaaaattggtctattcacaatatgaaatgttttgcagctagtgaaagatttagatcaagaaagatgtgcactgatctgtgttaagtgaaataggtaaactataggcaattaggtaaagtgtgtctcacttttataaaaaaagcacaaaaaatatatatgtacatacacactgtattagttttctgttgctgctgtaacaaattaccacaaacttggtggcttaaaacacaaatatattctcttctagttccggaggccagaagtcaaaaatcagtctcactggctaaagtcaaggtgtcagcagggctggttccttctggaggctctaggagagaacccatttctttgacttttcagctttagaggttgcctgtatcccttgccttttgaccccttcctcatatcactccaaccacttgcttctgctgttacatttcctacttcctcctttgaccttgcctctgtctataaggacccttgtgattacatttagggttcactcaaataaccagggacagtatccctatctcaagatccctaacttaatcacacctgcaaaactctttttgccatgtaataatatccacaggctccagggattaggatctggatatcttttggagggctatttttcagcttaacacacacacacacacacgcatgtacacatgcacacacacacacttatgcatacattagttccataggccggtatgagcatagagaaaggcaaaaaatattagactccagattaacattgctttcctcaggggagtggccgggtggggagagattactaactcctttttttcatctgaattgtttgaattattacatgccatgtaattgcatgcaatggaattttataatttaatccaataaaggaaccaaggtgggtaaaaaagggagctcttcctcagccactcaccagaggcaactactttgaacaagttggatgtgccgcttcctgtactttgctccaggttacacatgcatgaccacacgtatgcacgcatacatatgcattttatttctttagttaacaaaacgagggcatgctgaaatttgctttttttacttcatcattgacatatctccatgtagataagtttaaatctatctcagtcttttacaaaataagttttttggggtaggtaatacaagacaattacacagtaaaatatcatttttataaaaagatacaaaaatacagtacagtagggctgggcgcggtggctcacatctgtaatcccagcactttgggaggctgaggtgggtggatcacaaggtcaggagtttgagaccagcctggccaatatggtgaaaccctgtctctactaaaaatacaaaaattagcagccaggcgtggtggctcacgcctgtaatcccacaactttgggaggccgagacgggcggatcacctgaggtcaggagtttgagaccagcctggccaacatggtgaaaccctatctctacaaaagtacaaaaatttgctggtcatgatggcgggtgcctgtaatttcagctacttgggaggctgaggcagaagaatcacttgaacctgggaggcggaggttgcagtgagctgaggttgtgccgttgcactccagcctgggtgagagagcgagactccatctcaaaaaaaaaaaaaaaaaattagctgggtgtggtggcgggcgcctgtagtcccggctacttgggaggctgaggcaggagaatcacttgaacctcggaggtggaggttgcagtgagctgagatcacaccactgcactccagcctgggcgacagagcgagactctgtctcaaaccccaccccccaccaaaaaaaaaaaaaggtacagtaataaaagtgtatagaaatatagggaaatgaggaccatgctggtttcctctagggtgaggggcaggaagggagggaaggagagtgagaccagggagggatcccaaggatgcattggactggataagtgaactgttatttctttagctccttggtggtgcatggtgacttgtgttattacatgtttttgtatatcataaatattacaaaataatttatcaaacatttaaaaaattaaaagcaacaaaaacagtcaatatatatatacatggttgagaattcaaaaggtacttaagggtaaacaatgaaaaaaacagaactcaaccacctatgggccaccatccagttcccttctccagagacaaaactgttaatcggtgtcatacatatattttctttttcttttttttttgagactgggtcttacttggtcacccaggctggagtgcagtggcatgaccttggctcactgcagccttgacctcccaggtgaagccatcctcctgcctcagccccctaagtagctgggattaaaggtgcacaccaccatgcctggctaatttttgtattttttgtagagatgggttttcgccatgttgatcaggctggtcgcaaactcctggactcaagtgatcagcccaccttggcctgccttagccccacaaagtgctggggttataggcatgagccaccgtgcccggccttcttatatattttttcacagatgtttttgcatactctgccagtttatatatacagtcatttctctattattagtttacaagagtgttttataagtgatagaaattaaccctttgttgcaatgcattgcaaatattttctcccagtatgttatcttttttctttgtttgccagtctttctagatacagagttttgcattttctttttttttttttttttttgagacagagtcttgctctgtcgccatggctagagtgcagtggcaccatctcggctcactgcaagcttcgcctcccaggttcacgccattctcctgcctcagcctcccgagtagctgggaccacaggtgcctgccaccactcccgcctaattttttgtatttttagtagagacagggtttcacctgttagccaggatggtctcgatctcctgaccttgtgatccacccgcctcggcctcccaaagtgctgggattacaggcctgagccaccgtgcccggcctagagttttgcattttcataaagtcaggcatgccaatcattttccttatggcatttacttttgtgtaatgtttagaaaggctttctccaccccaagaatttggaagttttttgtgtttttgtgttttttttttctagtgcctgtaatagcctttgtttgtacatttagatcttgaatccatctggatttccttttatgtgtgaggtgtggtatgggtctgtatccatttcctggggctgctgtaagaaaaagccacaacaacaggaatttatcccctcagttctggaggccataaatctgcaatcaaggtgtcagtaaggccatctcctcctgaagcttctaggaccgtccttgtccttgctgcttccagcttctgggggctgcaggcgttccttgtggctgcatcactccagtctctgcctctgtcttcacgtggccttctcctcctttctacatcttctcttctcttctgtctcttataaggacatttctaattggatttagggcccacctggataattcaggatgatcgtgtctcaaaattcttaacttgattacatgtataaagactctgggagttaggacatggctgtatctttttttttttttttttttgagatggagtcttgctctgttgcctaggctggagtgcagtggtgcgatctcagttcactgcaacctccacctctcaggttcaagcgattcttctgcctcagcctcccgagtagctgggactacaggcgtgcaccactatgcctggctaatttttgtatttttagtaaagacggggtttcaccatgttacccaggctgttctcgaactcctggcctcatgtgatctgcccacctcagcctcccaaagtgctgggattacaggcgcgagccactgcacccagcccagaattttcttcctttttgaggctgaataatattccactgtatgtatgtaccacagtttgtttatccattcatctgtggatggaaacttgtaagcacctgttgatttttgagccatgtgtatgtggcgactctttgtttctagtttttgaagtttttaaagttaattgacaacatataacagctctgatgccctgcattctcttgccttcctttctcaggctgcacttaccagtgggctaccatggccgtgcctcctctgtcgtggtgtctggcaccccaatccgaaggcccatgggacagatgaaacctgatgactgtgagtgaccgcagcgtccaggccttgctggtacccagctctctgttcccacacagagagttctgtggcctcactcacagcaccgttttttttttttttctggtgttattccagctaagcctcccgtatatggtgcctgcaagctcttggacatggagctggaaatggtaagtgagcttgatgttttattgccatgggatctatagacacccggcaggagagccctttgggatggctccccgcaccatgagccgcccactcccctcctcttcagccacatcggcagccgctctgtgtccccacctggccatcagaaggacagttgatccttattacttgcagattctgtatttgagaattcacaactacttgctaatatttatttgtaagtccagaattaatattcacagagcttttgtgggcatgtgtggacatgcgcagggcagtgaaacatttgagctgcctggtgagcatgttcctaggtgaggctggacaaggtgttactctgccttcttgtctcagcttatgctgtaaacatgtgtcctttgtagtctattcggtgccatgttttttgcagatctgtgcttttttggctgtttcattgtttttttataatgaccccaagtgctgtgctaaagtgccgtctagtgtccctagcacaggaagactgtgacgtgccttatggagagaatatgcgtgttagtaagctttgttcaggcaagttacagtgctgctgcctcagctcaatgttcatgaatcaacaaaatatattacataaagcatttttaagcagaaacacacataaaacaggctatatagttaggttttgattagttgataaaaattttctgaccaaaggcttgaaggaacctaatcctgtgtttcctctaggaagtcattctatatttgctaattctgtgttcatggtgactttataaaaaataattacctggccgggtgtggtggctcacacctgtaatcccagcactttgggaggctgaggtggatggatcacctgaggtcaggagttcaataccagcctggccaacatggtgaaaccccgtctctactaaaaatacaaaaattagctggggatggtggtgggtgcctgtaatcccagctacttgggaggctggggcaggagaatcgcttgaactgaggaggcggaggttgcagtgagctgagatcgcgccaccacactccagcctgggtgacagagcgagactctgtctcaaaacaaaaaacaaaaaacaaaaacccaaaaataataattaccacgagtgacaagagtcaagtgtatcagccccatggctgggcccatacaacctcagaactgtggtcactttaggctgcatacttttttatttgttttttgttttgttttgttttgttttgtttttctgagatggagtctcactctgtcacccaggctggagtgcagtggcactatctcggctcactgcaagctccgcctcctgggttcacaccattctcctgcctcagcctcccgaatagctgggaccacaggcaccttccaccatgcctggctaattttttgtatttttagtagagacagggtttcaccatgttagccaggatggtctcgatctcctgacctcgtgatccacctgcctcggcctcccaaagtgcttggattacaggcatgagccaccgcgctcggccagggctgcacacttttttaaattaaactttttattttgaggtcattgtagactcacatgcagttgtgagaaatagtacagagatcccaatacccttcacacagtctcccccagtggcaacatccttcgtaaccatggtgctctatcacaacctggatgttgatgttgatacagtcggtcccaccacctgaggatccctcatgctgcccatttttcagaggggacactgaaatctgggcagcccccaaggtgaggggaccagggaagtgatggaaaggaggagctgacctgggggaggcagcgctccggggacctggcagggtcttcagcatctgctgggttgtctgatgcccaaggttggagtcagtctccgtgtgggaaatgcagacaggcagatggagggggctttcccatagtcagcacctacagttttaggcgttgcctcaggaagctctgagtgcctcatcactgatggtgtagaagaagctgtcatggggccaccgagtcaggctgagacagtgggaagccctggttggtggaggcaggctgaaaggcccgtctgcttttctggagctccctgtctctcctgggcttccctgtgatttctctggattcagtccagaggagggaaatgagtgggcactgccgaatagcccgtggatagcagggcattccctgccagccctctgcctcctcctgccttagcaagggtactatgtgagactgcgggaggaggacccccagctgagattcatcagagcagggcatctgagccctggtttggggccatggtcttctctctgggagaactaaggactctgcaggcagacacttcacctgttgagagggagagagaaaagacagagagtcagcatgtggagaaatggttggggcagagagcccaggtcacctggactagtgcttttgggttctttttttcatcttgatgaaaaatttgcaatgtttaactattgtcacagaacaaataaaatggtgactaagttttgcaaatgtcatggctgagtctatgtttttcaaagagattttcccaaatttttctttctaatgatgcctggctagtctgctggttcatggacatcacgttggtgctgtttttctttagaggtagtgggatgacagataggggttagaggccgtggggtgtgctctctctggtactatttgctgcatgaaggaggcagtcttttggtttttcatttttcattaaaaaaatttattttttattttttatttttatttttaaattttattattattatactttaagttttagggtacatgtgcacaacgtgcaggtttgttacatatgtatacatgtgccatgttggcgtgctgcacccattaagtcgtcatttagcattaggtatatctcctaatgctatccctccctcttccccccaccccacaacagactggattaagaaaatgtggcacatatacaccatggaatactatgcagccataaaaaatgatgagttcatgtcctttgtagggacatggatgaaactggaaaccatcattctcagcaaactattgcaaggacaaaaaaccaaacactgcatgttctcactcataggtgggaattgagcaatgaaaatttttatttattttatttttttattttttgagacagggtcttgctctgtcacccaggctggagtgccgtggcgtgatctcggcctgctgcagccttgacctccctggctcaagcaatcttcccacataagcctcccaagtagctgggactgcggacatgtgccaccatgcctggctaattttgtttattttttgtagaggtggggtctcactatgttgctcaggcttgtctcaaactccgaggctcaagtgatccttccacctcagcctcccaaagtgctgagattatagacgtgagccacagtgcctggcctggtttttcatgacatgaatacaaaccctgatagtttcagttttacaagcctcatgtggctgtcaagtcttgaaaggcaaaggctgtatgggatgaagaggaaagagcagagtggcctgggatgcactgaagggaggggaggctgctttggagctcaggggagtggaaggaaggccgatggcgggggcagggcacaccactgcactctgctttcctgaggcgtccatctgacctctgacttagaaacacagtggattcatgccaggcccctgtggcagtcctggtccatggctggagtttggaaatacctgacctttgctctctaggtgacaagtgacctgggcggcagatcagctccagattctaatgaactctcccccatgtaaggctttttttgtaggccctggaaacagattgggagagccgatccccatttccaaggcccatgagcacatttttggaatggtccttatgaacgactggagtggtaattactggagctctgctcctgtagagatgacggggaggaggctggggacttggggcaatttcatagaagctgaagatctggtgcaggtcaaaagtggcaggtgatgcagtgactgagagtgggggtctgggtatcaaacagactttcagctctaagaactcgggccactcacttaactcctctgagctccaattttctcgagtggctagggacacggctgacatcataactaatatttactgagcacttatgtgtcaggccctgtgcttaacacccttcgtatattctcccgctgatccctacacggtatgtgcaatattatcttcccattttacagatgaggaactgaggcacagggagatttcagttagttgctgaactaagatttgaagcaaaacagtccagcttctgagcctgagctctcaaccctttgccatacgtgggaggaagatggcaccataagccccagaaagtgtctctctcatagtttgagaatgagcttccagccccttcctgggagatatcctgaccaccgtttggtcatccttctctttgctgtaacctggcacagtgccctcaaaggacctctgtccttggcattgaatgctcttgcccctttgtcctggggcagcctgactggggctgatctttgtggagatggcagtgctaggtgtctctgctccttggtcaagggcaggagggggtcgttgggagatgccctgatcagcctttgtaagtcctggctgtgcccttcttctgcagcacgagacattcagaagtgggagtatgtccctctcgggccattccttgggaagagttttgggaccactgtctctccgtgggtggtgcccatggatgctctcatgccctttgctgtgcccaacccgaagcaggtaagcacattctctgcaggaagctcccaaacccagccctgctgcctctgaggctgcttgcccactgagtggacatgccaggcatgcagaccatcaggagggaagctctgtgcccacggcatgcccacagcagagtgcctgggagttcctggccacgattacttccaggcagccagggcatcattctcccttgtggtttccctggccctggcacagttcttggagaaaacacagaattttgtaaccttaagaatcttgcaagacccgggggatctggccagttggcaggaggagtccctgcaggtaccaacattgcacaacctcccaggtggccatcaaatcttgttctgtgcaaatggcgccacctggaccccaactcatagaatgcagcttggagcccagcaacagggagtccctgcagcctctggttcccggcaccgcttggtctaccactgggtctaggccttgacccctggttccagtcctcccttctcagcctgttgcaatctgccccactccatcactggcaacacctggccagagtcacctgtgacccgatagtcagtgtcatgaccttgtgtccccttcagcatggacttcctgtggcccctcactcttgttggcattccctcaccccttggtttctggcatgtgacctgtcctcgttctccagtgtctctgagtcctcacgatgcccctctccaattctgacctccctgtggggatccaggctgagctcccagccatttgcacatcctcgcttgagcatctcaccacgcatttgctgggggcctctaccaacacccggtgctggtcctgcacccacactgctctcccatgctcctctgcctctggggtcatctcatgtttgctgtgctacaaacaaccctgaggtctttccttgcaagccagttctagtgaagtcctgtggggctttcaccctcatcccttgctctctcctcgctgctccctaccacagcaccccctgcccaccctggtcattttcagtcgccaggacttgactttctctctagctggcagcggccttgtctagtctccctagggctgcaaggccacagcctctctttgcttgtcctccagtcatctgccttcttccgggtcggtcatcacagggttttgcctgccttcctctgtgccagcccttccccaacaccatttaggtacaacactactattccccctctgaactattatttacttaatgttttccttcagagtggctcccagtttaaacttaatatattaagaagggaactttatattcctactggcatcactagctacactgtttcataaccattagtatcaccaaaaacgatctcatgtcccgtgggtgactcatgtaccatgctttggaaaacactgcttttggccggagtgcaggcgttctggcccagccatccaagctgcctccctagctggctccagcaccagccagggctgtctacttctgttgtgacccctctgccttccaggggccctgcaatgcgctttcaggcccagcctttcctcacaggccaggctttgttctccatctcggcctgtctgctgcccaccttccctttctctcccctcctgtggctttcaggaacatctctggtttggctcctgtgacctttgacctgctgatgccccttccttggctgcatttcctagagacccacagtatgatcccccctactgctatccagggacacagtgctgggtccctggagagggaatgctcctgctgtctcagaccctctgcctaggggagcaggtgctgctgggggcctggctggtatgggggcccagccgggtgagctcagcccacctgccagtgacctctgtgctgtgctttgccctctcaggaccccaggcccctgccgtatctgtgccatgacgagccctacacatttgacatcaacctctctgttaacctgaaaggtatgttgtagggggactgacatggccaggagctctgaggcaatgtgtgcctgtgtgccttgtcctgaaggctcctgagctttggcaagggtgagggcacgtgctacagccctggagatgtgtgtggctcgtctaaaggaaagaggaggggaggggaggggacaccctggtgctcactgggaacctaactgggcccatagggcattaaccctgtcactgagctctcagtggtagggctgaaaggatggagtccgggacttccatcttctgcttgaatcccctccccagcctctccaggggctgcctggctcctgctcacatatcgccactgaccctcacttccgtggtgggtggcacatttcattgagtgcctgtttgaaagcatgtccttgtgggtctgttcgcttggctgagcccctggggccacacagagccagcgcatcaagaccccagattcccaccatgggccagccctgagtgtcttgcagacagacccgagatccccaccctgggccagccctgacatagacagggcccacatctccctgtggctgctcagcccgcctccgcgaacaggcccaatggggcgttggtaataaagagactggctctgcaggccatgactctgctgctcagctgtgggactttgggcaagttgccaaacctggccatgtcctcatttgtcatctatgaaatgggataatagcggcgttgacctcatggtgtgttgtgaggaccaaacatgtcaattcatgcaaaggtctgggacagggtctgtacctagaaagagtcaggtgtcattttccaatcccaacgggggccctcggatggggagggtttgcctggtggccacacacagacctcctagccacactctggccaaatctcctttttagctccattccattcctttttcttttcttttcttctttttttttcccccgagatggagtttcactcttcttgcccaggctggagtgcaatggtgcgatcttggctcaccacaacctctgcccctgggttcaagcgagtcttctgcctcagcctcctgtgtagctgggattacaggcatgcgccaccatgcctggctaattttgtatttttagtagagatggggtttcttcatgttggtcaggatggtcttgaactcctaaccttaggtggtctacccacctaggccttccaaagtgctgggattacaggcgtgagccaccatgcccggccagctccatttctttcttctgtctgctctgtctgtacactccaggctttgccatgtctgtctcactgtcagttccagggtctcggcccttcatgaggtggttcctgtcaggaggcgcagtacactgcaggagctgtcgccatgggagcaggatgctccatggagaaagagctgtcacagagagcctcctggctgcccagggccctctgggaagctgtgctgggcccgctctttcaggttccaggtcaggaagctgaggctcagagaggaaaaggattcaccccgagccacctacctggctaatggcagggctgggactcaatccaagtgtgtcacaagttctaggttggcctcctgccacccacaatgcgtgcttggagtatactttctatctggttttgtcctcagtattcctggctgcctagaggtgaacctgcccgcccgggggaggccactggtagaaaagggacaagattatccagaaagcacagtgtccagagatgtagtcctgcatttgcagttctgatgttctgagttgggatctgggcgaaagggtctggggaggagcagccttggcagacccagacctcgcatggctgaagagcacacctgttctgtgccacctcagaggggaagttaggaccaagggaggaagccaggttttgagggagcagaggagctttctacttattagtgctgttcagaagtggaacggcaacagcccggtaccttgcatgtagtagatgtttagtaaatattgtttagtacgttgtgaagtagcacactgcccatcactggaggagctcggcaggggacagatgacccagctatccagaggactcctgaggggacagcaggttatccttgatcaaaggtcacaagtagctttcaaatggcacactatctttagtggatttgcgggtgccaggatcactgtgttaagaaggattctgaggctacatatggactcagagcaaacatgtgctgtgatcaattaatgctgcctgctgtaggcgtgggaggaggaagtgatgacttgtgtgcatgtattggccaaccctggacctcccagctctgatgtcctaggagctaattgtttcacagactctaagtgaaatcatgttggacaatgggaagcttcagccacagaacaattctttttttattttcctccctgatgcatggaattaagttttcatcaatattgcttttctttccaacaggagaaggaatgagccaggcggctaccatatgcaagtccaattttaaggtaagctttgacgctgatcagactgctttttagaattgagggaaagagagacttttcttcctggcaggaacaggaggagagcattccttttgggatatgatgatgggtcagcctgtgggcctggagcttccatggcctgtctcttttaggagtggccatggggtcacagagttctctcgagatagaggctgcataaatgtggccagtgattttcttgggggaaaataggtgttcctgtaaaggtctagttcctggtttatcctgtcctgccaggggctgtattgatgagagtgacttattttttaagtgaacttttaattgaagcataatatacatagataaaaatgcacacattactgtaatcccagcactttgggaggccaaagtgggaggatcgcttaagcctaggagtttgagaccagcctgggcaacataatgagaccttgtctctgcaaaaagtaaaaaaattagccgggcgtggtagcatgcacctgtggtcccggctacttgggaggctaaggcaggaggatcgcttgagcccaggaggtcgaggctgcagtgagccatgatcacaccactgcattccagcatgcgtgacagagcaagaccctatttcaaaaaataaaaattaaaaaaagtgcatattatacatgtacagcttgaagaattttcctaaaatgaacatccctgtgcaaccagcacccagatcagaaatggaaaatttccagcacctcagcagccccgtggggccctccaggtcacttcatcactccctccagcaaaggtcactcctctcctgacctctgctaccatgtattattttttttctgtttttcagttttatagaaatggcatcataaagtagcatgtattcttttgtagctggcatctttgttttagtgttagatctgtgagattcaaccctgttgctctttgcagtgacagctcatttttctcattgccttatagtgttgcactgtataaatattccacaactgacttaatttttttttttttttgagatggagtctcgctcgttgcccaggctggagtgcagtggcgcgatctcggctcactgcaaactccgcctcctgggttcatgccattctcctgcctcagcctcccgggtagctgggactacaggtgcccgccaccacgcccggctaatttttttttttgtatttttagtggagatggggtttcaccatgttagccaggatggtctcgatctcctgaccttgtgatccgcccgcctcagcctcccaaagtgctgggattacaggcatgagccactgcgcccggccaactgacttattttgtaagtcacatcaattccacaatcgatggacatttggttgtttccgttgtttttggctatcacagagttactgtgaacattttagtacacaccttttggtgcacatatgtgcacatttctattgagtgtatatccagtaataggcttgctgggtcatagagtacacatagactcagcctaggggtacttccaaacagttttttgaagtggttataccagtatatactcccactagcagcatgtaagcattttgcctgctccacatcctcgtcagctctggtggtgtttgccttttcgttcaaaccgtgcctgggattgtgacttcagtttgcatttccctaatgactaatgcagctgggcatgttagtcatatgtttatggttcatttgtttcttggccttttgaatatcctctgaatcattgaactatttctagtttccctaatttcccttctaatttaatattattctgggctccttagggctagtaagaagaaattaaggggcctccttgcaggggctcgtgggcaagaatccatcttttgggtttcctatgccgggatgtgtggctgtaggaatggcaatgtgagaagctgtggcctgggacaggcatgggcgtgcattgcatctgagcgtctcggtgggcacgtggtgccttggccccctctgcccacagcctgaccgcccacagctctccctcgctccttggcctgccctgacatcgtgtttgaatcgttcagctccattgcccagtgtccatcccaaggcccggcatgggagaatgggagcgagggctttgctcacgagaagcctctgctgtggtgtggacttagattctcccaatacgggactggagggtgttcccagggcagagtggagtgttgtacacaagggcatgttgcaggctgagggactgagcagtaaggtcagcccttaggggatgctgcttggagaaggtggtcagtgtgggcttgaggtagcagaggagctgaggttggagtttgtgaaggagatggaagagcttgggggaggtctctgggcagctccccaggaggacaatgtgtccttactataagggactggagagagctggctgggggagctggggaccggggaaaggccagggaaggcggtcgtgagcagggcaggctgtgcccagctgcctccgggatgctaggctaagcctgccgctgctcattccacctcgcgtccattgcctgcagtacatgtactggacgatgctgcagcagctcactcaccactctgtcaacggctgcaacctgcggccgggggacctcctggcttctgggaccatcagcgggccggtgagtatctggctgcactgagggctgcccacgcagagcatccctgctccccacacagccccaagggccctcagctcagcctcgagaagagatttcaggcccgaggtgggtgtatctcacaactctgtcttcctcgtagcctttctctctgggtgcaggagggacttctcatccaaattcaaacctaaagagactggtgtgagaacggaagcctgggtctctgcctctgtaggggagcagcgcagtgacacgtggggaggagtcaggagacagtgatagtgtcttggttgtcaccatctcacactacaccctcccaggatgaggtggccatgctgctgtgccccttcccacccgcttgtccccctgtaagcctgcgggagtcacagaaccttcagagatgatgaccttggggtggtgcatgtgtcactcacttcctgcagggggctggccgagccctcttgttccttgagctgtcgacaggagggtgttaagcatcacgatatctgggcaaactgcagcctccagagcagggaggggatgctgcagggggcactgggcactctggtcagggattcactgattcctaaacaagcgatgtccttagtggaaccattgctgtccccacaggaagaaggggcagagttccatgtctcaaaggcatctctgcagtgatcccaccaaggccgaggcagggtctctgaggggcatgagggccccctgccacttctcgggactcccaggtcttgctgagcatggtccatgccagagccaaggcataaattcatgttattctttcttccctttcctgtgatgaaggagccagaaaacttcggctccatgttggaactgtcgtggaagggaacgaagcccatagacctggggaatggtcagaccaggaagtttctgctggacggggatgaagtcatcataacaggtgagggctgccaaacccagcagctcgtcttcctccttgcccgccatgcactgttctagctgcggggcgctcctacctggccatgaagccatctgttctcacgcatcctgactctgcctcccagagtctctgcctgcttgttctgtccttccccacagctatggctacccgggacttcaagtgtgagtctccctaggccagaaagactgtagacattctgcttggtctcccttctccctgagcatagttataaaatactggcaggttcctcaaggtctagactttgcagcaaacgccctgtgcagacacttggtgacctatgactaggatcaaggaaggttcagctgagttagtgactgaggcttcgcagcagcctgttccaaggaggtgagggtgcctcttaattcttctgggggtgccattctgcctaccacattttactaatagagggaaagggcaccataatggttagcagcacactctttagagctggaaaggttcaagttgaactcccaggtcccccaccagctgtgtgaccttcattaagttatttagcctttctgagactcagtttacctcatctttaattattttttttgtttttgagtcggagtcttgctctctcatccaatctggagtgcagtggcacaatctcagctcactgcaacctccatctcccaggttcaagcgattctcctgtgccttagcctcccgagtagctgggattacaggcgcgctaattgtgtatgtgtcagtttccgtgcttaactaaaagcttgtgttagtttcctgtggctgcagtaacatagtaccgcaaactttgtggcttaaaacaactgaaatgtattctctcacagctctataaggtacaagttcaaaatcctcgtgttggcagtgccatgttcctggaaactctggggagcgtctgtccctggcctcttccagcttctggtggaagcctctttgtcttgtggccacatcacactgatctctgcctccacggtcacattgtcgcctcgtcttctgtctcatctcctttacctctctcttataacacacatgtgatagcatttagagcccacctagacaatctcctcattctaagatcccaacttaatcacatctccagaaaatttactatataaggtaacattcacaggtcctagggatttggccgtaatttagtccactccagagctcttggagagcaaagtttagtccaagtagcagccacatagtgcatgcccagtgtggctgttggttagttctttgaataaagtggatttggtagagaagatgcaggcagagctcaaaacagcagatgatacccattattaatcaataaatacccattttgctcccatttctgcagcctaattatacctctctaatttgaatttgactatttactgaacatctgctaggagccaaccatattgcaggcatgtccaccttccttatttcattttctactcacaatagccctttgatgatataatatcattgcccccattttgcagagtcgaaaacttaggctgatagaaggcaggttacttgacaaaagtcccacaactggggaagccagtctgcaactgaggtcttctgattcccctgccaagtttgtttctagtctttctgcaatgcttgccagacctaccgcaggcctttggtcacggttctgtggattgagtgaaagcattttctgaagttttgatttggggaaaggaaggaaagagatggtggcagaagagaaaatgatggctttaactctctgttgtcagtgtgataagggcccctgactaagccatgctagaccaggcagctgtccagggcctgggagaaaggaggctggtatctagcagttggaatgcacatgtgttcttgacatttgagccagagaaggaaggagaaaggagccaagatgccatgagagtcatttccatgtttgtttgtgtatacaacgccttactccggaaggatttttggaggccagcagaggaattcagggaaaggcagttccttggatctgaagaagcacatgttggcaagtgaagagggaaatgggaacagatgggcaaaatcccctggaaccaagaaagaagaattataatttgctaagaggagaggcatacattatgtgttcataaaaagaaaaaagagaatttcatacagaaggggaccactgaaaaactcaaaagaatgcatattgctagaatttgggctaagcagggggtaagcagaggagcgggcaggtggaggtggtgtgtcagctgtgttaccttgtgcaaaggttccccgcattggcggacggctctgccctcaccttctacgacttcactggtcacgtggccctgctgagctgctttcttgcttgaaagccacacatggtttcttcagctcttcccggctttcctcctccttctctgcacctgctcagatgcctttatggctgcctctcatttccctgcttgctcttcacggatgctccttccccaaatcaatttctaaccattggaaacgcgatagaacattcagaagtgctggcatcagccaacgccgcagcacttactgcaggccagacactgtgccaagtgctttacctgcaatacattttctattccaaacaaggcagctactcttactgtctctatttttcagatgtggaaactgaggcccagaaagatgcatacttacccaggatcacacaggcgataaagggtagagccagggtttgaacacaggcagttgggctccaggagctgtgctctgaacccttgtgtcctgttgcctctttaaatggcgcgatgaaattctcatttctgagagagtccaaaaaccacaaaatgttcagcaagagaacaggtgaagtaaacaaaccaaaaatatcaacaaaaatctctgatcgtcttggtttaactcatccatcccctagtctcgctcacaaaccccatctggtgttgagcttgcaacttgcaaggatgtgttctcgcaggcatttgcacggatggctctgcactgctggacacatgcatttctcactctccttcagatctttgatttgttgatagttatgatttgttgtggattctttcttggtatctgacattatttggaaacaatatctgagcaaaagtctttcgtttcttgccctgcgtctctcagtggtggcgtctttcacctggtgttcctgtgtctctgtttattccagtttctctccccagcattattgcttgccttgcctggcacagaattcctgcgcaaggctgaccaggggtcccagggtgtagaagcagtgacccttctccttcaggaccatggttgggagagactctttaaaaatgctgcagttccgagttagttgttttgatagatgtttaataaatttctgctgggagccagttttactttaataggctttttttttcaccccagtggtgtggatatttctgagcattgaggtggaaaagagactgacagaaaataatgaaaatgagcaacagaataggtgaggtcgttgctctcgacaaagggcatccctgcatgttgtcagcatgtgggtcacggggcttcttagggccccccaaaggacagcctcactgaacagatgtgacaaatgcatctcgtgcctgagtgtctgagcctttgcacgtgttcttccctctgtctggaatggcattttcatgtgtcttccctaatgaactcctagctacccgtcaaggcccagctaagatatccccccttcctgctccctttccctccatgctgctcgctcagcaccttgtaagcatttctctgtatctctcgtctggacctcccactccctctaagtggacccctctcaagggcagagatgggcttctctctgcttttccatcatccttgttgaaatggaattaaatgaaggaaactaatatttattagtttctgagatgtgctgggaatttcactgaaatatttagtctaatccttacaaccttgagagataagcgttgtttttcttgtttgcagatgagggaggtgagttctgaagtcaaacagcttgttcccagccacccagctcataatggttgtaatgactgacacttacagggaatttcaaatagggactggaggctgttctcagagttttctatgcatttgctcccatcatccttgcagcagtcctgtgcggtgggcactatcataagatccattgcacagatgaagaaactgaggtctagagggacccaaggttacagagccaataagtagaggagccaggctttgacctcaggcattctggcttcaggctaattggcagagcgaggatttgaacccaaacccatgtggggagagttgaccactgtattagtctgttttcacactgctgataaagacattcctgagactgggtaattcataaagaaagagaggtttaatggactcacagttccacatggctggggaggcctcacaatcatagtggaaggcaaaaggcatgtcttacatggtggcaggcaagagagaatgagagccaagtgaaaggagaaaccgcttataaaaacatcagatctcatgagacttcttcactaccatgagaacagtatggaggaaaccgctccatgattcaattatctcccactgtgtacctcccacaacacatgggaattatgggagctataattcaaaatgaggtttggcgggggacagagccaaaccatattagccacaggaaagctgttgagccttgcagtgcctctgaggatccctggctgtggggtgggcccgggttctagtccaagggctcctgcgtgcaactctgcccagcttccgtggagggttattcttgtgtttaagatatgtgtgtgtgattctgatggcaccttcctgcctcgggccagctgtgtgctgacgggcactgccgctgcctaggtgttggttccggtgagcccagcaactttgtgactgatccttgtcctcctctgttccagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcagctgtgtccacttatgatcgtgatttgatccagtgggtcaaggtgtgtaaagcctccctgccagatattcattaatatgttttctcactcttattagtgaggtcaggggtctttgtgggattttcttattagacatcccaggcctcctggtattccatggaatttgaaaagagactggcacctgtagtagtcagggctctccagagaaatagaaccaaggagaaagagatcgatttattgattgattgattgattttaagcaaattggcttctgggattctggagggtggcaagcccaaaacctgctgggtgggttgctggctggagacccaaggaagagctgcagtttgagtctgaagcagtctgctgtcaaaatttcctcttcctctgggaagtgagtcattgtttggtgaaggccatcaactgattagatgaggcccagccacactgtgggggtcttctgctttactccactgatttaagttttatttcacctaaaaagtactttcttagaaacatgtagaatagcatttgagcaaatatttgggtaccttagtctagccaaattaatacagaaaactgcccatcaca

SEQ ID NO: 28 - DNA, 5206 bp, Homo sapiens
  source 1..5206: mol_type = genomic DNA
gccggagtgggccgtcagcacttaaagggcccgcggctcgggcgtaggaggcggtgcctctgcagcaagcgtggggcgcgggaacccgagcaggttcgggagacggaatgaagggccgggtgggctcgcgaggggccggggagtccgcggggagcgagggagtttccgaggggcgggtcgtgttcctggcagcgtccctccagggcaggcccgccccctttgtcccagttccccgctgcccgggctggggcggccggggttcattcattgccggcctgaggactcctagctcggccccgctccgcgctacagcccaaagcccagcctgagacccagccgccctcgtatgcccacggcctagctccccttccctccaacagacagactgggaaaaccgagtgggcgacggctgagcaaggtcactccgctgtcgggggcgcagccggcctcagaccagctttcgtgcttcccagggcctctctgcgaccactttcggggtccgcgccaggcgcggggcgggggcgggggcggcttcggcgcggcgggcagagtccagcgggcagcggtgggggaagggcgagccgcctggggagagggccgggctgcgagcctggcgatccagattccagcccgctgtcgccagctgtgggaccgaagggcaactgtttcacctctctggccctagtatctgtatctgtaaagtgccagtgataacacctgtctcaccgagatgctgggggaattcaggaaaatcatgcaaaagtgcctggtacggagcctggcacgcagagggctcttggtcaagtgggttggagctgcgtgagcccagaaggggatagaggcagcgtggaggaaggcggcagcgggcccggtcgctgggaatgaaaggcctcagtgtctggggcttcctccccgtactacccgcagagtttgttcagggtggaggtgcgcacctggccaagtccacgtctacacggcccacccagagtagcctaagttgggcgggattcctaactctgagccaggagtgaccgggctggccctggcatgggcagaggctgagcgggggttggggtggggccccctccaggaccaaccacggtgtggttgcccctgagctggcctcagcctgcctggcaaaggacctcacccttgaggccatgtgatctatttcctgcttcctcccagctgacccttgagggaaagggggtgggggccgcctagagcaggaggtattagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggcaagtggaactagaaaataaggtgcctgtgtgtcaggtctccccagctctgctgtggcgggcccttaagatcacctcactgaaccctcacgctgcctcatgaagtttatacaattattagctctgttttacagagatagaaactgaggccaagaggctaattaatttccaaagcctaaggccagaaagtgatggtacccagacttgccccagggctgacttctgagccagtctggtacctagggcacactgccgcctccttccaaagcgagcttagggggcaggattccagtgggaaggaagctctgagcaggcagcctcagccacctctgagactctgtatcctgggccaggtgccatggcagagaaggtgctggtaacaggtggggctggctacattggcagccacacggtgctggagctgctggaggctggctacttgcctgtggtcatcgataacttccataatgccttccgtggtgagcggggcagtggggctggggctacttgaggggatggcagaagcaaaaccctgggttccacctccaccaccgggcggggaatgtgtgtctggctagtccctgggaacacagcaccccatgtcgtgatgatgtggcctacatgtaccctaccaggagggggctccctgcctgagagcctgcggcgggtccaggagctgacaggccgctctgtggagtttgaggagatggacattttggaccagggagccctacagcgtctcttcaaaaaggtgggtgcaggctgggcacggtggctcacgcctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaaaaaaaaaaaggtgagtgcaggcaggcaggctgagggcattgccaaggactaaaaccagtagagcaacctctggccatgtcacccctgcagtacagctttatggcggtcatccactttgcggggctcaaggccgtgggcgagtcggtgcagaagcctctggattattacagagttaacctgaccgggaccatccagcttctggaggtgagaggcatgggacagggcacagacactaggagggtgtccagctggaccccagcctggcaggcagtgccaaacacagagcccaagctgtatcatcctggactcatgtctttacctcccagtctcagtttccccatctgtaaatgagagtgctcatcacctcagccccattctcctgtggaggagtaacagggtgggagtaatgtgtgaggcagaggtcactgatgccatctctccacggccagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaaggtgagggcccccttgacagtgccctggctccactgatcgatggactcctcagggcccaccctgagcccaggggtgggattccgaacacccccactaaggaggaagctaaggctcaggcagttgcagtggagggccccatcccctgcttgtttctaaagataataaatagacaactggccgggcgcagtggctcatacctgtaatctcagcactttgggaggcccaggtgggcagatcacctgaggtcaggagttcaagaccagcctggacaacatggtaaaacccccatctctactaaaaatacaaacattagccggccatggtggtgtgtgcctgtggtcccagctattcgggaggctgaggcacaagaattgcttgaacctggaaggcagaggttgaagtgagccaaatcaggccactacactccagcctgggccatagtgagactccatctcaaaaaaacagaataggcatgaggagggctctgggttcagctgggacacgctgcctgtgcctctggcctcaccacctgacccacatcccacagacttggaacgcagtgctgctgcgctatttcaaccccacaggtgcccatgcctctggctgcattggtgaggatccccagggcatacccaacaacctcatgccttatgtctcccaggtaaggcaaaagggaagggacagaggagtggccctggggttaaagctggtgcctgggatctgggacgaactgacctgatctccacctccaggtggcgatcgggcgacgggaggccctgaatgtctttggcaatgactatgacacagaggatggcacaggtgagcctaggaccagggggacctaggagtgggagccaggaaggagagtcagggggaacagactccccatccaacacactcccttctctgcaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccgccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgagtgctggcctgacccctgcagttaggggccagggaggggctaaatcagatctgggcatgcccacccagggcgggctgtggggtgggggaggctctgcattccaccgtgggccctgagcacacacctcgccgtgttgcaggtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 29 - DNA, 272463 bp, Homo sapiens
  source 1..272463: mol_type = genomic DNA
aaacttaggagagtcctggttgtaagaggtattaacattttcagcagtagtactctagctacacttgactgttcccctctctgtgaatttacatgatatgtttgaaatactgcccctcaaaagtctcagaactttgagaaatacggtcctttccaaaaaaaccccttatgtccaatttgaaggggtcgctgtcagtgggtgcttaagtgggtaaagaaaagccaagaatatgtcagggtgaggaaggccaaggctgagcgaggtcagcttgggacccacctcctagaatgacctccgccagcaggaaaaaaccgttaaggggaggaaagggcaggtccctgcggcctccaggtgccagccgcgtgagtgggcggagaggcctcggtgcctcctacccgctccggacgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgacctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtaccgccggaatcccaccacccccacttagacaggcagcccgcctcccaggagccgtctcgggacacgggccgcccctcggccctcgcgcgccaaccccgccccaggcggggaggaacctgagtgggcggggctcggggtgactcgggtaaccgggttctgtggcttccgtagtggcaggtttgacagcgctggtgcccggagcgggcgctgaagaaacttctttcctcatcccctttcccctctgttctaatcagcggtcttgcgccatagggtacgtgctgtggctccaacacttattccccagagtgctgctggggagtgactcaccgccgctgcaggttttctgactttggcacccactagcgtgggcctgtggagtaacgtgggcataactcctggcacgtgtaattacgcatttaaaactttctagtttatttcatagcaaatgttgtgattttatatctaagaggattccttcaggcagacactatatccttttgttttttccttgctaatattcctcatttaggggaagattacacctacattgatcaattttttctccccttggatcaacattgagaagttaaatgtacatcaacatttgtccgtgtgtgactttaaccatcttgaagagggagaaaggtcaggaaagcaacttttacaggccaatgtcgttttagcttgtcttctaccattgtgtaccatacaactttagttactgggctaataattctattcataagttccactaaaaaggtacaggtctttttctgttgtcgttgttgtttgaagtaaaagagctattatacaagttgtaatagttatacttgtgaggttaccccattttgatttaatagtttctccccttttaggagagacactgcagaatggaaactatcctggcaacagaatatacatggccaatttttcgagtgatggaaaacatccaactagttaactggcatgaaggagcgttgagagtaatgaaaatgggttgatttggagtttgaaaaaagcccagcaaattgtttgtgtcctagcattttcaggtattaaatgcattcaaatcagcaagtgtttattgaggaactcctataaataaaacactgctctagggattgtaagggatgtgaagtttcattcttgagcttgtatatagtagtgaatgaggcctctgtaaaataatcaccttgagctgtccctcacttaatcagatgattatgctcttatataaaccatatgaggagcagccttgtgaaattgttttcagaatttacagtatatgctttcagagaaacttagtgcataatcgtcataggtttaaggttggatttgatttagaaatagtcagaaaaaatttagaacaaaagatagtgattaaaggtagtggttagattttttttttgatgtccttgtaaccatgacattaatttacctgtgtgctttgtaaaaggacacttaagatatttattaaagaagagttgtggaaatgttttatctacacccccttccttttttttttaaatgacacaaacagattaacattctttattaagtgtttctttcatgtactttatttccaactccactgggattgaagcatttataatcttctttcatggtttgccaaaactaatgaagggaacaaaggccaagataaagaagggaagagaatccagtgtgcttggtgaaaagtctcgtccagtgggccctcatgcctcactctgacccggattttacttttgtccttggttctgagtaatggccatttgctagcatacatgttccatttaggcatatcaaatagtaatttggcatttgttagtggtaacttctattgttaacacttgaagaataaaacatttttccttcatacaatctggtcttagttccttgtccaattttccatttatttctgataatccatttggactgtgtgtctttggcctaacacaaatacataaccagtcaaacacttaggtgcaaagtatgcttactaaggagtgaagaaaatttgaggtacaaacaacagtatataattaaggtgatgaagaaggaaatttctctttgatggactgtctcatccttccccaacagatatcttttgatttgaaattttttggatgttcccttaggatgttttggatgttccttcccttctttaccttggccttttccccttctgtattagtccgttttcatgctgctgataaagacatacctgagactgggcaatttacaaaaggaagaggtttattggacttacagttccaagtggctgaggatgcctcgcaatcatggcagaaggtgaaagtcatgtctcacatggtggcagacaagagaagagagcttgtgcagggaaactcccctttttaaaaccatcaggtctcgtgagacttacttactatcaggagaacagcgtgggaaagacctgcccccatgattcagttacctcccatcaggtccctcccacaacacgtgggaattcaagatgagatctgagtggggacacaaccaaaccatatcaccttcattagttgttcttttcaccttctgtacctgtgagaattttgaatcaagtgtagaggattaatgagttactctgctataaaataaaaattagtacattattagcatgactgaccacctccatgttgtctcattgatgacctcccaaaatagcattttccacttgatttttctaccttttatttagttatttacttgttgttacactacaattagttgttataattccaaaatcttagtgctttaaaacaacatttaattgttcccatattacatgtcagcatgagtcagccagagggccctcctcatggcagtcactcaaaaatctaggcttatgaaggatttgttttgaaacatgcttctgtagaggtggtcacagtgcaaagagaagcatgttgaactatgcactatttcttacagcttttgcctagcagtgagtccattctgctgatacgttacattggccagtgcccatcagcttgccatgtgggtgaaacagagaattggcatttgtgaacattgtcaaaacaacacaatttaataatactactttataccctctgtttaatgtttataaagtactttcagatccggtatttaatgtaatcctcataacaaaaccatgaggtagacagacggtgggcatttttcctgttttgcagatgaagaaactaagtgatgggcttgagcatatatggcataagtaagtgctgcaactgtgattaatctttctttactgaaactgttctcaaccagttcacagacaacttcatgataatttagggatccctcttttctttatctctagcattgtacatgttggactatttcttggctctttgaagccataatcttgcttttctttcattttctcagcctctttttgaccatttaatgtaagagattttcaaggttcttccctgggatcatttatgtatttctattgtatattttctccctagacattctcatccatcccatggattccatctatctactgaggctgcccacatctgtctccactctagatctttctccttatcttggacttatttatatcttcattttgatgttttataaatacaaatctcaacatgtataaaactgaacttaacagattttcattccaaacatgtttgtccctgtcaacccaatcgcagtgtctggaatcttcctctaccagctgctcaaacctaaaaggtaacgagtgatttctaattactcccgtctcctcctagacctttgagtctagtcaattgtagcccctaacttttaagtatgtagcatgctgccttcctactgctgccatcctagttcaggttgctagcatctctagtatggtttacagaaacaacctcatagctgttgttcttttttcaaatcttcactccattctaacttctccactcctcttcattccaaacagagtaagtagaatggattttgaaataaacaaatctgatcatggtactcctctgcttaaaccctttcaaccattcctcatttctcttgagttctgtacagcctccttcccataacttagaagattctgcattatctggtccctgttgaccttttcagcctccctctcggtaccatctaaccagagggccataaagggagagggcagcttggatctctggggaccattctgtaaaggtaccagaataccagtaaaataaattagaaacatgatatccatttcccacatgcattccttttttcttgaatattgaagattttcatttcttattttgtccacacacaagaaattggggcatctggaaaaatcactgaataaaagataagaaagatgaagaattagaaaaattttctaatctttatcagaagagtgacagatttagcttagtaggagtgggttaaataagtgaatcttttcctgtatttaatattttcttaatataaaacaatttctctaccccatgaaagagaaacatttaacaaatgtttgagtatcagctggaaagtgtgacatcatattatcctgtcttggatgccacatgttttggtttagccctcagtgaagctgtgcttttgtacatgctattgcttctgcctaagcattctttgcttctaccttaggatagttcctatacatgttttgggacacagcttagagatatattatatgccttctctgacttcgccctgtctcaaagcttcttctgggctggttgaggggtccctcttcttttctgccaccttggaccactatcctatgcatgctcatccactgtaatacagttgtctttctactctttgtatcccccactagattgtttgctctcataagtgggtactatgtctatattatttattcactgttgtattcctcagtctgtagaactggacctgcctcacagtaaatacttagtgtaatacttgaatgagccagtggctgagtgaatatcttctgacttcatttttcctttgtgccataccagtgagtctatggtcaattcacctggagctaaaaatgtctggattactagggtagatgaacagggaacaggagtagttactagaggtttcatgtgacaatctgggtaaggggaatatatgctcaattaaagagctaaagatgaccagaataaatcaagaaaatagcttcttaattagatactttcatactcatcagagactaaaagtttgatctctgaaggaatagtcagtttgagagaatctgatgtcaagttgtagctgtgtgtccaagaatgggagaaggggttttatgataaatattatatgttaagtattacaattacagtgaagagctctacttggttagaaataaaataattttcacattggtatctattaaaattagaaagtaatttggatttggtacgttagcaaccactccaagaaattaaaaaaaaattgtattgaggtaaaatgtacatatataattcaccatttttaccatttttaaccacagttcagtggtaataaataaatttatatatattttcctcctttatcttccttccccactgtccttcccagcctctggtaacctccaatctactttctgtcttcctgagaaacacttttttagcttctgcatatgagtgagagcatgtgatatttgcctttctgtacttggcttatctcacttaacataatggtctccagttccatccatgttgctgcaatgataggatttcattaatttttatggttgaataatattccattgtgtatatatactgtagtttctttatccattcatccgttgataagcacttaggttaattccatattttagctattgtgaatagggctgcaataaacatgggagtgcagatatcttttcaacatactgattttatttcttttggatatatacccagtagtagcattggtggattatatcatagtcatatattaacttatttgaggaacttctatactgtttttttttccaagtggctatggtaatttacattcccaccaacagtgtatgagtgttccctttctgcacatcctaaccagcatctgttactgcccatgtttttgatacaagctattttaactgtagtgagatgatattgcattgtggttttgatttgcatttctgtgatgattagtgatattgagcatttttttcatacacctgtcggccatttatatgttttcttttgagaaatgtctgttcagatctttcgcccattttaaagtcagatttttttgctatctgattatttgagttctttgtacattatggttattaatctcttatctgatagtttgcagatattttctcctattctatgggttgtctgtttactttgttgattgtttcctttgctgtgcagaagctttttagcttgatttatactctgatgtctatttttgctttgatagcctatgttaaggtcttacacaagaaatctttatgtgagagaccagtgccctggagcattttcccagtgttttctgctacaattttcatagtttcaggtcttagactaaagtttttaatccatttgatttgatttttgtgtatgatgagatattaggggtctagtttcattcttcatcatatagttatccagttttcccagcaccatttattgaatagactgtcctttccccattttaagttcttggcacctttgttgaagatgagttggtggcaaatgtgtgtatttagatctgagttctccattctgttccattagtctatgtgtctgtttttatgccagtaccatgctgttttggtttctatagctttgtaatacattttaaagccaggtagtatgatgcctccagcttttttctttcttcctttttttttttttgctaagatttatttggctatttggggtcttttgtggtttcatttaaactttaggatttatttttatatttctgtgaagaatatgataatcagcgttttgatagggattgcattgagtctgtaattgcttggctagtattgtcattttaacaatattaatccttctaatccgtaaacatggaataccttcccattttttggtgtcctcttgtatttctttcatcagagttttattgttttccttgtatagatctttcacttctttggttatattgattcctaggtattttgtattcgttgtaggtattgtaaatgggattgctttctggatttatctttcagatggttctctgttggcatatataaatcatacagatttttatatttcgattttgtattctgcaacttcactgaatttgtttaccacttctaacagcttttgggtggagtctttatgtttttgtaggtatataatcatgttgtctgcaaacaaggctaatttggcttcttcctttacagttttgatgccctttagctgtatctcttgcctaattgctctggccaaccacaccaaaaattggttcccacagcgcagaagttttatatcacagtggaatggggtacttttttctcagtgcctggccaagttgtgggctctgaaggaagtcagatgtcagtgactgtagaaggcagtgaagaatctgaagatgacaagatgtacatgacctgctcttctgcactactagattcatttgccctttgcagctgagatctttactaactccagtcattcctgaattctctacagtgatggtcaacaggctctgacctcttctcattttcaaagtgccttcaaatgacttcgtggagcatcttggtttagtttaggctctggcacctgctgcaccacctcctgagaaatgactgtgtgtgttgtaacttacaggattcctttcagctctcatcaaactgggccttggtcagctagtgaggtgataatattgtctctgtgaaatatgctatagttttagactgataagtatatcatactgctgttatttgaaagcacatattaaactttgattatacatttataggtattaaaggaaaatatgaaagtgtattctttggagaaaattgctactaccaggtacctttcattgtaaagtgagctgattttcttcttatggcaatatgagctcatcagtttatgttcaccactgttttgaatccagggctcctttgtgtttaatatccagaagaatccccattgtgttttgtgtttagggcaacaggaacccggtaccttgacaaaaggtaagactctatgttaaacacatgattatgtagagttttaaaatatgttatacatcttacattcattgatttattatacaattaaattttagctcttataactattaaatagctttgagtcctagggaaaattaatcaacctctgtgaacttatttcttcatccataaaagttggatagaatccactttgtagggtgtcttgaggactaagaatacatgtgaagatgctcagtaaacaaataatagtttgatgataatattattagcaaactaatatatcaagttaaatatttactaggatattactttcagaagattttactgtttgcttctttaacactgtattctgaaatcaatcatcagataaataccatgaccagaaattccccacaactctttgttttgctagttaactgtgccttactttagggggttccttctttttttttgttagtaggagtgattgtgtgaatgaggtgaggcaggtggtaattttaatcataatctaatagagaaggaaaggaatatgtttaaactttgatccttaatttagagaggaaatgataaagaaattgccagtttactataagctgaaggcaagatgagtcctgggatataatgagcacaaagctccttttattgagagaggtaaatgctagcctgcagaaattcaaaatcactgttctcttgatcttccttttctgtctttttcttttctttcatctgactgctaagtgttcatattcttgggcatcaaacagctgcagggattttcttcctcctgaactgtagatggttagaggaatggtcatactgagtttactaatagcaggagtaactttgaaaataagactaatgtagaagaagaaaaaatatataatagcagcataaaagtttgaaaatgaaataattattctagtggagtctgaacatatgatatgtgcatattaattagaaaaagttataaatccaatattctgccttctcttttttttcctctcttgctttttgatatttgatggctgcagttattttcaatgggtttgattttgccataagatgcataaaacaaatgaatagaatattcatatgtattttagtagatccattgaatgattaattttaatgagacacaatctctgggtttatacactagttctacaacccaaaatatgataatcagaaaccaaatatacaaatgtatttcttgcataaagttgaagttttccaaatacccagcaaaaagaattaactgtttgttttaccggtgatatcacatgatactcagtgtcatcaatctgttttcatttccattaataacacctagccacaggttatatttaattatgaataactgcacaatacagatatacacaccagtacagaaacatgataaaattggttatgcatttaggttcatgtcatagaaaacccagcacactttcaattaacagaatatcccacaagcaatgaattatagaaatagaggcttgtgaagaaaagcgaaggtcagtggtttgggctttagcttaaatacatccttctttatcttctgctatattatccttagcatatggtctcctttcttatgcttagaggttgattgggcacagcttggcaccacatccatgtttctagctggaacacgtgctagcttactatgtcttttttagtgaagcatatgttagctttcttgtaaacttcaactggttcttcccatttacaggttattgatcagaattgtcccatggtcatccttagctgaaagtgagcctggatcatcaaggctttcagtggcacacacatcttcctgaaatgtatccttttgtctcatccatcacaacttcccagggctcttttcctttctccaaagaggaaactacatctggcagaagatgaaaagcccagtgagatcatgctgtagtcctctaaaatcacatctatgcacaaatcattctgtgcaggatccaggcattctactgttcctgagaggagtctatagtaacacccctcagtattaccagccgctggttatggattttactttgctagacctgatctttgtttttctgggttctttttttttggcggagggccgggggtatacagagacttttcactgctctgtcttaaggtgattcagtcacttcagctacttggccctagctccactatcttctttttttaatttcatgaatattcttagaaaatataagaatgttgccaggcgcagtggctgacgcctgtaatcccagcacttttggaggctgaggtgggcagatcacgaggtcaggagtttgagatcagcctggccaatatggtgaaacctgcctctactaaaaatacaaaaattagccgggcgtggtggcacgcacctatagtcccagctacttaggaggctgaggaagaagaatcgcttggaccggggaggaggaggttgcagtgagccaagatcgcgccactgtattccagcctgggcgacagagccaaaaaaaaaaaaatacatatatatatatatatatacgtatatatatatatacatatatatatatacatatatatatatacgtatatatatatacatatatatatatacacatatatatatacgtatatatatacgtatatatatatacatatatatatacatatatatatacgtatatatatatatgaatgttttgagatgaaattggtttcttaattactaataattttttcatcttatcttgggctcatgaaaaaatggtcagttttcagttatttggagaatagaaaatttgtgtgattaaaaagaaaaggagaacaaaattaaaaatgtccattaatttatgctaagtctttaaagcatgaattatttttttacgtaactacacacaagcttatgaggctttaacattgtacctttccgtgctgttctttttaaagcttaagatgtgtaactatcagtcttcatggttgtcatttttgtgctttttattattattttgtctcagcttttctctttctgcattaaaatactctgacacttttgtttacctgtttgctttttgcctacaccttggagtcttccatcctcttgaccattttgattggcagtgttatttttgtggtttaagttgtgcttactagtaataggagtgtagtgaaactaacaggcttctttttgctttacttctccaaagtgcctttaattaaaaactgtatggtacccatgcagtattaggcaaacctctactcacaaatacaacatataaacaagaagtacatagaaataagagtagtatcaaacctaagggttggttttagcaggttccaagtacctataaagtcagaggacatttgaaaacatagtggagattgtttagacaattgtaaattgtgttagaccgtattaaaaaaaatcattctgaaataattacagactcacagaaagttgcaaacagagtttagagaaggctcctctacccttcactaagtttgctgcagtggtaatatcttgcataactgcagtggttgtatcaaaaccaggagattgacattggtgcaaactacagaccttatttacatttctccagtttttacatatacttatttgtgtgtgtctacacttctatacaattttatcacatgtgtatattaatgtaactgacactgcaatgaagatatagaactgttacatcactacgaaggaatgctctcctgctattcctttatactcacattgcccctcccccacccatccctaacttttggcaaccagtgagttatatggtttgcatgtctgtaatgtttttcatttggggagtgttctatgaatgaaatcatatatcagtttttgacagtggcttttttggcctttttttttcattcagcataattcccttgagatctctccacgttgcatatatcaatagtttgttcctttttgtcacttagtggtattccattgtatggatgtaccatccatccagtttgtttattaacctgttgaaggacatttggattgttcccagtttttggctattacaaatattacagtaaacctaagatatgaatatttatgtataggttttatttctctgagataaatgcacagaatgctgtgatagctgggtcacgtggcaagcatttgttttataaggaatttccagatattttctttttttcttttttcttttttttttttttttgagacagagtcttgctctgtcaccaggctggagtgcagtggtaccgtcttggctcactgcaacctctgcctccctggttcaagcgattctcctgcctcagcctccctggtagctggcactacaggtgcgcaccaccatgcccagctaatttttgtatttttagtagagacggggtttcaccatgttggccaggatggtctcgatctcttgacctcatgatccacccacctctgcctcccaaagtgttggaattacaggctgagccactgcgcccggcctccagatattttctacagtatctgtacaagtttgcattccactggatgcagttgatctgcatccttgccaacatttggtattatcattaatttttgttgttgttgttgttttttgagacagagtctccttgctctatcacccaggctggagtgcagtggcgcggtctcggctcactgcaagctccgcctcccgggttcacgccattctcctgccccagtctcccgagtagctgggactacaggcgcccgccaccacacccggctaattttttgtatttttagtagagacggggtttcacagtgttagccaggatggtttcaatctcttgacctggtgatccgccctcctcggccttccaaagtgctgtaattataggcgtgagccaccgcacccggccttcactattttttatgttaactaataggtatatagtgctatgtcattgtggttttaatttgcatttttctaatgcctaattacatttaaagatcttttaaagtattattttctatttgtacgttttctttggtgaaatgtttattcatgtcttttgcccattttctaactggattgatttttcttttttcacttgccggtttttgttttttgagatgagtcttgccctgttgtccaggctggagtgcagtggcgtgatctcggctcactgcaacctctgcctccccatttgaaatgattctcctgcttcaacctccctagtagctgggattacaggtgcgtgctttcatgcgcgtccgtgtgaagagaccaccaaacaggctttgtgtgagcaataaagctgtttatttcacctgggtgcaggcgggctgagtccgaaaagagagtcagcgaagggagataagggtggggccgttttataggatttgggaaggtaatggaaaattacagtcaaagggggttgttctctggtgggcaggggcgggggtcacaaggtgctcagtgggggagcttctgagccaggagaaggaaattcaaagggttaatcactcagttaaggtgggccaggaacaaatcacaatggtggaatgtcatcagctaaggcggggcagggccttttcacttcttttgtgattcttcagttacttcaggccatctgggcgtatacgtgcaagtcacaggggatgtgatggcttggcttgggctcagagacctgacatgtgccaccactctcagctgatttttgtattttgagtagagatggggtttcaccatgttggctagtgtggtctccaactcctgacctcaaatgaccagcctgcctcagactccgaaagtgctgggatgacaggcttgagttactgagcttggcctatttttgtgttttgagagttcattatatgttctacacataaatcctttgttagatttgtggtttacacatattttctttctgtctgtggcttgtctttctatcttctaaacagagtctttcacagagcaaaatttttaaattttagtgaagttaaaaatttcaattttttcatttattttgatgaatcatgcttttgttgccatatctaagagctcttttcctagctctaggacctgaacattttctctatttttttttctaaaagttttgttgttttacatattacatttaagtctgtgatccattgtgcattaattttttgtgtaatgttttaggtttaagtccaggtttattttattgcttatgtgtgtttgcttccttttaatgatcataaactgacaaacttgtattgagaagcgacctgaccaaaattaccctcatctttaatcaggtgtcactgaaaggtacaagcaatgaaaatttttacacatattataggttatcgaaagcatggaaacaaactgtcagttttcttatttatgagatctcattttaagctttgacaaaccctaaactttaggaagccaggcaaaaatttgtgatatatatgggaatttattctcaagtaggtgcctcatgttaaggttttttcttttcagtttttgattttcatatttttctgtcgtgtcacattattgatttatattccaaatatttcttcatatgaatctgtatgaatgtatatgttcatgtatactgcataactgtagtggttatcattttaatttgacttatcattttaatttgattttttatttttaaaaatttcatttcttggccagatgtggtagctaatgtttgtaatcccagtactttgggaggctgaggtggttggactgaatgagcccaggagttttgagaccagcctgggcaatacagtgagatcccatctgtccaaaaataaaaattagccaggtatggtggcgagcacctgtagtcctagctacttgggaggctgaggtgtgaggattgcttgagcctgggaagtcaatgctgcagtgagctaagattgtgccactgcactccccctgggtaacagagcaagaccctgtctcagaaaaaaaaacttaaaacgttttatattttagtctcagaaccctctcatttcacagtatcagtcttcacttctacattatgaaaacgattgcctttatttatatacattgaagtacagagaaaaaacaaacacctattactttaaaaataagtttcattcattttgtctgtttatttgacttaaatgacaagtaaatctaatattttgtgttataattttatttgtaagaatgaattggttaaatcttaactaatgtcagtattttacaaaattagtttcttttatctaaatgaaattagcctttagtttattccaatattaatattttctttgatatttatcagggttcattatcttataaatatattagaaatcatagcatgccactttccaaatagaaattgattagttgttgagagatggaagttgtttgtacgtttatttggcaaaatttagaaaatttatgaataatatagctaaaaatttatctgcctttaaacagaaaggtaaagtggagtaatttttccactattcaacctaatgtattcaaattatcatttcaacatgtaacttaaaagattactgatgagatattttacctgtcatttgtgctaagtttttgaggaaatatttattctacaattgtaactcattataatgaatttgaagcactaaacatccaaaagtgatctctaccaagtttactgataataataataatcatcaccatcattacaataattattattgttataatttacatatacatcattttatgtgcattggggtcagagtctgccttcctaagaagtttccaggtgatgctgatgctgctgtttcccagaggatactttcagtagtaggtagtcccatacctctgttcaaaatggagttagcaaagggctaaattttgttctgtaaatatgtaagctataagtatgtatttcaaatttttaaaaataagtaatacatgtatatactgatgaggttaaccaagttacttaattttttggtggtcacagtaagttttctaactcttattataggtaaaaagggttttattgttaatattatcaaagttgctttttcttacatctgtactatgagttttactgttgcagatttgtaagaagtttattcctaacactctctttggcacaggcacttttctatatgatagcagaacaaatatgagtaagataggcgtcctacctgacaggagctcagttaggcaaataaacacagagtagatatttaatcacaaagttcagtgtaatacagatgaaagcatatcttcttctattaaggaaggggataatacatatatgacaaagaagttcttttgaattgctttaagttctcaaaattatttctctattaaaattagaatgagtctttaagaatgtggaagtctgtgggttttgtggaaataaataatgtaagagctaagacattaatcttcattaaaacatttaatgaaggtatcatttgaacttttatacagctttggttacagtgaaagtttacttgcaaaattggttcagttggaaaatgtgcttgtgtaagaattgccacattgtgtgagcactgaagcctctaaaatagcttgcaaatcatatctgaaaacacagcaacatgtttctttataacagataagcccattttggaagggatagtgggctgtttttaatgggaatgaggcaattcctgagtaagctaagtggctgcattcctgagtgagtcaagggacattatgagtgttatctggagaggtttccagaaaagcaaatgagtactgaatgctcatgctcctcctgattccatgttaggtgtcctgcccagaccaatgttatccaatagaaatgtaatataaatcacacaggtaatttaaacttttctagtagccacattaaaaaaggtagaaagaaaactaatttttacactattcaacctaatgtattcaaagtatcatttcaacatgtaacttaagagtactgatgagatattttacctgtcgtttgtactaagtctttgaaatctgatgtgtattttacacttatagcacatctcagttgggactagtcatatttcaagtgcttaataataatgtttggctggtggctaccatattagacagtgcaggtgggtatttgaaataacagcttttggaaaaagttggtatcactccacaaagagattcaaggggaagattaaggagggagaatggttcagtcagccctgtgttcataacagaggtaattagacccaaagaaattctgacttagcctaagatagggactctgcaattattgaccagtgacttttttatatttgaagataaataagtagatgatatgttaagtgtaaacatggagatatgccacatacttaacagtggctaagtaggtggtcatgtttgccctaagttacttggcatggctagtccacgttgaccttttcattgaggtaattcttattcatgtctttttttaatgctaaatgcatcatgtccgtcctataaagcaaaaacacaaacaacacaaaacaaaaacatgggccagacaaagtaaatctggtctttcttgataaaatgactgagatcaggtgactgctgtctgctttaatagccctagacctttctggatgttccaatttcacttggattcggcccagattaacagctgtttctaacttcgttgtcccatgaatcttgctaaagtgaggtgactcattatgacttgcattatttttgagttggtctttgcctgtaagagaggggggttggaaagattgattctctgttaaaacttaaaactagtgataatattgtgggggtgtatgtgtgttcatgattgtgtgtgtgccttgtgtctttttatattcttttcttcatgacttgcttttcttgttttctctagatggtagtttcttcagtgttcatactttttatttatatttgcatatataactttaaataatagttaacctcatactcataatgaaaacattgccatttttagaagtatttgccttcatgagcaatcagtcacattcttccagtggaatgttgttttcctgctctcatccatgttgtgttttccacactatgctgtttagtacgtgctgactcactgagcatctttgggatgctggctgtgtgttttgaatttaagaagagaagaatatagttaggggacacattattgtcttttggtattttctatagaatttagaatagagatttgtactcaggggtgttttgcaaatgtgtattgactaggggtctggtctagcttgttctgtaatattaggaatctagaaatatttattactgtcgttgttggagggtccctagaaacagttgggagtaattcttttatcatgtagtggcctgtggtgggcaaaacctctctcacataccgcttaacctttctcgtgtctaatactactcatgaagaagattgtaatttgtgcattgtgcttttatcaggttgctgttcccaatgcagttagtgtaatttttcatttcctaacagtcctcgggcaattctgtttaacatgctttctatttcagaacattctcctatttaaaaaacttctttcgcctcaggcccaacatgattttccagccaggccagtagtaatttctatcattcctggcttcattcaccttcactgttaaaattcgatgtggatttcctaagaaggtttcctttttgtgtttatggcatagcaaatgatggggcgcctatgccttctttgatattatttggttcacaaaaatattatttcatttttattactaaggggaagacatgcatgcccagttttcatatttatttcaaatctgtttcagttatttatgtcataaaccatccttttttaatgaatagaattttaattgtccacctgaacttttaaagttgttcatagcattttcctgaacagcagtattcacactagaataagagactgatttgctgatttttttataacgttcaagttcatttagtaggtagcaaattctctttttaaagtgctattttaaaagtgaatgaaacaggttatcttcctttccatcccaaatgaatatgaattaggtataatttttggcttgagaggagatagcattttaagtagaggctctcgaagctactctttgggtctgaaattggctataatgacataatctagaaggatttaggtttttaatggggggaagtctggcaaacagaaacatgcaagagaaaccctttgctgtcttattttaaggcactactggtttacattgaggtaggttttgaaatatctttttatagtatcaagattttcaagagattctagggaatatagatggggaggtggagggctaaactaaaattagagctctagttataatatatattatatattatatataaaaaactatatattatatataatctatataatatgtataatactctatattatgtagagtataatactctatatattatgtagagtgttatatattatatagagtattatactttttatatatcatacatgttatatgtgtgtatatttgtgttgtatacacaccacatatacatagaacttgtgtgatgtatgcatggcttttatattatgccttgtattagttggaatgttttcccattaattatgctgatttctgtgtacaaacatgggagaaaatggggcttttcctctctttggggatactcatcataacattaaggagaaaggaagagtacttcttttttaggttatagtttgcattttagatttcattgctgttcctctcgacttccatctgtgttgacatttgggaattttgtggttgctctttctcaagtggagtggaaatgcttaaaacagaatttacacttttaaatacaaccaaggctctattgcattgtgattcactccaggtctgaatactttttctttggcttaaaaaaaaatcaaatggtttgttgaactaaatatttctcaagcttgcaaacttactgattattatacattattaacaaccacttttgcattaatggaaagatctggctgaaaatacaatgataaatattaaggttttagacacttaatattttatggcatcaaagatgtttttatatagacggtattgttaattgttatttgttaatgacattgtggtttaattttattttggtttttagttaaggctcaattataacccaggaaatactaaaaatttgaataagccataaatagccagatttggtgctgtatgacttatgttggctctgtgctctattttttcttaaccttttaaatccctgtcagttggcattttctgtacgggtgtgtatgagagagagattttggggctgaataattagtggtctggacctcagttcagttactgagagggtgaattccctaagactccttttagcttttaatgtttgtgatggattcttttagacaaaatttgattttaaataaattgtgtgtgtgtgtgtgtgtgtgtgcactttctaacactcttaggcagtacagtgggagtttgttgtaatttccagattcagccactaaacaggtgatccggaggcactattcttagcagtttgtatagttggagaaagacagcaaaatcttataatggctttaagtatttcatactcctcattttcaattctgggccttattgactggcctttgctggttattgtagccatttccctcaggtttagttctcttctccgtactgcgtttatgagaaaaataataattagaagttaagtggtctccaacatgagaccatgtaattcatgattatttgttttttgttttgttttgttttggcttttcttaaaggccagctttacatatgggtagataccagcttaaaaaaaaaagagagagatcctctatgtatagctgaaaatcttattttcttggtgctaagacaaaattcaggtgtgaattagacaaaagtggaaaagaatagattaaataataaataaccaatacactgtaatatgtattggttaatctattattattattatttgagaaagggtttcattctgttgcccaggctggagtgcagtggcaagatcatagctcattgcagccttgaactcctaggctcaatcaatcctcctgcctcagcctcctgagtggctgggactacaggcatatgccactgctcctggctgatttttaaattttttgtagagatggggtcttgctatgctgctcaggctggtcttgaactcctgggctcaggtgattctcctgccttggccttccaaattgctgggattacaggtgtgatcatcacacctggcccgatttttatttttaattgtttattatggactttggaaaggaattgtagaaacttaatcaaaggcatgtgtaatttatttaatgtttggatatgtgtttttggttaaaaaatgtaagaaaattagcagaaatactttctaaaggaatagaatatatgtcaattttcaaaggatgataagccaaggtaaaattggcttaaccagttttggaagcctcatggaaaaactcaagtcagtaatgaaacctctcaataaaaaaaggtaactagagaatccgtgaccacattattgtgttacctaagctgatgaacagggtaagatattttatttttctattaaggaaagatcaattcctaggtcccagtgctcttgagacaggcgttaactcactcaatatttgccaggcaatatgttgtcttctagaaagtgcacccctgtcttttgttcttgagtaatttactggctagttggaggtaataggaataatccagtgataaattgtagtatataaaatttacctggtaactaagatgttatacactcaaatttctgggtctggatatcacacagttagaagttttaatgagtttcacatgaaatattttgctttacatatataaaatcactgctgggtaggctgacagtgtatcctgcagtggttaaaagctgagacttgggtcagctggcctgagttcaaatcctagctccctaactatttgctatgtgctgcagtctgaatgtttgtattccctctgccgaaatttatatattggaatcctaacccccaagatgataatattaagagacagggcctttgagcggtgtttagatcctgagggttctaccctcattaatgggattagtacctttataagagaggcacgaagaagctcatttaccttttccaccacatgaagaagcaacaacaaggcaccaactatgaaactatgagagatccctcaccaggcatggaacctgctggcaccttgatcttggactaaccagcttccagaactatgagcaatacatttcttttgtttataaactacccagtctaaggtattttgttatagcagcctgaatggactgacactatgggtaatttaactttcctaacccttaattttgtaatctataacatgaggataataataccagctttatcaacattttatgaggattaaataatgggataatccatgtaaagactggctggcaagaagtacgtgctctgtaaatattattaattgtgattaggagatacggaaaataaaatgacccaaggaattacattccagggtatggaatttttttagaatttttctttagatttatttctgcaagtaattacattcattacaatagctttaagtcagtgccttccaacctgtgaagagtctttttttttaaaaaaaaaacacacattttttgctcaccatcactggccatcagagaaatgcaaatcaaaaccacaatgagataccatctcacgcctgttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacagtagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaagaaaccaaacactgcatattctcactcacaggtgggaattgaacaatgagaacacatggacacaggagggggaacatcacactctggggactgttttggggtgggggaaggggggaggaatagcagtgggagatatacctaatgctagatgacgagttagtgggtgcagcgcaccagcatgtcacatgtatacatatgtaactaacctgcgcattgtgcacatgtaccctaaaacttaaagtataataataaacaaaaataaaaaaataaaaaacacacatttttaatctacgagagactgatacataaaattcaacaaaaatgagttactagaaaaattaacttaaaaaaagaagacataaaagtaccagtttttaaattagattcaacacatacaaaaattctctgtaaaactgctataaaagtctctaaatgcttactctcaatttcagtacttatgttatcatggaccagtgacaaacagttggcgactcagcagtggtctgtggcacacatttgagtagtattgctttaaatatcaatatgaaatttttatatatatataattttgaagtaaatgaatatatatatttatataaatatataaaaatatatttatataaatatatataaaaatatatataaatatataaatatatatttatataaatatatataaaaatatatataaatatatataaatatatatttatataaatatttattttgaagtacatgaatatatatatttatataaatatatatataaatattcatttacttcaaaatttatatctataccccagaccatttctctggccttctgatttacacgtggagattaccatctctctcttagttaatggcattatttctactcaggagaaatctgttattattatctctttctcctcctcacctgtccaaccaatccatcatttatgtcctattgaattttgctattctgtacatctttactgctagcttcttagtccaaagccaccaatgtctgatacaacttaataccagccttcctgcttctactactccatcctctttcttccattctgcatagagttacaagaatgagttttctaaaaaggtaaatctgtttataacattttattggcttcatgttttaattacagtttccttgggtgaatggtatgtaacaattacattttcaagtcgttgagaggcagtactctagatgggtggtttaatagcttagttggggtggtggttgtgtaaatgttaaaaattctgatttgagaggttgccagatattaagattaagaaggaataaatcagaggctggagatatttaggaagccctgtagccaaagggatactattctcttagtgctttaactgtacatttacctctcatttccttccggtttaaaactgagccagatcccagtctttcacggggataattgacatatcaggtagcaggctaatttgtattagcagcaatctggaagtaacttgtggggttgaattctaagtagactaaggaggatgcaacatacaaatatgtgtgtacttaattcagatggagccaaatttatgtataggagtgttgttaacaggagtctggatttaatgtgttaacttcagcacctggaaatggctccagcaatttgcctggttatttgattcaaacttgggttcagcaatggccaacatttcaatgtggttgagatcccttaacgtttctagctgtgcaggtaggaggaaagtgaaatggcacaatacatttattatatgcagtcctctcctgtacctcctcactccaacccttctgagattccagaggacatacccatgattaagaattgagaaatgtcttggtgaggggagcagacctgtatggtatctctcagctgggaaatcttactgggatatgctgccattgagctagaattgatttcagtggggatcacggggctctggagtggcaaagggcttttttggcagtgctttggcttcatggataaggtagctatcattttcatagtaggcttagatgtggagtggcagtcagtgttttgaaatgcagcctttagtggtcgtggctaattggttataatgtccttaagcatacaataaattggccatttaacatatttttacttgatctctataactggggaaattctagctgtgtggagtagaaacttgacatttgctactgataataggagccctttggagccccttgattgaaggtgagactgatttcccttgagaaaggacatgaaatactaccacaaatgtacactttaaatcttccaaggctttcctaaagggacttgctgtttactgggaaaaagcccagacttttgaaaattaataaaaatgggtcctggattaatccctggggggaccgcagtgccactctggcatatcagttcgagtcaaggcttatggaagtcgcctggaaaattgacttccagctgcatccgcatcgccatgggtccagtggcttggctgactagtcctgtgattttcccacttcctgaatgcatgattgcatcaagcctggaaattggcagaattttcacattgaccccttgtggagtgaggactatttaggaagactaagtggaagcccctgaaactgcccttcactaacaaaagacaaaactttaagcagtgctacatccctacaaacattgcacagagcagggctaccttcaaagacttcaatctcagtggagaatataacatctctttttgatttgctgattggatgaatggatcttggagatcaaatatggagtaacataatcctaatcagagagtgactcttagttgctttgctttccaaaatgtagtatcagtatacatttgtcaccccatgtccatgggggatatgttccaaggcccccaagtggatgcctgaaactgcagatagtactgaaccctacatatactatttatttgatctgataactgagatagctactaaatgactaagtggcaggtaaaatagacagtgtagatacatcagataaagggatgattcagatcccaggtgagatggagctgggacagtgtgagatttcatcacactattctcaatgacacacagtttaaaacttatgaatgtttacttctggaattttccatttaatatttttgtaccacattgacctcaggtaactaaaactacagaaagtgggtgactcctgtagtcctttgcacctggaatgccacaactgatacggcatcttttttttcttgctgtgccagttagattagaggcacattgtcttcagctagtgagaagaactgaacaccttcattgttttagggcagggtgataaaagtcttctgatctcatcataatatggctcatggagaccttgaccatctagatatgtagaaaacatctcaaactagtaccctaaagcaaacatgcttttgaatctgatgatcaggaagtagcaagtaggtggtttagtaggactcacacgtgccagatgttggatgataaactctgtgctttaaagttggtaatcttgcaaaacttaatttaatactgtgttcaaatattgattcaacactattgagtctataggtttttttccccaaatgacttgtgtttaattaaataaggaaaacaaagaacttgatagtaatttgaaaagaaggtacttgctttgaacaacttacacagtatcagacctctaaaatacaaatttctctgtagcgttttgacttgagcttcatttttgaatggagatttttttaattgaagtttttcaactggaaaatacatttaggaaatttagtgtatttattttacacacatactttcatatgtaaaagttaacataacatttacaaatacaactctgtagtttaatgctttatatataaaagtaagaataaaagttattttggaaaactttagaaataaaccagagtttttgccttcaagttgtttatgattgattatacctaatgctcttaatcaaataaaatcttgtttgtatttagcaaaataatagatggcttcagaaaataagtacttatatagataggaaaggcaaatttgtacaactctcaccttttgttcaagtgtagaaacagaatccatgccagcaatttattgagtatttactatgagccaggtactgttgtagataattggaatataggtgtgaacaaggagactataaagctcatacatttgaggagcttactttccagcagcaggagacaggcgatacacaataaacatcacaaatattggatgataaatgccatggcaaaaagaaaacatagaagaatataataaaaacgggaattgagtgtggaggggcagttttaaataggcgtatttcaggttaggaactattgagaagctgacatttgtggaaagacctgcaggggaattagtcatgcactgtctggtggaagagtgtaccagacctaagaaatggccagtgcaaaagcctctacacaggggtttgccaagagcaggggtccccaaactttggcaccagcgactggttttgtggaagacaatttttccatgaatggggggcaggggattgttttgggatgattcaagtgcattacattttttttgtgcactttatttctattttattacattgtaatatataatgaaataattatacaactcaccataatgtagaattggtgggagccctgagcttgttttcctgcaactagatgatcctgtctgggggtgatgggagacagtgacagatcatcaggcattagattctcatgggaacacgcaacttagatcccttgcatgtgcagttcacagtagggttctatgtgaaccctgttagattctgctatgggaatctaatgccaccgctgatctgacaggaggtggagctcaggcagtaatgcaagcaatggggagtggctataaatacagatgaagcttctttgtgtttatttttgccattcacctcctgctgtgcgacacaattcctaacaggccatggaccggtggggacccctggcctagagtattcaggaaacagcaaatagaagagtttgtatgggacagaatgagctagggacagagcagtaagaaaggacattaagaaagataagggaggaaggatcagatgacaccacaaatacttgtagattgctgtaaagactttggttagcttttactgtgagtgacatggggagccactgaagcgttttgagaagacaaatgacatgaacttatgacttaaaatgattactctgggtgactatattgaaaatagattgtaggaggcaaggatgtaaacaggacgactagttatggctattatgtgatccaaatgagagatgatggtgacttgaatcagtatcttaggagtgatggtaagaaattataaaattgaattcattctgattctgttatgaaagctgagtcaaaagcacttcctggtggattggatgtgagagaaagagaagaatcaagggtgacttcaaagtttttggaatgaacaataggaaaaaatttaagtgacctgggcccgggttatcatttagttagatatagggacagtactatagcttggatttcaatatttatagcttgcagatttaaatgcataaatctcatagattgtaaggacaaagaccacacttatttggaattttttaatatatgtgaatctgggattttagtcggatgtggacttgctgcatatgtttgcctaatataaaatatgctgtattatagtctagtatatcatatttttgagggacagtcatcttgattaatagcagcctttctatttcattttattttttgacgtggcttaatgtaattctcatagtgttatgtatattcgttgatttaacaactatattttaatgcttagtatatgtcagacattgtgttaggtgctgggctataggaataaacaaagcagacaattgtcttcatggtgatgtaatcattgtctgaagtttttgtttgttattgttttgtttttgtttttcccattacaatagtttttgtataataattagaaacaaaaattagtgtttttttgggaattaagaagagattttagacttatgtatgtagggttttgtattagtatgttctcacactactataaagaaatacctgaaactgagtaacttgtaaataaaagaagtttaattggctcatggttctgcagtctgtacaggaagcatggctggggaggtctcaggaaagttacattcatggcggaaggtgaagaggaaggaggcatgtgttacatggttggagcaggaggaagagggtgaaaggagaagtattacacacttttaaaacaaccagatctcatgagaactcactatcatgagaccaggaagggggaatctgcccctgtgatccagtcgccttccaccaggcccctcctccaacattaggtattattacaatttgacatgagatttgggtgggtacacaaatccaaaccatatcaggcttcaacaggaggcaaatgacaatcaaaatgttatcatctaaggagtattaatttataaagtgagtatttgtaaagatatggtaatagggaatccatagtggataattccagtggcttagcttttgagttgctaatacctgtaggcctgaaggaataaaagaaggagccattcacctaatgtgaaacaagaaaatcatgtacagtcatccattttgatagtagcagtgatcttagttcaggggacatagtcaactcaattgcagggagggacctggagaataagtgtcgtgatctactccacttctccatgatctcttcctggacctttcaaatggccaaaccctgctcaggccagaggtctgtgatacagtccatagaggttgggttcccagggcagaaaatggtataggatgttggaattaaagatgtaaaattaaagatgtatggtacagcctttctactttgcctctcagcctatattaccttttttcagggttaaaagtttgggatcctgacttaggtaatccacaaagtcccatcagctaccctatcatcaagtgatgtaaaaccggttataccttacttgaaacataacatattggctaccactggtactcttcatataaggtagcacagcaaaacagagaaaataactggcttaagtcatataaacatatttgctacagactccatgtctgtagatggtcacaaggctcagtttgtaatcacagctgcctccgtattggctacacggggttctttatgaagttaacctttaagagtttcattcctacaggatctcagtcttcggctgtgtttttattaggttgctgcagttttcctttactgaaactagaaggctttctggtatattttctgattctcagcagtcctcctggcttctgttgtgaaactgccacccaatttgctttttttctttccacgcttcagtgacatgaagaacacaaaatggccacacagtagtgttagctttcaattaactgaaaatatgatcatgttccttggtggaagaattccccactttgaacatgaggacttccaaactcaccaagcctaaaattggggagtgaagcaaaattcttccagtagcttatcaattattacagtgaaaagggctagtcccacctcttttgtttcattcctggacccacattctgcctatggggagataacactatatatttgctgctagtttgaagcatatactgtatcttactggtcagaacctcaacccgtcaagctgtttcctacccaatatcattataattgagacttcagcagactcttctaccattttataaagccatctgtttctgggtgatggagcacatagtaataccagtgaattacttgagtgtaagctcatcatctatatagtatgccctctggtcacaggccctgttgtgtcatgtaacacagcaattgacaaaggataagttaagtctgttgatggcattggaaacactgtaggcaacaaagacaaatctacacccagaataagtatttcttcttgggaggacacaaatattccccttccttcatgtggggtatccagtggtatcagcctgctcccacacagttggttgatcagtccatagaatggtaacattctgaggtttatgggggcatcctgctctttgttggctgcatgcttagcatatatggtagtcagatatggtgaggggaagaacatggtgagggaaagaccatgaacccatggatagcatccattcttgcaaccctagcagctttgtacataagcaaagcatgtattggctggggaaactggctgactgacatccactgaattgaccatcagtgttcatctgatgtctaagaggccactcctgcctgtgtgttctatgatgggtatttatatgggcatgaatatcatcctactctgtacttcttcctagaggtcaatacctgtcactgatttctaagttactttcttcccaagattatgccctgtttgccagaacttgcacttactagctcataagtcaatgtagaactgtacttctagttactttttattccaaagtggaaaaccacatgtacaacctagttctgctcattggagaggctgtcactgagtgggcttacaattcactcctagcttatgcaggcatactgtgcagatggagctgttctacaggctcatgcattttccttcttaacttcctggccactgggacctgcccatgacaccaaacctgtgggtttaagggagaggcggaaacagtaggaacaagtgactttggagttcaagtcacttgtttgggtagtttagtttacttgtgccttctaaacatgctttggtctggtcttgtatatactatttccattttatagtggaattccattttgcaagttcattttgagggtttgtttgatagaacagataataatcagttccaaacaggcagtttaaatagtcacttaatatttaatgggcaggctgttaatctctgctagcacctagtaagctaaaaactgcttttcagagagagtagctgtctacagagaaaagcatggatactctaatgcagtccccacataccagcttcttgagtcagagagtggtgtgcaaaaaaaaaagggggggtgaatttggaggggcagatggacgatacttgatagactttgaacactgaagaattttaatgagaaacatttaattagcttttctgttatacatctttgtgtataagaaggcagcagtagtgatttgatttgggattagaatttgatttaatttcattgtattgatctttcacattgtacttttcttttgtcagggatttttctttctttttccttttcttcttgtccttttttcactctctcttctcccctctctcctcctcctctctttccagtagtaattagaatatatttttgttgtataatccattgcaatatatggctaaactaaaggtctcagctctagactagactggttatccactgctagccacatttactgtgtccagtttcttttctgttattacctgcctctcttggctcttagaggaaaagttggatgatgtgattttgcattatttttgttatctatctctgttaggatagatctgtggtcagagtaactagaaagtatataactataatttgattatatcattttttgcattattatagttcctccttatgcctttctataggagtcctacttcagaaattactaagtttttgtatttccttttacagagtttaaattactttcaatacatttacttatctttaggatgacagacgtttttgattctatgatatgtatatgaggcagattcttgctcaaggagacattttaaattcaggaagtttgacatcgttttttttaccctcagtattattatatcttttggttcatttgtcatgttttataatgttaatgattgaacagctaatctgtatacaaataaaataggtactgccaggcaaccaatttttattgctgactttttggtaattgggagggttaattgataattctatataattatataatttgattctaaataatattataggagcagctttaaaaataatcttttgccttggcaattctggctaggtgtcagttttagagaaagaaggctacatttaagaatctgttactttggaggccatcaggacaggctggaattatgagaaaccaaatgtcacttcaatttattcagcatgaatttattttccaaaagaagcttaaaaatatactgcctactttttccctatttttacttggagtctcattttatattgacattcatattctcttttgtactttagcttgaaatttgttaaagtttctcataatttgaagaattgcactggagacatttggctttacattatgcaatgaatgctaattgacagctgattcataattagttaattgtaaacacttaactacagaaatttgttcagtgcactaaaagcccagacatcaccactgtgcaatgtatgcatgtaagaatctgcacttgtgcctccaaaatctataacaattcaaattaaaaagtatagaaatttaacaagtctggattgataacccttcttaaaaagtagctgttctaggaatgccttggtcaaattctcatctgtaggattagagatcttctgatgccatatgattaatgattttttcccctttctcatggtagattagtaatttgtgactcttttgtttattcttcaatagtgataagatccgtggatcccttttaggaagttttacaaatattgcaccaagggaagaaaatgtgtaacatttgcaggattaaaggaattatgaagagaattttgcccaggaattaagcatgtttgcattttcatatttttatgaaggaatatcaagtatcctggacattgaactgtctcagtgtggaaattaggttgactggatgttactatgggtatcatttctgccttagggaagagaacaaaaggaaacaggaccccataccctcctccacccatcattactaactttgaataagtcaccatgacgtagacccataatcaaaatgtcagccccaccccagaaactgacacatatccttggtattaaatgaaagtaatttttaaaaagaagtctgcaatatcagccgggcacggtggctcacgcctataatcctagcattttgggaggctgaggagggcagatcacgaggtcaggagtccgagaccagcctggccagtatggtggaatcttgtctctactaaaaatacaaaaattagccaggcatggtggcgcatgcctgtagtcccagccacttgggaggctgaggcaggagaatagcttgaacctgggaggcagaggttgctaggagctgagattgtgccactgcattctagcctgaagacagacagagactccatctcaaaaaaaaaaaaaaagtctgcaatatcaaagatgccatatttaaataaaaactaccaaataaagtacaataagatacaccatttaattttttcaccttaaatttttttcttaaaaaaaataaaaacagtgaaatacatcttaaattacttcactgcctgttacactgagagtcccagtgatagatctgttttattactgtttgtttcaataaccatttcctgtctccctcttacttccagcaacattctcaaaaccacgctcacaaacaataaatactaaaagcagtggcactgaagcatgacgtactcatcttcattctcctctaagcctggttaccaccaaagcacaaaagcccagctcccacaccctcaagagcaacatcctgaagggggattgaagggggatgtattgttagagattctaatcctgaaaggagaaatatgatcttatgaaaaatacatataattgaattttatcaaacttgggacaccatgtaaaactgagttattaatgtggttcatattcctctaaaaagctaaaaaaaaaaaggcctattgattatcagtttaagtaacctttattaagaagaaatatgttgagcatttttgggcatcactttgttgggtgcccaaagccaagagagcatcatcaactctggggaatgactgcttggaacatttggaagaatccctctgttggtacaagcttgaaacacagctcatgtcatgccccagtgttgcttagaatcttctatatgcagttataaccactgaagatttgttagtcaatgatggaccacatcttcagtggtggttccataagattataatgaagctgaaaaaatgtttatcacatagtgacatcaccaataatgccatagtgcaatgcactaatgtgtttctagagatgctgatgaaaacaaacctgctgtgctcccagtcatataaaagtagagcatatacaattatatacagtatatactgcttaataatgataatacatgttaccagttatgtatttattatactatactttaaattgttattttacagtgtactactactatgtatattaaaaaattaattaactataaagcatcctcaggcaggctcttcaggagggattccagaagaaggcattgttatcataggagatgacagttccatgtgtgttactgctcctgaagaccttccagtgggacaagatatggaggtggaagacagtgatattgataatcctgacccggggtaggccaaaagatataaggaaagaaaataaaaatttaaagaaagaaaatatatttgtacagctttacaacttgcttgtgttgtaagctacatattattacaaaagagtccaaaagttaagaaaaaattaaaaagtttataaaatagaaaagttactgtaagctaaggttaatttattattgaagaataaaaaatgtttaaatataaatttagcgtagcctgtgacagtgtgtataaagcctttagtagagtacagaagcaacacgtctaccagcagacatttaaaagagtttagtgtacatactaattatatgaaaaggttttttgtttatatgtctatttgtaggccttgtgtccaaaaattgagtccagtaacaggcattttggcaagcatctcagaaatcttgatttcgacaaatagctcagttgagtgagatgcagatggacaacacagaaacacacgttttgagagtaatatgtaagtttaaatgcagttgttggctttatagactttatgtgattagcattttattttagagggcttagatatgaagacattttttatttttttcaaattttagatttgcatttttttatttttagtaaaactaatttttgcttttggtgaatgaaatttcttttctttcaatgaaagacatcacattttcatgtataaggatgaaatcattaaatcactgtttgttaagctaagatgttgtgactattaaaggggtttggaatgatgtaaaggagctgtggaaacgggaaatagaaattttggaatactttgtagtgagttagagcttttatttatttatttttcttcagaaaaggtttttccttcctgaaaaatctgtgattctttttattgactagaaagatttggagcaggggtgaatttgattagagatcataattttaatacacatgttggtactatagaactgtgggaaataattagtgaacagtatcttaatgcacttattatcatattgggaagcatttccatcttttaaatttagaatgttaataagaaaatgcttgtaaatacgacctttaatgtgaatttggagacaaacctagttccacttaaagtgagttatataaaatattttaaagataaacatatatatttcctgtggaatgaatcttttgttgcatttgggcttttctcaattatagccatgttcactgaaccagtacaggaactgagaatggagtcttgtggagaaaaatgtcaaatatacttttctcagcagttgttgagctgcccagttcttgatggggtacaattattgtttaggtgttgattctagtagcaagttaaagggagggaatttgaaaccttgtgttttccaaggattagaaataaaaacaaagaaagcaaaacaagcaaacacaggaccaaagctcaagctttgattttgaagttgatttttgaggccgcatgactaatgcttttcatagtactgcatactggccgtgagcaggaagcaaagcagatagagtggctgcagatacataattacatggctgcctctgtcttctctgggagtttttaaatggaaataatgttgttcttgagggtgcagagctggacttttgtgcgttggtggtaaccagtcttagcagagaatgagtacgtcatgcttcagtgccactacttttagtatttattgtttgtgagcgtggttgtgagaatgttgctggaagtaagaagaaagaaggaaaataggtattgaagcaaacaataataaaatagatcgatcactgggattctctgtgcaacaggcagtgaagtaatttaagatgtatttcactatttctttttaagaaaaaaatctaaggtgaaaaaattaaatggtttatcttactgtcctttctgtggtagtttttatttaaatatggcatctttgatattgcagacttctttttaaaaattacttttatttggctgggcgcagtggctcacacctgtaatcccagcactttgggaggctgaggcgggcggatcacgaggtcaggagatcaagaccatcctggctaacatggtgaaaccccctctctactaaaaatacaaaaaaaaaaaaacaaaacaacttttatttaataccaaggatatatgtcagtttctggtatagggtggggttgacatttggaaaatgaataaggaagtatcagaaagctttagatatgttatatccttgaggatatgacactatgagcaaataacactagagaagccttaccaacctgtaatttcttgaagacaggtaccacgtttttttcatttttattttgttccagtgatattttattcaggagtgcctactattgttagatatctgattaggtattagagatttgaatagattatatgtatgcaagtatgagattatatatgtgtatataagtacatatatatttacttgtgtgtatatatatatatatatatacacacacacacacacacgtgtgtgtgcccatgcacataccctagagcctaaacattttttgaatgagttaataagtgggttaaagggggtgggaaaactgaatatagacagagccatcgaagccttgaagggtctcatacattccatttcagcagaatggtcaggtttagctggccatattttggattaggacagttatgactactattacagtgatttgaacagtagacttgctaatgagatataagttttcattatttggctgtcctcatttcttcctcatctacttttcaataaactttcaaacttttcttaaagtagacaatttgattaaacatgctctaccttaaaacttttaaattatttttaaataataaattttaaagtaatattatagatcctttcataatttacttaatattttgtctttgtatgtttatagtaggaaaaaatagaaaaacagagataaaagcaaagaaaaatcattaaccccattatcaagagaccatagttacattctgatatacagtgtatcagataacttttctatatattagtatacatccataattaaatgggcaaccctttaaacttgattcttttttgcacttagtgtatcatgaacatctttttatgtcactaaatgtagatccaacacttcaatattaaatgtatgaatgtcacatacataatatctgtgatacgcatgggcagtgcttaataatttgaaaatattatacatgagtattaattctaacggctaagttttcccataagaattttgagaattcttaagagggatttgaaattgtgttgaattagccactgttacaagttattacaatgatgatgattactgtttttaaggtactttaaaataaaaagctcttttaaaattctggttctgctaataacttgctgagtgcccttagtaaagtagcttaacttttctgattcttgggttcctcatttgtgcaacaagtacagaatttttaacatacagaatagaaagaattagatgttgtttggggggcacttagcacaatgctaggtacatagtaaatgcaataatcagtatcagttattgaaatcaccccagattgttaagaaattttctactcttacaagcatctcatggtgaaacatgctgagagaaacatttgttctagctctgtttcttaatggttgctgtactagatgctgaggacataattttaaacaaaacatgatccttggctttatggcacctataatctggtagggaaaatatgtcagcagataaatttataatactgtataattatataccatttgagcagtttggtcaaagctctccgtgaactcagtcttgggaaaggttgacccataagtaatgaggtgcctatgtgagttcactatttcacttgttttaattatgaataggccaaaacagtaattatttgtatcagtatgtctggtcagagcactttgggatcacagaattgaaaaactgttccccataagcaatacaaggcttaggtgaatttaaagtttccattttactgatgttgaataggctactaaattaagtatcagtatgacattattagcacacagatttagttgtacttacatgaaatttagctttgggttttctttcttttttttttttttcatgtgtttttatttatttatttatttatttatttattttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgggttttcttttaaatctgcttgtagcattatgctcttggttatagtagtttcatttggtgaggaacttgataatatggtaagtgaaatgtatcagtgttattttacattcatacattacatcattacaagacctacagagtagagttgctcagtaacatttaaataccttatctcaatttcaatttgggtaaatagttaaaagaataaaataggtaatggaggagatgtaataaattgagacatgcacacaatgcagaggaccactgtacttgccaaactgtacctgtgctttcagacctattctgtttcatcggagttaggttattggctgtaaaatcaatgggtttgtgtatataagatatatatatatatatatacacacacacacacatacacatacacacacagtgtgtgcgtgtgtgtatgtgtgtatatgcatatgttatacaatgtgatatatatgtagatagatagatatagatataaggcttgaatttttataaattaaaagagatcttgccaatatgtaggcagccactatgaaagctcttatgatctttgtagttttgtgcctgacagaattttgaaacctttgtctctctcagtaaaggcaaagaactgtcagagtgtttgatagatctttgatatttcactgctatttagtccaaaagatgtggatttttttgttgttggaaatatatatatctcctgagattctttgatatattttaatgtagtgtgtcctatgccattgtcaaagtgataactgattcatttatcctgttcctaatataaaaacattcacaaggctaacatccatggctctctggctatatttaataaattcataagtgtgattgggtttgttgatatgcaaagtgtcaatttatatcagttttctgatctttgattattgttttaggtaaaaaaattagtgtttgttagtttttactttactattgatataaccatcttgtttgaaactatatatcataaagatataaattcttatatctctgatatatagtttcaaactacctatcaaaataatacttcaaactatgttttaaactatatattcaaaaagtatttgtttccagatcttgcttcagatcaattaattcaagtttattgtgacaggaacactccccaaataaaaattctctgggcaattaaaatcatatgtgtctctttctctttgttgactgtataaaataaaataagactgggcatggtggctcatgcctgtaatcccagcactttgggaggctgaggcaggtgaatcacttgaggtcaggagtttgacaccagcctggccaccatgtcaaaaccccatctctactgaaaatacaaaaattagttgggcatggtggcacgtgcctgtaatcccagctacttgggaggctgaggtgggaggatcgcttgagctagggaggaggaggttgcagtgagccaggatcacactgctgcactccagcctgcaagacagaataaaactctgtctcaaaaccaaccaaccaaacgaacaaaaaaaccgaaatcccaaaaataaaataggaaaagttaacatactttgtgaatttgttcacttactgtaagtgatacattttaatgtttttcaagtgagttttccaccaattttatttttgaccagttgtatcacacttacctagagcagaattttttttcttcaatggttcaacttattaaaattatttaagacatgctaagtaacaagtaatttaaactgagtatacaagattaagtcagctggtaaactgtaaactgcaaaacttactggggtgggcagggcgcggtggctaactcctataatcccagcactttgggaggtcgaggtgggcggatcacctgaggtcaggagtttgagaccagcctgaccaacgtggagaaatctcgtctctacaaaaatacaaaattagctgggtgtggtggtgcatgcctgtaatcccaactattagggaggctgaggcaggagaatcacttgaacccaggaggcggaggttgcggtgagccaagattgtgccatttcactccagcctgggcaacaagagcaaaactccatctcaaaaaacaaaacaaaacaaaacaaacaaaacaaacttattggagtgatattaagaatggtcaaggaccaatgctttggaggtaaaatcttgggtttatatttcagcttcacacacagactagctgtgtgaccttgagcaagattgcttaacctcttcagttttctcatctgtgcaataggaataatgctacttctcccggtgttgggttattgtgagagcttaagtaagctttcatttgtaagttagaacaatgcctggaacatagtaagtactccataagatactggtcattataatttacaatttgtaatatttataaattattattattttttctgtccagattatttctctttttaaaattttctgtgttggccaggcacagtggctcacgcctgtaatcccagcactttgggaagctgaggcgggtggatcacctgaggtcaggagtttgagaccagactggccaacatggtcaaaccccacctatactaaaatatacaaaattggccaggcgtggtggcgcacgcctgtagtcccagctactcaggaggttgagtcaggagattcgcctgaagccaggaggtggaggttgcagtgaactgaaattgtgccactgcactccagcctgggttagagagtaagattccttctcaataaataaataaataaataaataaataaataaataaataaaataaaatttcctgtgtcttttatatttcataagtggtttataccctgcattttattttaagaaaaaatataaatgtaacatgtttcttgtacatggtaaaatatgtactttttggtttttgtgggaaatgtgcaaaataacctttgtgttggggtacattttttttctttttgggttgggaaaattttagcacccaaataagaatcaaagaagtttagagtatagattataggatggaacctttcaattcaacttcttcattttgtagaagaagaacctaaaactttggatattcatctttccaaaggtcacattgctagtatcttagagttgggtctagagtgtggacctttcgattctttaacctccctctccattttgtttttcccgtggtgaggatagcatttttgacagtgtttgagtaactgtaacatccatattgaaagacagaaaagacataagcatcatcactttgaaactattcatggatacaatgaaagtcacattaagaacaatatcctagtgatgacttaaaagattgggattgcttctcagcaagttagttgaccatacattctcaggagcatactactgtgcagatgtggtccaccttgcagaggacctaaagcttctgtctgtctagcccatacctctggtctttgccacgtaatttttccaaaaagagaaacctgaatacagaagagcagagtgttatttgagccaagagctggtgaaacattaagtcagaatgcttcctagaaatcagtagactaagactgtgttagctcatgtttcatattacacaagagaaaataaactgaaaggtcagttgaacagttacagcattgcccttttccaaggtaatcagcagagcatgtagcaaagacctgaacaggagcgtgactggaaagagagtggctgataaagaggctggcagcttaaagtgcttgggacaatacttgacacttccaggcctgaccagatgggccatctcacagggcttaccttcagtaactctgatttattgcattcagatgtgtgtatgtgtgagcgtttgttaggcagtcaggttttcactttgccagaagactctagaaattttaatattgaccattaatcatacctcagtaaactgtaaagtcaatatattattaatttgcttgcaaccaagagacaaggcacagtgattaaaattaatttctagctatattttgttaaatttattctaattaatctgttaagtcaaaatatgtttacattaatggctttatagtaggttctttaagttgtgtcattaaacgtgatagtatttccattattctgaatgtagaataatgtagtataaataaatattgttaaaagaaatggagttttaaggatttctaaatggtaccactaaatgggctttgtccagttttttgttaattgaataagaacatttctttttcttttcttgattttataggatttagacctagaaagatcttagcagtgatctcccttgaccccctcacatctatggcccagtgccagaaattaagaaagaatatttaacaaataatagccgctatttacttttgggacactcttttaaatagtagcaacttttaaaagataataattttgaatttacctcatacttcctcccccaccaaatacttaatgatctcttcataaccataacttctctatatattttattaatttgagactgaaagtagccaattttcattgcacttaactttagactaagtaagaacaaaactatgacttaattagcttttattccttcacatcagaaaataagacactaacaattttttcttaaatgtggactgaggatgtgtttattagattggtcacaatgcatttgattgtgttttagagatggtacaatatgaataaaatttaaaaagattaaaattaataacacaatgtgtgcttgtaatgggattaatgtttaaattttatttttgtattaaaattagcatagcagagcaattccagttttttcatgttttaagttttctacttagaaattggagactaatgatttgctgaaagtagttaataatttacaactaaatgagatcttcatttcttattttttttaaaaagaaagatgtaacgtgtcataaaataatttattttttgtgggctggttatatataagcacagccacctagacatcaatgatattatcattcctttttataaatgaggaagcagaaattctgagattgttaagtgaaaattgaaggtcagttgctaatgggactagcaatatataactcagtcttttatttgtgaatctattctttcttgtgtagtaccatgcctggcacatagtaggtggtatataccaattagtcttagagtaattccatatatgaaacaactcatttaatagctagtttcaaatctcgtgaacctaggcattgataaagattataatagtgggaaaagctgcttgagtgaaaaaccaccgacctgcagtttgagcagaagtgaaatggtgggaattaactgtctgcaactcacttttaatcagttaggagtagtttgcacagagtagtttgcagtcattttgaagaacagtgagaggtttgtgttttcactcctggaacaggcggtctccactgggtcatcacatccccagtttattattcacctgtgcagatctgtatacatttgatcttgatagacacctgagctgatgcattgaattctcaagtgagacgatatatctccttttatagctggtcatttggtcacacaggatgttaaagaagaagagtgaggaatttatctaaggacttcttcccattttctgtcccgtaatggtcaaagtttgtcctttggagcctttattcttctacacattcattttattttgctatgaactacatgtttatatccactcagaccataaatgttgaaactctgatccatcatgtgatgatatttggagatggtacctgtgggaggtgattagttagatcacaagagcggccctctcctgacgtgattagtggctttataagaagagattggggagtgtttaggttgtttcctccctttcctgtctaccatgtcaggatacaatgagaatgtggccatcagaaaacaaggaagagtgccctcaccaaacgctggatctgctggttctcagtcttggacttcgcagcctctagaactataagaaataaatgcttgttttttaaaccgtccagtctatttgttataacagttcaaactgatcaagacatgcagtatctggcctcttcagatagctgcttgcaagccacaacctctatagggccagtcaagcaagtgtacaaggagagccagtgggactgactaaatcaggaagccacctatattatatctaatatagttacaggaattatatcttgtttatattctaatagtctattaatttttctgtttatctcatttccatcaatcttattgaatacattaattaatagtgtattcattatttcacatgaaagatattgtgctaaaaagtttaggtacattatttcatttgattttcaaagcagacttgtaagttccattattattcttatttcagattagaaaatttagttacagttggtaagcagtaggattaggattcaaatttaaacataataatcataatcttaaacctaactctaaccattttctcaccattgaaagaatctgatggataattggtgctcactaaatatttgttcattgaaaacttatgtgccagtattgtatgtactaggaagacatcagggttcaaaatagataattttcccagtctttgtggaatttcaaagcgaagaataccatttagtttagttcaaaggaaagaattacattcagaattacattctcttttctggttgtctttatcagtaacttacgtaatgctgtcctactccttgctttctcttctacggtctcccatacataacagagaatatcttcaagttgtggactttataatgtcttttatctctatattctcagtgactagcatagtactggatatacagtagactctcagtaatgcttgtataataaatagatggatttcactattccttgtcacctttgctcagtttcatttctactgttttctgatagatgaagtgaagagtgtatgctaagttgaatacagattggaaatgtcactgaaaatttatgtaggattttgaaaatagatgcatttggtgatttgatgacatttacaacattttaaaaataagaaatagttttcaaaaataagaaaccatgtgtaccatgatgtcatttaaaaaattcttttcattgctcactcttgtctaagaggaggatctgccaatatctgtgcttaatcgtttacttaataaatactttattaatttatggactctgcctaataaaattcatcgttcaaactgctccctgtaaaacatgtctctgatcatatcagttatctcctctgtaaagtttttaaggattttatgttttattccacttattatctgattgcagacaatctttttcatcccaattggccactggaatactccactttctcctgctctgactacacacagctagtcgtcatgtcgtcaagaagcatccaatttttacacatgtaatgcgcttctctgtcttttctccagctgtcaaaatgtactactcatccttcaagatacagcacaaatgccagctactccctaaagccttctcctaatctcttcttccagtcaaaatcactagttccttcctggtcttgctcattcttctgtgaacacttgcttatctcaggcctgtcctgtcatgagttggacattgtttcccattgcacagatgaacatcttacaagaaggatcttgtttcacgtaactgaattattagcacacaataaatatgtttatcctgcaataagtatgttgggtatttttgtcgaataattgccctgattgaggaacataaaatactcactttaaagtctcgagtggttaaccttcatttggcagccttaatatatgaataattttgtatattttggttatttttcacttaagaaagaaagtttctgtgagacacatgcagtctttttaaagactgagttggagagcttttttatttatttatttatttatttatttttattatactttaagttctagggtatatgtgcacaacgtgcaggtttattacatatgtatacatgtgccatattggtgtgctgcacccattaactcgtcatttacattaggtatatttcctaatgctatccctccccccttcccccaccccacgacaggccccagtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaagggacacgaactcatccttttttatggctgtatagtattccatggtgtatatgtgccatattttcttaatccagtctatcactgatggacatttgggttggttccaagtctgctattgtgaatagtgctgcaataaacatacatgtgcatgtgtctatagcagcatgatttataatcctttgggtacatacccaataatgggatggctgggtcaaatggtatttctagttctagatccttggggaatcgccactctgtcttccacaatggttgaactagtttacagtcccaccaacagtgtaaaagtgttcctatttctccacatcctctctagcacctgttgtttcctgactttttaatgatcgccattgtaactggtgtgagctggtatctcattttggttttgatttgcatttctctgatggccagtgatgatgagcattttttcatgtgtcttttggctgcataaatgtcttcttttgagaagtatctgttcatatccttcgcccacttcttgatggggttgtttttttcttgtaaatttgtttgagttctttgtagattctggatattagccctttgtcagatgagtagattgcaaaaattttctcccattctgtaggttgtctgttcacttcaatggtagtttcttttgctgtgcagaagctctttagtttaattagatcccatttgtcgatttcggcttctgttgccattgcttttggtgttttagacatgaagtccttgcccctgcctatgtcctgaatggtattgcctaggttttcttctagggtttttatggttttaggtctaacatttaagtctttaatccattttgaattaatttttgtataagtgtaaggaagggatccagtttcagctttctacaaggctgcactaaccaaagcagcatggtactggtaccaaaacagagatatagaccaatggaacagaacagagccctcagaaataatactacacatctacaaccatctgatctttgacgaccctgacaaaaacaagaaatggggaaaggattccctatttaataaatggtgctggaaagttggagagcttttttacccttccaaaaattttcaactctccactcctttaaccctattttcccccttttgagctattaaaaatttctcttgaagttttacttctgtgctttttcttgcttctaatccaagcctcccataggaagcaaatgacaaaataaaatcttaaaaatcagctattaagaaaggagttttcctcgtgtgtttcttgggtttctggcctgctcagaagcacttgagaatggattctatactcaatacatttccaggtaagggatgatccatctccgctgagatgtctcctgtgttcacagtcctttctgtaattagagcttcagtactgatctgggatgaaccaactgccttccaggagagcaaagattttagtttgtttcattttgttttcatacctatcgcctagtagtaactccctgccgcccctccgtcccaccctgggtagtccagtcaactttattttcttccagactttccataactcacatattcaaatcaatttggagtgtgtgatatgtgttagtgtatttatatttgtatttttctattccaggaaaaaaatggaaagcattcttaaacacttttggaacttgggaaaaatcgtaatgttgctaatagctaatatgtgttttaaaatctaagcaagtgtaataagtaaaagaacattgataaagtaaaaagtatactatagtgttgccacttcaaggtggagaaaagttccagccaccatttattgaatattgcgggtaatgctcctgctgtttcattgattccttacaatctatgaggttcccccgagcccccaattaacatgttaaaaaaattaggaaaaaggagattaagggatttattcagagtcacatttggtgtgtaacagagttaggatttgaacgtggactatttctagaaataaagctaatatcagctacccctgattctcttaaatataagattaaattaattaaatataattataaggctaaatataattataaaattaattaccttaaaataagccgggcgtggtggtgggtgcctgtagtcccagctgctcgggaggctgaggcaggagaatggcgtgaacctgggaggcggagcttgtagtgagccgagatcgcggcactgcactccagcctgggcaacagagtgagagtccgtctcaaaaaaaaaaaaaaaaaaaagattaattaccttaagagtaaaacaacataaataactttctttaaaagtgaaatatgacttttaatttgagatttaacttgaaatctaccttttgtgattaatgatgtgtgatgtccttattgcttattaccttcttgatcttggacaatttatgtctttatgtttgcctctgtctcttcctatgtaacagaggatttaaaacattgatatagacgtcacatctgataatttttataacagttctttatatctatacaaaatgctagttcctgtagtagtttcattttatgttcttggttaccagaaatttgacctagtttttaaatatcctgtaaatccatagcaaaatattaggagagatgactgtagtaggagagggcacaggcatgatgagcttgctgtatcctcaggcattttcctttttgagccacaatgatttcaaagtacaatgtgtatttctgtatcagaagctgtagggctgaccttgagggaagtcaagatacttagttaaagtaatataatgctataatcgtggttccatggaaattttactaaatgggacgtttgaaaatactttaagaaacttcctaaaaatgattattttttaaacttaaactttacataaatctaaaaatttatcataaggtatgataccaacattgaaagtaaaattactaccacatttgtttatcctcccaacgttatacctttttggaaaatcagtagttttccttgtattatgagggtgtatgtgtgtgtatattttttaccctaagttcagtttttgttttgttgattgttccacactgatcattttattgcctgttattacttacataacttaatatggattagcatttccatattccaagaagtatagatgactgatattgggaagaggttaaaaaaacacacacacaaagaaccttttctcatatgatttaaagagtttgcatatggtattccatcaggcctgcatatctagtttgttcgtctaggtaagtattttaagtattttgaaacagttgccactgtttaaattaggaagagttcatagaaaaatctgtatttttttatgttcttgaataattacatgattggacaaactatgctacgcagcaatgaggtgtaactattaaatagaggctgtgcttttagatgaggcttgtactctccatctcaacagtttctttctgccttgttttccttaattatgttatcatcagctttgcaattttgtgtttcttgtgtggggtcagctcctcataattgttacacctgcctggcctggctccttggggtggttcagtttatgtccccttgaataacactatctgtgagactgggattatttcgggcaagattccatatcagcacattttgccctacctcattttttttgatggttgtcatataatttattatttggatattccacagttattcacctagtttcccattgttgcaaaagtgggttattttccatggttttgtagtataaatagtgccataaagaataaatattattatatacatagatgtctttgcatctttgtgtgatgtatatccaaagaacaaatttctaaaaatagagttacttgaagagtgtgattttgaaattttcatagctgttgccaaattgttttctaatttatatttcaaccaagagcatttaaaaatgtcttttctcctgaaccatatcccatccatatagactatcatatgtttctgggtcttttaggtggaaaattgaattttgaagtttaggtttgcacttctttagttatatatgagtttgatcattgtttccaatgtttattggccacttgtatttcattttccatgatctcttggacttacttatttttaaaatattaaagtttataaatttgatttctctggaagttattttggttttagagatctacttttttatgacaaacttatagatttcaatattttattgaataagccatcctttccttatggttttgaaatgccctttcatcacatactgaatttttgcttctgcttaatactatttcagaaactcagtttttctccatagatctatttcaaatgctttcagttcctcaaattttataaacctagttttacatactcagtaaaattcctatgaatattatataaaattatgttactgttttaataatgtgaaaaattatagttttaggaaaactgtacttcattttttaaaatggtagttatttgttatacgtgattagaacaatgcaacagagaaagtaaaaagaaacctcaccaaaataatcccactgatattaagggtatatcattcttgatatttttatatgcctatctttagatagcaggttaaagaaaatgcttgatagaaatactataatgagacatgagaaaataaatgtctgttaactttaaacaatgaaactaaagtgaaatggaaagaagaaattattggaattcgtatacaaatttctttaccttaaatagttatttcttaaatgctcatctaagattaataaagaaattaaaaagtataatgatgacaaccttaaattttactctgtgttgagtgactctctgctataaaatttcatccccctttcactcatgcctttttttaatataatatttttactttgtcagttgagatccttttttcatgatcacattcatacagttccacagttgtctagccaaggttctatatttaaggagtcagttcttagacacactcctacaataactgttcagtcttgtatgtgtttgtttttaatttttaattgccatttagaaaaatggaaagtagcttatttttcttctagaatggttcattagtgtcattgactaaaactcaattttaaatttgacaatatttaaaaaaatcccttagatatgaatagaaacttgtctcctaggatattcctagattacttttccttcttagaattgtgtggagttggctttatcttttggtttttaattaatgttgcctttttctgcctggttgtctatagactcatttcttttatcttttgaatttcagttgcttaaattgggatacattttgtgtgtgtttgtttcccaaacctttcttaaaacattgtatgctctttttaatatgtggatttaattctttaggataattttccagttttatatcttccatattcattttatttggttttatttttcagtcagcagctatatccatatttggatcatttttttttgtctatgttgggtatctcttaggttctttttaatatattcaaattcattgtttttctttaattatttcaattctcaattatttattcatttaataatttgctatttttgctatacttatgtacttttttttgttgagtctaactcatcattatctattgatatactttattcctccatttatttccttaagtctgcagtcttttacttttcattctgttgtcatataatctttcagctcttattcttttgagtttatttttaattaagttgtataatgtgaagtatttgtaaaaaggtccattttctatgtagctaagttgagatgtggttcattattctgcatctcaaattttgtatattccctggacatcccgtgcctcgattcctgccatctttctgggaaagattccttacccctgagggtatggggaggtgtagagaagcttattggcattgcctagttcattgtatagttctggaaccttcacttctgacatagagcacctggcacatggtttacttctccagttttaccaagtttttcctagtttgtttcttactggatataggggatactaatgaaaatagggtagtactttttggtgtaccagtacctgatccaggggaactgggagagggtcaggagcaggcatgtgctgttctttgccctgcttaggaatctgtgatttcttcttgtggccactggcttttgtgctttgatatggtgtatgttcttgacatgcttagttgctttagggaaggaaaaggctgcaggccaaatctggcccactacctgttttttgtaaataaagtgttattggaacacagccacacccactcattaactttttgtccatggcccctttcgtacttcagagacaccctcgagtagctgtgacagagaccatatggctgacaaagcctaaaatatttgccgtctgcccctttacaggaaaagtttgccaaaccctgcagtaggctaattttatttttcttgctgaattttgactgtgttatttcattttcttaggaatcagaggagagagatgtagagattctgttccattacactgtcttgacatggaagttgctataatgctagtttttaaaaaaattcatgaaatagtataaccatcatatttcctctctcataccagtgcttgaagttacaaaaaatgctagttagattagctcagtttattttaaataagaatgattttatcctaccaggtagcctctactaataaatgaaattatttatattattcttctttaataatgtctttttttccctgaataagactaaagcagttacttaattacagtagcttttctagaagactatttaattttctaactcattttctttcatacttcttcaaaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttagtaagtacttgaaagcattgaactaaatagtaatatcttattaactatttaatacatatatttcttatatttcatgtatttaaccatatgaactttaatgattacaaataaatatcagacttttcagatagagccttagaatttattaagctctttgtatggtgcagctgtttctgttataatgtgatatgtgtattcttgaaagactttatgttctgtaaaatcatgtactagaaataacaaggtttatgagaaaaatgctattaggaagacaactccaaatttacttaactttgttagcaagctctgacaaaaccaatagcaatccaggtaaaaatattggcataaagctccgctagcattcacacctggctggctggcatcatagttcttggatcctctgtatagccttatactcttttcggagtcttcagtaaaagtagatatctaatctggggtgtaacctccatcactcatttctttttttcctttaccttgttttagaacacagtgggaaatatcttgtcagcattgtcatttgcactgttaactccactagacagagttaacgctatggaaagcaaagtcaggtttctagcttagagtctggtgggaggaaggactgtaatgtaaataactgtaatacaatctactaagttttattcttgaagggtaaatacattactagaatgatgacaaggatgaaagttcagttttgaaagtggaataactggaaaaaataggccttggtaaaggttcttgatacaaggaaaaggaatatcaaaatgatcataatcctttaataccatagaatggtataatatttaaaatttgatttcactgggctcaaaagtctacatgctgtgttattcaatttttatgacgttttagaaacagcaaaactgtggggacagataacagatcattgttgtcaggggttggggtggtgggtaaaggttgattacagagggacgtgagggaatttttggggtggtgaaaatgttttatatcctgattgtggtgctggttacctgattgtatgaatttatcaacatttatagaactgtacatgtataaagaacaaattttaatgcaatgtaaattattcttcaaggaacctgacttaacagaactttgggttttatattaatatgcattgtctaagacagcactgtccaacagaaataaaatgcaagccacttacgtaattcagaaattttagtaacaatattaaaaaggtgaaaggagaacagtagagtaaaatttaataataaattatatttacctagtatataaaatattatcattttaatatttaatcaatgtaaattttattgatgagaatttcattcttttcttgtaccacatctttgaaatctgggtacagcaagtcttaattaagatggtaagttttcattgcaaatacagtaatccttcggtgtcaatggggaacttgttctacaacttctcgtggataccaaaatccaaggatgcttaagtctcttgtataaaatgatgtagtatttgcatataacctaggcacatcttcccttatactttcaatcatgtctggattatttacaatacccaatacaatgtaaatgctgtataaatatttgttatactgtattgtttatggaataatgaccagaaaaaatagactgtttaagtgttcagtacagatgcaaccatccacttttcttttccaaatattttcaatctaagattggttgaatcagtagatgtgcaacttgagggcagactgcacttaatttaaatttaagtttaataaaattttcagtttaaaagtatgttcatatacccagttttttccaaacaaaattaagaggtttccagtaactgacttgaataacacttttaaaatttaaattaataacttaagataaaataaaatataaaattcagtttctaagttgcactagcctcagttcaagtgctctatcgcctcttgtagctactggcttctttactggaaagtacaggtctaaggactgaaaataattcatggtgtagtcccaaaaattagatgtgtctcgagagttgttagaaaatttcatggacacttttgtaaaagaccacgagatctgataattcagattagcttggcctgatggtaattattaaatgtattttgaggataagagactactcacttaagtcatggttgttattaataattttttcttttacataaacacaatatttccccatcttctctaagtgactgccttgactttttgttactagaccatttagaaatctgcctataatcaaggcattctatttcactagttttcttttttaaaattccatgcagaggttgaggatattgagaatgtttaagttaaatttttatgtaaagatacccaactactataagaaccaccattaatatctgatagttgcatttggttcccccacccccatatttatgatgaaatccacttaatagtttctataaacataaaaatataggaaagggactatatgaaaactagatttgtgaactgtcataatgactattgctcatttattaaaagttgcgctgtgtgtgtttgtagaattgcatttaaaaattttatgttcttggacttaatgcttaactgttaaaagtacagtaattaaaaaaatgttttgtaaacaggaaactaaaattacctggcccatattttattgtaaaaatgtcctctgttaactttttatcccaatttacattgacttttaaaattccactctttataaagatgtattgcataatttcaaatttctccatatccttgtgataacattcatttaatgattctcaatcaacaaatatttagtaactaagggcatgaaaagcagcagatgtaatcggtgggcctttatttttattgaagagataagaaaagactacagtaaatgaaattgtgacagaaaatagttaaggacaggcagtatattgggaaacttaaatgtctaatttattttctttttttagaagaaaggatgtcttttttatgtccaaagttataggatctcaaagtctctttgtgaatgggatctcaactttttttcactaatgggctttgactttcaaaaacaaacaatttgaaaattgagagtggagcctgaattctgagccaatgatgcatttagaaggtttctttgtaaaaaaagatatacacgtgggtcagtatgactttagtgaacacagaatttttattgtgatgacaacctacgtgaaaatatactcttagataactgaactaaccatgccttaacacacacacacacacacacacacacacacacacacacacacacacacacacacacactctctctctctctctctctccagggattctgtattttatttttcccttattaacataaaatccgttttttcctaataatagttgagcaaaaagaaagattttttttcttttttttttttgtgcctactgacctgagactattttagttacaggtacttagaataatcaaatataaatgctatttaagaaagaaattgcctgctgggttcagtggctaacacctataatctgtaatcctagcactttgggatgctgaggtgggaggatcattcaggtgtttgagaccatcttgggcaacagagatagaccctatctttaccagaaaataaatagataaatacaaataaaaaataaataaatcatcatgaattggtgtgtaaaataaaaaatgatgggatttagagtttgaaaacacagttgagctctctaaacaatggttcttcctctggcttgttggggataaatgtgatcataattgttttaactgcctgactggtttgctctaggtactaactagattgtgaatgtgagaaattttgtaccttaatcagtgctacagaaatgttaattggcagtattaaaaaaaaaaccctcttatttgcaaaggtctttttatttatttcagaaaattactgttaatttcaaaaggcatttgaaccttgcaaaagtaaaatagtctgttttgccaaaactaaggcagatttgccatccacattttaaaaaactagtaggaaaacagcttcactttaaatatagtacttatatttttctttatttgagagaaaataaaacaatcatttctttttcgtccagtcgtttttaaacaactagtttttttagctaacagctgccgcagcaacctagaaggatggtgtatatatattgacattcatcaggattggactcttaccactgaaaaagtctttctggttaaactagaaactagtttaaagggctgagatgaatttctaaaactttgaatcatctgcaatacagcaaagactcattctttagaaaattagatgtgatttaaaatacacttggagttttggttctcaatcatgtttattgcaggttgctaaataattgaaaataactagctgctttccagtatctagatgataataagagagaaaggcagtaaactacatatgtcaatataaaataattgggttcttatttgctataacggaaagcatttcatttaaaattactaagtctgggaggtaggcacctttcaaataacctaaatgtctatcactgatagactgaaagaaaggaaaaaagaaacaaaccttgatttttatgcctatagaaaaaggaaccactgatatttttgcagagtgggaaagatagcaagaagaagtttttaactgtttttttgggccagttttgtctataatttttttttcagttatataagttttcagtgtcataaaagccttcatatttcttaatcccacgtgctctgaaaccgtgctactcaacatgtgctctgtggaccagtgggttctgtgaactgtaatctgttttcagtgatattgtcagaaattgggaataagcatttaggaatgttgatagcaatttggcagggtcattttatttctgtagaatctaataattacaatacaaaaacttgggcttgagttttaaatattttttctttcagtttttgaataattaattttatttacataattattggtctatagtgaaattaaagttttttaagaagggtaattggtacataaccatagtctgagaaacactgatacgaaaattagcgatcattttttactggttggaagccgtttctggttcggggtataattctgataccagcttcttttggattctgtttcttcatctaatcttttttgtctctattagtcagctttcactgtggcatgacattttacaaacaactccaacattttgatggcttacaacaacaaaggcctctttcttgttcattttcgctgtagtggtcagctgtggctctcccgcaactgtcaaattcactccagaatacaggttaatggagtaaccccaatatggggagccactgatcacatgagagagagaaagagcaatgaagaaactctaggatggctctaaaaacttcagcttgtaagtaacatatgtgatttgcacttacatttcattagccaaataacatggccaagccttatgtcaatgaggcatgaaggccaaatcatcttttatggaggcttgtgatggttaatactgagtgtcaactggattggattgagggatacaaagttttaatcctgggtgtgtctgtgtgggtgttgccaaaagagattaacatttgagtcagtggactggggaaggcagatccacccttaatctggtgggcgcaatataatcagctgccagtgaatataaagcaggagaacaatttgaaaaagataagggcctagtttcccagcctacatctttctcccatgctggatgcttaaagcccttgaacgtcagactccaaattcttcagttttgggacttggagtggctctccttgctcctcagcttgcagacggcctattgtggaaccttgccattgcgtaagttaattcttaataaactcccctttatatatctatcctattagttctgtccctctaagagaaccctgactaatataaggctcatgaaaaattgggaacaataacgtatgacccatctttgtggtatacagtgtaaactttccatattttttgatattctagatatcttacagtttttgtgggaagagaattgttttggcagggtagtgatccagacagattgttgagaagatttcttgacttctgaactcagagagaccttcaaggagtcgtttgttcaatagacatttcaactccctctgggttctctgttaatgcatttttgctatgtggcttcccttcaattaagtttattggaaatttttcctagaaagcaggtttttggaggcagccttgggattctagaaactgtttattttggcaaagtgatagcgaactacaaggcacaaggctttaggtttgttaaccaaaccagtacctatgctgagaagtgacctctttgacgtatgtgaacctaaagtaagcattcagcaaacagtgttttgtagaaagttttgcagtacttcctttggctttccaacctgatttcgttgctctcaccaccttagtttattttacctaatgggttgttcactttcaatggagtatatgtacaatggaggtttacttaaccaatctctgtttactagacatagtgaacttacttttgcttaacagatttcattgtaaatgccgctgactgattcccacagaatactgagcacaggtagtagactatagtctactacaggtatacagttctgcttctaccagttatactgtgtgtcagtttcctcccccaatcccatccatgctactttttcccattataattctatatcataattttatataaagtgatgatctatgactatgacaggaaagaaagttattgaatattgggaaaatctcagtaaggacaagttttaaaaagtattttgaattaagtatgaacttaaaaagaaaagatataaacctaattgacttttgcatgtagattattttacataaaccttttagctttcattcatttttgtccagagggagttgggaattataaacgttgcattggagatgtatgttcatataagacagatgctacaaaatccttatcagagggcccaaactttagttttatgtgacaagatgggcgaatgtatatttctatttaggttttaagttaaaataacatgtttactgttttgtgtgtgtgtgtactttattactccctcttttaactaatattttcaacatacataccaacttttggccccaattgtgctggatcatggagctttgctataatgcctaatgggattatttttactgaaaagcatctttaccttctgggattttaggagattgctgttagagaccttgtcgtgttgtaagatatatatatatatatacacatatatatatataaaactaatatatatataaaattatatatataatatataacacctaatatattatacctaatagatatcatacctaatataatatataatacctaaaatgtaatagatattttatatattaggtttttatccatggttcatggctcacaattcccatgtcccttgttacagtctttcgttaaaatgctgcgtgtgttagactttaagggtaggcctcaggaaacagaatctttcttccttcttccttccacctgctccaaagcaggactctaatctttccccacctttctgattgtggttgttaagactctaccctgagagggtcctgcctcataccctgggggaaggcatgcttccacaaaaacccaagagaactgggttccaagagcttcctgatagctgaacacattggggtggcttgcccagagagggcatagaagttgtctgccctgggccaggcgcagtggctcacgcctgtaatcccagcactttgcgaggccaaggccagcggatcacgaggtcaggagattgagaccatcctggctaacacggtgaaatcctgtctccactaaaaatacaaaaaaattagctgggcatggtggcaggtgcctgtaggcccagctactggggaggttgaggcaggagaatcgcttgaacctgggagacggaggttgcagtgagccgagatcacacccctgcactccagcctggatgacagagcgagactccgcctcaaaaaaaaaaaaaaaagatgttgtctgccctttctcccataccttaccctatgcgtgtctttgtctgtatcctttgcaatatcctttatacaaaactggtaaacgtaagtaagtgctttcctgaattctgtgagccactccagcaaactaattgaacccaaagaggggaccatgggaatcccaacttgaagttccggaggcccagacttgtgactgctgtttactggtgtggggggcagtcttggggactgagcccccaacctgtgggatctgacactgtctcctggtagattgtgtcaggattgaattggaggacacccagttggtgtctgctgcttggtggtggggagaagttcccatacctttggtcacagaagtcctcttctgtgttgatgattgttgtggtgtcagaatataggaaatacatggtttgagagagtttttcctggtatggaccttaatgctagaaagtagattttgaattgtgtaacataaatatacatttcctagcctcatattgctttttaaaaatattttgttcaaaatttatgctctgttaatacagtactttttcttaggtttcagttttggtattccacttgcagttaatgtctgtaaaattatcttgtttatggttgttctttagcagttgtctttaaattttcataattttatctatcaaattggctttgttaagctcgccatttacttacacaaagtgcattattcatattctcttatcaagttagatgttttcttagagaagtgatgttctgttttataacagtcacatctagccccaagtgtgactgagtacaacatatatcaaattttttgtatcgtgatcacaacaaaactattcattttaagttcaaattgcattattctaagaagctgtcacttatgatagacatttaaggcaacttccatttaatttgttgataatttctttcttatgccacaggtagcttatctgagtatcgttttgcattgtggagaggtttacagaaatgtggtaaatctgtcaaagctgtacagcattgtttttgctcatccaagcagttgtttcatgcaggtgaattggaattcactgattagtcttgacgcttggtctggtttattgtcaggctttgaatctgtagctctctcttcatttcagattattttcctcttttccctattactgtcttgtattctttatattttcaacccctgttgaactatttccttttaaggaaaaaaattagaggtacttttaagcttgaatagatcttgggggggcggaaaaaaaggaaacttgcttctttgtattatagcttgccagttcatcatgtaaaactatgaaagtattcattttaattatgactgccagagacccccctctcattagggactcctgaaaaaatgacttagccatcttacttgcttgtaaatcagtggcggaatcgcttcagatgtattatttagcgatcaggaagctgaaaataataccacactttttttcagcaagaaggaatgaccttcaatattgatgtcattgtcttttaacaaccatggacacataagtgagttttaacccaaatcttgaaggcctgttaatactctcgctttttgtatttattttatttctttctttttcattctaatattttaaaagttgagggatattcatataacataacattcacttctttaaagtacacacttcagtggtttttactatatttttatgttgtgcaaccattattactatctagtttcagaacacttccgtcaccccaaaagaaacctcatacctgttagtagttagttctaattcccctcttcttcctaccaacccctgtcaaccaccaatctagtttctgtctctatggcttcgcctattctggacatgtcatataaatggaatcatacatctgggcttttgtgtctggcttctttcatttagcataatatttttaaagttcatctgttttgtagcatgtaacagtactctttatggccaaataaaattacactgtataggtagtccacattttgtttattcattcctcagtagatggtcatttgggttgtttctattatttcttgtgaattttactgttatgaaaatgtgtgtcaagtagtacaggctttattcagtggccgtgaaattgagaagagggagcttggctcaccaatcaacttctcgactagtgaaggttgaggggattaaaatgtagtgtttctctaatgaaggagttggacattaaaagcaaaaggaatattcacgatttttctgcaagtgggcagtgaacatttcagaactggagtgctgccttttttgtccttttatggcctcttccagtcattgtcttggcgactgtgaactgtcatggcactgatgggagtgtcatttagcatggaaatgagattataatgaagcctgaggtctttttgacgtccttcagtcggctgtcttagtcctaaccagtctcagctagtctggctacaaaggaaactgtatcataggcatcctgtttcttaaggataagcagagttagggcagggtagaaattcagctatgtcacataggcgttacactgggtaacaatatagttttgattctcttgggttgtcttggttattgatgctcttaccaaattcaatattttgctgtgttggtcatttccttatttgccctatgatcctttcactcatccttctctgccgtactctccacatttccaagccgagctcccttggcttctgcttctgttgagttggtttagtgggtagcactagtggaagactggagagtagaaggaggcggggagctggagaattctcccctcctcctttgcccactcttgcaatctagagtaaggctgtgcctcttgaagcagctgtgtcaaaagaacataaatcaccagagccatttctgattttatttgcttctaagtgacccctactttctttaaatggctacatttgtacatactattatgtatctttctgttcaaagaggaagaaaacatttttgattcatttgttcctccctcctatcttctctcctccctttttccctcccttcctcctccttttccttctctctttcagtttcttcgttctctacctcccactccttttctccccccttccctcatttccttccatccttcctttttcttagatattgctttgatcgtcttattcctcagcaagcctagttactagtgttaaaaagagagtttcaggcttacaaaaaggctctgagttcttagggaaaaaagatggtactttatttcttaattcacataaaacaagcaattaactttgtagcaattattacagacttctaaaatatcataaaacagtttatacatgattaccaatacatctaaactctagacaagtaatatcaaagttttattctcttccttttttttctgtagttacagaatatgatcttaaaataaggtgcttactctgttaaaattgtattttcctctaaatagtgttgatattcacatgtaattcactatacatatagtttatatgtatatgatatatataggtggttgtgtgtgtgtgtttgtgtgtttcaaaaatctgtcagggttcttgatattagaagactatatgaaagatccagaatttaaattcaatagcttctttctcatctacccctgctttccttcccttaagtaacagtacttattgagtctcttctgtgtgccaaatactgtgttaagtaagtcttggaaattcaagcaatgcacaagagggacaataaccttctcttctagcggaggaaatggatggtttcttcctaaccagcagtcattgcctgagcttatatattaataacattaaattgaaattttgatgttattataagtagttgtggccattatgtgatttttttggtataaaaatagatacaattttataaagatacgttaggaagtaattaccaatactttcctaatactttctaaagtcaaaaagtaactcttggaatataatttaataataattataaacaatatactccttcaggatactgttttttgaggatcgtgtttgattgcatattttttttggtaatattttatgtgtttatttttaaaccaaaactgttggactgaaagtttgaggtatatgtccagagaatctgtaattgatttaaatgatacatgagaccttttttgtcaagctgatctgagctagaaaaaatctcttagaatagctgcatttagagtttaatgaaactaggcagaaaggagactaaagtgaatttcctttttagtcttttaaatgaaaaagtgcatcatttgtcctatatatcttattcatcatcagtcatagcaaagcattcattcccatgagagagataatggagtcagagccgagaggaatggaagattgtcattcaatgcagatgagttttagtaatattcttatcatgaaaaattgggttgcaaaaccttaagatttaaaattaagttgccatagatatatttaattaaaagtagattgctttaacctttctttaagttagaaataggtttaaaaaattaaatttatagttagtttgtatttaacttgtattcagtacttgcctttaataggaattctttataaagtttagtccaaaaaaggcacattttaattgaattattacaatgaacatataaagaaagtttctgaaactattttataacagtatattggatcaaaatatggttcacttttttcttgatggagaacgttaccaaacttaacaaaccaaactaaaaactgagagcaaaagggggctctgcattctcaactcctaacacctcgttagcacagctggctatatttcctggtgttttaatgttttcacctgatggggtaggtccttattcataatactgcccaatggacattgttcttctaaagttaaagcatatgaagcatgaagttattgaggttgaaaagcaaacataaacgagactgtatattgtgcacattagttggccaaattgcaaacttcccctttatgtaatcattttaggttaattagaagaaattagagggctccaaacttattctgtgattctatctaattgagcacttttaatccaaggcattaaaaataaaaatatggtgaatatagaaggatgtgttggccaactaccagtcctcactgtacttgccccagccctggctctgtatcacctggtttcagaatgtgagtgtcccttgttgtaagaagatgctgaagtctgggctgtgtaggtcatggcagttttcccacctgagaaaagccataggagaaggcatgggtaataaggtttagagcatttgccacagccccaatctatgatcacgcccttggctcctgtccgtcaactcgttacagatcccttcctctaagagttactaagtcagaagtggggttttctcttttattggtttacttttgcctaagatctacccagatgaataataatattaccttaggtgcttgattcaactgtattattttatttaaaaaattaattaattaattatttttgagacctggtcttgctctgtcacctaggaaggtgtacatgatcatggcttaatgcggcctccaactcctgggttccagcagttcttctgcctcagcttccagagtagctgagactacaggcgtgtgctatcatacgccactaatttttattattttttatagagaggagtgtcttggtatgttgcctaggctggtgtcgaactcctgggctcaagtgatcccctctccaaggcctcctcctgcctcggccttcttgggctacaggtgtgagccactgcatccaaccaactttagaattcaaactttattattttttttatgattaggtcatgctgactagcacaaagtatctcagagtaattgtacatattaaaccaaaatacattgttaaaagctaagtcgtttactataattttcatttcattttttaaaggaaaagcttttgtataaaatagtccatttttgttctcctttttcttcctcttcacagggtgaggaatcacaaattgaaatctcctgtaaatatattatcattaactggaaggaaattgcaacattatagagttgttaatcttttctcatttaagatcgagattcattcactttcagaggctgaacaagaaggcatggtcatgttaggcatacagaaaattggagtcccttgttgcaagcagatggattatcctcctctggactttattttgttttacaccttcatcatcggccatataggaagagcttcctgtgtacagtgctccacaggaagtacgataaaatgaaattttgtatgctagagctgttagcatagttcctaaaatctagtatgttcactgtgtttctttactaattcatttttgctttgtgttagtaggacttaatcatgcttacagacaatagtaatgtctagcgtaggacaataatatagcaagacaataaagggaatcataaataaaatgagacaacaatgaggaaaacagcaagatgataaagacaataaaaagtagaataaaatagaaacaaaataaagacagtcataaatggtttaacccttttattaaacaacaacagcaaaaaagaggatttccgtcatttaaatttgtgtttcatggtgacgatgctgttatggaatggcttggagttattcattctgttaggataagtgctaatgatatcccaattaattgattagcaaatgtttcataaatatattggaaaaatttactattgtagttttaaacaggcatgtacatgtaactataaaatagtgagtagttctggtaactgtttatttaatgcacatgtattgtttgctgtgtgcctgatccagtaccagagctggacaagtatctgtcttactactttttggttggtatttttgtatctagtgcttcctgtcttatttggttgatagtgttacaactgagatatagtttattcatttctttgcgaagcttagtaagaggaatttagagacgaagtatgcacacacagtgttagcgctgaggggatgaacatatgactttggttggtgttgagtgtctagtggatgtcagagaacttaagtccacttcatttctggaggacccaattatttctggcaggacttcatagttgtgaagatcttactgtgctcattagaaactggggtaggcacagataaagcacatagttctctgtctctagagcattagatttataatgtttgttagtggacctattgttgcatgacttttccttagttcagctaaatacagggccttgtcacacagccacggaagattaggctcacagacaatttgaagggtgagtaaggcacagttttattgggtgaaaagggaaaaaatgggaaatagggatcctccacaaagctagaatccccgctggtgtgctttgaattgaatccctggttccacccaggaagaggaggggccgggctcctccccactgcaaacaacactaacttcccagccaaacatgccacagagcatacctctcccggggcccagactggttggagtttctctgggcaccccttccctcctggctatctcaatatggccaatgatcaagagaggctggaagaggcttagttcaaaatggtggagtggactcgcccgctagtgatgggaggctgtgtgtgagatgataacgcagggccttgcgggctattttatgaagtagttaaaagtgacaaaaacattttaatgattttgtttcaaatttaagagttcttaaaatctaatcagtagttaataaaaaacatgactatttactttgtttgactttaaacaaatggttcttacattaaagacagaaaacatgacaattgttggtggattaaatgttctttattttaacggaattgccctaatggcagtcagattcattcttgaacatgttaagcctccatataacttgccagtattttcctaaacttgggtccctgatttctgaaatgggagtgaggaaagatgtgaaaattgatggcctcaagctttttaaaatccaaattgaaacttgtactacaaagagagaagtttaacctgagagtttatgcctgtatcagcatgacatagagtagcaattgaagttttcttacaccctacagatctaataaacacattggttcatttaaaagtgattcaattttcttggattttagatttcagaaaaaaaggaacatagtctaataaattatgtcctatatgtcttataaatgtagaaatcacatatagaggtttattttagatgctactagtgtttgggcatagataatttggcattttgtgaatttttagattaatagcctattgaacattttagaatattcctttttttaaatggtgatatttaatatgttgaatggatatagtttatatacataatagtaattgcctgtgtaatttacatatagcattaaatatatatagtatatataatatttttggcatttaggacataaaagagaaaattaagatctgttttaaaatacaagtaaatacattcatgtcattcatgttttttgaaattactgtaattttgcttttaaatcttggtctacacaattggttagtgacccatagtaattgaaaagattaacaaaaggaaccacctaaatcttttgtgcattttaatcatttatattatttgctaaacacaggtataattcttattaatataatcttagtatataatggagtcttattaaaagaatactatttatgcttatttgcaaaactaaaaataaatgtttttttgggttaattgtattctttattacctgttcagttgccaagttaacttaatatcatcttcatttggcataaaaaggtgaaaatttcttttagtaaatccttgttgagtacttattctgtgggtgattctgtgttaggcgttggggtacaaagaagaataaaacttgatccctaccttcagaaagctggcagtcaagggaagaacaaatcaatatagacaaattagtaagtgctatgtataagcaaatgtattaagtgtagttagtaagtgctatggtagatgtaggtttaggctacttgtgggagttcagagggagttatcactcttaattggtgcaccagtcagctatatccactgtagtgcggagtagcacactatttccatactttgtgtaacaatagtaagcatttattttccactcatgcatctgcagatctgttagaatggctctgctttttagaggttttgatatgcttaggaaaggtgatggggtagcaagcaagattttttggtgtggaatgaagctgctggtgagtgatgagcagaatttttggaaagcattatcaaactttattgtgtaaaaggtataaagattgctgtggcagaatttttctgttttaaactccatgatgctaaatactccagactgaatggggcgtctcgatctacgatgttttgtgacgtgactacttttctttgatgctactccagactccttgatctctttttcaacgtttcatctcttttgaaccttgagcttccaccgtgctcaccttgtaaatctgtaaagtctaattttttctctgcttttgcatagcttttgggaacagtgaggaaaatcacatagagatgtgaactgctgcttctacggaatcatggccatcaacattccacagaaatcatttgcacaccccgagcctgctctttcttacattctccatggtagctatttcagtttcactgctctcctcagaatctgttattttactacctcctcatttttcattcacgtaatagttgccttgacttttcagagaaaagagaagccaccagaaaggaaaattttcgacttcccaatcattttcttaaaaatatctctatatatttatcttttccatgtgctttcaaaagttggtagaagaaattgctgtcacagatccatactttgaatcccattttcttttgcgtccttaatattgtacatctgtttgcctcttcttttcccctcagcctctccatctgctgctttctttccctctgcatataaagttgttcatcattcttcttccttaaatatattagaacgaaagacatacctctttcatttctctgtcagatttctagaatgataccatagactatcggttagaaaacctgtgtgtgcatagcaaacatgtagggagcttataaaagtaaagatccactcctggatctgattgacggatctatagtagagtatttattgttttcgaacttttaaagataaccaggttggggaaatactgtaataaatgaatatgtattaatatgggtgatgctgaccgtgtagtatgtgacaaaaggttacaaaattgtaagttaaaaaagtgtatgtatatacttttatatatattttatactatatagacacatgcatatgcatataaatacctacgtaataagaatgagaagattttatactaaggcattaataatgtagaggtggatgtggtttgcgtatgttttagtgtttttaaattttattttattttattttatttttgagtcagagtttcgctcttgttgcccaggctggagtgcaatggtgtgatctcagctcaccacaacctctgcctcccagtttcaagcgattctcctgcctcagcctccagagagctgggattacaggcatacgccaccatacacgggtaattttgtatttttaggagagatggggtttctccgtgttggtcaggctggtcttaaactcctgacctcaggtgatccacccacctcagcctcctgaagtgctgggattacaggcgtgagtcactgcgcccggccagtgtctttaaaatttatctatatattttttctatgcagaatacatccttcttttgcaataagaaacaaaaataatggtagatgttaggaccccatgtacctgcattccctattttaccttccttccctcccgcctccatataggtatcttttcttcctttatcttcctgcagtagtagatgttgtagtagatgctgtagatgactacttctagtttcttaaaattcccttctctcttactttcatattctctgtcccatttaaagaaccacaaaagcgaaacattatttttctctgccacccctaataaccaaacaattgtcttaccaaggaagtagctttcaaatgcactccttcgttttcatccccatcttcattgttgtggtttgagagaaccagttgagatgggtatcactgaagcccaaggagggggaaccaggagtttccaatgccagtgaaaatgcatgccacttgaagtctggagagaactgttgggactcgaaattttcaagtctgtggtgacctttgccagagtatttcagacacattttagcagctgaagagatatgaggaagtagagatggcagttaggaaattggtctatcaatggtaggatagccagagaatgacttggatcaaaaagagaggttttcttcattgttgttaatgttctttcagccagtgcatcaattcatcctatttgaatgctgagactaaagagcttgagggcatgtttgaaaacatcagaacattagaaaaaaaatgtacaaaagagaaaagaaaagattggaatcgctgagcgcaatggctcacgcttgtaataccagcactttgggaggccgagacagatggatcgcctgagatcaggagttcaagactagcctggccaacgtggtgaaaccctgtctctactaaaaataaaaaaattagctgggcatggtggcgggtgcttgtaatcccggctgcttgggaggctggggcaggagaactgcttgaacctgggaggtggaggttgcagtgagctgagatcatgccattgcatgatcaaaccaaaaaacaaacaaacaaacagaagacaacaacaaaaatggaatcaaggaattagccttgaacaagagaaaaacaaacaaaaacaaaacaacaacaacaacaacaacaaaaaacttgtctttctcacggactgaaggagaggaggtaaaggtgcctgcacttatcagtgcataggtttgagagtggaaagctgagggagttcttgtctgctggctcccgttttctctgtgaaatagaaaagctgctgctgcaaggaagtagagtatacaagtttacctctctgtggagatactggaagctacttggtacaatgcatgatttttattattttcttactctatgtgtctctctggcttgctgtcattctcttttatgatacttttgttgttatcctccacaaggctataacaccaaggttaatgctaggcatgttgtaatcattaacagaacactttgttgtcatttaaggttgaatatcgagagagtagcctgagtcatgctctgtcacttacttggctggggatggtgacttatcgcagcagtgtggttgaggggatcctctgttttcacagactgatgtagctttagttctggtgtagctgctatattgacatgcctaatgttttcagggcttgcaaaaatgtactagtgagcttttctatgaaaaaaaaattccatagagaaattttgattgctaaagcatgagattccaggatggctttaattgagagggcaaacataaaatctagttaaatttctgctgtggactgagtgtttgcgtctcctcaaaattcatatgttgagccctaatctccaatgtgatggtatttgcaggcgggggctttgggaggtaattagatcttgacgggagagccctcatgaatgggattagtgcccatgtaagagaccccagagagaggattcctgtttccaccatgtgagacaacatggagacagtactctgcaagttgggaagagagctatcaagaattggaccgtgctgccaccctgatcttagacttccaaagccttcagaactgtgaaaaataaatgttttttgtttaagtgacccagtctgtggtatttgttatagcagcctgagttgtctaagacaggtattatccacatttctacccagtagatagatgctgggctgaatctagattgttgtatacgtgtcatagagggtaagagcacacacagacagaagcaggagtcagactaacatgattcaaatactggccctgtcatgtagtagctctgtgatttggtctttgttactctccctcttggagtgtattttctcatccatcaaatgaaaattgtgatactttataggacatttgaggtaatcgaattagatgtcgaatgtcaagcactaaggacaatccataactactgctactggaatcagtgtcaccaagtcttcctattttttttgttgttgtaatgattttgttatttctatcataataagactcttcatttctatatcattagttttgagatggcctttgctcaaattatttttttaaagggagtatattatttgatataaagttgttcacagctctccttcctcaaatatatatgaaatgtatatggaaaatgaaagaaaatccctccctcaattctttgtcaggtttcttaaataataacatagggcattggttaccaaacatgtgtctggatagcaaaacatttaggagccatgtgaaagtttcagatctgtgttccttataggtctcattcagagtaaaagataagttcttacatcatcatcattagcctagtttgcttaagttggtaatcacctctgaagccaccactaattaatctgggtttgagaagaggatacctattttcatttgagtaaaaagcctgttgtttatagctttgaatgttgttaagttgttctaccttggcaaaagccttgaaaatttttaatcattttttcttcatagagtcttcagctatccatcctgagtctttattctacttattgagcaagctaactattcagcattaaatttttatatatctcactatgtggtcttttcctttacggtatctccaacagaacctgattttattctagggcaaaagctcagtagaagtgaatgaataaaggctacctgacttttaaaaaaagttttattttttaacagccttattgagatataattcacatagcatacagctcaccattttaaagtgtacaatttgatggtttttagtataataaaatagttgtgcaaccattattacagttcattttagaacattttcaacgccccaaaagaaatgccataccctttagctatcatcctaccgtttccccagcactaggcaaccactgatctactttctgtgtctatgaatctgctggtgttcaatatttcatataaatggtatcatataatatgtgtttttttgtgatgtgattctttcacttagcatgtgtacaaggttccatgttgtagtgtgtattagtacttcattcctattaatgaccaaataatacttcattctattaatatacaacattttgtttattcatttagtgatgatcatttggattgttttcacattttgactattatgagtaattctactatgaacatttatgttcaagtttttgtgttgacatgtgttttcatttcaattggatatccaggttggagtggaattgctgtgtctaatggtaactctgtctttagcttttgaggaactccagagttttcaaaggggctgcactgtattatcttcccaccagtagtatataaggtttgaaatttttccatatctttgctaacacttattatccattagccatcctagtgtgcatgaagtggtatctcattgtggttttgatttgtatttgtattttcctcatgactaataatgttgaatacccttttttatgactatttttatttttatttatttatttatttatttttgagaaagagccttgctctaccacccaggctggagtgcagtggtgtgatcatggctggctgcagccttgaccttctgggctcaatcaatcctcctgccacagcctcctgagtagctaggactacaggcgtgtgccaccatgcccagctaatttgttattttttgtagagatggggtcttgttatgttgcccagggtggtcttgaattcctggcctcaagcaaccctcctgccttggcctaccaaagtgttgggattatagatgtgagccaccacacccagcccttgaatatccttttgtatgcttattgtccatttgtacatcttgttggtagaaatgtctattcagatcctttgctcattttaaaaattgggttgtcttttttattcaattgttaaatattctttttgtattctagattcacatcccctatcaaatatatgatttgaaaatattttctcccattctgtggactgccttttcactttcttgatagtgtcctttaacatgcaaaaattttaattttgaagatgtcagattatctgtttttttcatttgctacttgtactttttgtgtgatattaaagaacagagattacaaagattgccgtatgttttctagttttagttctgacatgagtcattttgagttagttttgtatatgcttcgaggcaggaatccaaatttattctttttttatgtggagatccagttgttccagaactattggttttaaagactaaagaactattggttttaaagactattctttccctcattcaatggttgaaaaccattgaaccatccttgttgaaaaccagttggccatagacacatgagtttttatctgttacattgctagctatattagaaaccattattttaactttattggtatattttcataagtggctatagggttaggagggagacctatgtaggtgctttcttgattgctgtaaaccattgccatgctcccacaccatggactgggtcaggtgggatatcttaagatagaagattgtgttttagggtatagaggagagtcactaacctcaaatacatgctgaaaccaaggaagtgatgaatcagttaagttgcagttgatagtgatatggcatgtaacagggaactacagtgtgctccctgtctaaaaagagcccccctactggcccccaaatgtttgttgaaatggatagctagctagctactgaaaacatacttgagagccattcttggcccataggatgactgttgctacttctggttatagaccatatggcattcacaattctcttacaatttcttctccttcatgctttatcctttctgtgttctttctaagcaaataatgtctcactttccagctgtaatcattagttttcctctggtttactgttactgagagattacaaaatgaaaggatagtcaggttcagaccaaaaccaaacccaagtatctgagtggatttgggctgttacaacaaagtagcacagactggatggcttctaaacaacagacgtttatttcttgcagttctggaggctggaagcctgcgatcagggtgccatcatggttgggttctggtgtgagccctctctggcgttgcaaactgttgtcttctcacagtgtattctcacatgaccaagagacagaaagagagctctctgggattcctttaatacaggtactaatcccattcatgagggctttccttcatgatttaattccttctgaaagtccctatctccaaatattaccacatttggggttaggattttaacatgaatttggggggcatacaaactttcagtccataatactaggtaaaaagagatcaataatgcaagtcacagcaaagataaatgtcattatccttagatcctaaataatgtttatttttggtcaattatagatggcatgaattgtgtgaaattggagaaattttctttttttttttttttttttgagacggagtctcgctctgtccccaggctggagtgcagtggcgtgatctcagctcactgcaagctccgcctcccgggttcacgccattctcctgcctcagcttcctgagtagctgggattacagtgcccgccaccacgcccagctaattttgtttttgcatttttagtagagacggtgtttcaccatgttagccaggatggtctcgatctcctcatctcatgatccacccgcctcggcctcccaaagcgctgggtttacgggcgtgagccactgcacccagccgaaaattgggtaacatttcaaactcacttgtcatggtagtatttaatatactgttagcttgcagccggtcaagtaaactgaaaataaatggagaatttgaatgaaatgaaattacatattttcaaggatctgtggaacgtctacaaagatagattatacactggagcactttttagaactgagttccatgtggtgggctctgagagggagggtaagaaatgaggagaaagcgcggccagatagaggcatttcagccagatcagctctgtttttatatgctttgcatagttttagtgttggagttctccataaaatctattttgagataattgaatggtttctactcctgcaagtaaataggttggtaaataagtaaatagtttgattgcccctgtattgagctacaaagtaagcctcctgacgaacttcatttcaataaaactggaaattaatgaaaaaatcttaaggaaaatataatacccaccatacagtttttcacaagcaacaatagcattggagagaataatcagagttacaattatagtctgttttgaaaagaaatgaaaactgtatcgaaagctattggttacagctagaacaataatgaaagattctgcatctgatccacagaacacagaaaattatttgagtgcctattttccaaattatcccaaggaccatatgtaactaatacaattctagatgcactgaagggaagttaatttattgcatacaatggattcttaacacattagggcttaattctcttagtgaaccctgattgatcaaggcaggcataccctgttattaagatgataattcccagagttgatgaggttatgggtggttgaatatcctcatatccagctgattggagtatgaatggaaactacctatccagaaagtagtttgttaatctgtattcagaaccataagtgtattaaaccttatgccctgtgctttataatatcactttttataattgatagcaagaaaagagatttggacacctatttgtgcacagagacctcataacattcatttttatttttttattacagaaatattttactctgtagaataatagagataaggttctatattcttttcacccagctttgacacttatcaatatttagctagtgttgtttcatctgttcccttgcccgatgtacattagttgttttgcttttcataatttaaaccaaacttcaggcaatgtacaatttcgtcattaatacttttttgtggaattcctactatcagtagatgtttttggtaacataataactcttatcatccttattaaaattatcaatactttctttatattcagtctagagtcagattgcctgatatgctactattgatatgcaattacattcatttattcccacatatttatattttaagggcttttcttattttttcttctttttaacttattaagttttcccattttatgaattatttacatggttttgtagtcaaaatataatgagtacaatcctggaagactactaatctgtgcattttcttctcatattcagaataatttctatgcattctttgctgtattttgtgcttttggaaatcataaacaagaatatttatcaatccctttcttacatgagaagaatcatagtataaatactgtttcttgatgaaacattgttaaaattacaagcaatgaggtatatccatttatcatcccctttgttacatagaaagtaccataatgtaaatactgttttagaaataaagacacatacttttatttaaaaccacagttttttgataataaaactattttctcccataaatcccttaaataacaatttagtaagtgaagctctaggtcttagtcatatgctgcatgacattttggttgatgagggactgcgtgtacaaaggtggtcccataggattataatactttactttgacttcacctttttaatgtttagatactcagatattccattgtgatacagctgcttacagtattcattacaataacatgtcatacaggtttgtagtctaggaacaataagttataccatacagccaaggtgtgtagtaggctatgccatgtaggccggcataagtatattctataatgtttacaccataatgatattacctaatgacacatttctcagaatgtatccccatttttaagtaatgaacaaatgactgtatttgatttattttctaatttccagaaagctagatatacatgattgagcactatgtttgtttaaataatgaggtattagtattccattggttctgaatttagtggcactctgatatactttagagattgttcttgaaaaccacacctaagctaaactaatatgtgttaagagtagtttccccaaggtaatagtgatagggaggggaagtgtcttactaaggtccttcccagggtactagctgccagtagaagttgaagaagggtgattcctttgcacccaactgagaggaggaagaattatctggaggggaagagagaaaatcaaacagcacagggcaatatgtcagaaaggactactgtcagtcaccccccagacactgagtggttctctcataatcctgggtaagaacaatgccataggaaattccagctctatactttatgacaagattcttccttgatacaagttaagtagccaaacttcaatctttataagcctttgcattataatttcttatacattctgcatgatacaaagtaattaaatgacatcatatgatgaggaaggatgtttccttgctccaaagtggtgatattccagatatttaacaactgttttgacccgaggatatcctttcagatgggatgggattgatatctgccatatgggctagtactgactttatattagcctttgtatattagcctcgcctattgcatttgccagacatcttgcctcactgcttgtctgggtgtggcagggattggcccaagtgcaaaccaaactctttagcacattggaatcttcctgaaaaatggaaggccctacatactaaattggaaccttttcagccatgtttaaggaaaatttatattaaactcaaaaacgctgcagaaatgaagtggctaagtgctgatgaagagtagtgctccactgtgaatcaaagagtttgggaatgtttgaaggaggctgacatttgagaattttatgtgaggattagtacatttgaaaaggaaaggttgttgggtatgagataaacatagagtttgtgtgcctgatacagtgaccttagttaatgtttgatcacctttgccgaatgtgtgtttgcagttcatattaaactgtgcatcacactgtttcttttccatatctcgatttaaattttgtcagcttgttttgagtctgtggacaaatagaatcttatgccttatcagatatgatgaatttaaacctgttaataaaatacctattaaaatatttgctttagaaatatatcaggttttccaccatggcacatgtatacctatgtaacaaacctgcacgttctgcacatgtatcccagcacttaagtaaaataaaaaagaaaataaagaaaaatacagaaggccaaaaaaaattaattattgtaaattagctctgtaagaccttctttagtaagagatgttcaaatactatgtttatatacattatatttttattttaaaagagtaattagtacatattaattgccgagtgattcctagaaatattttattttaatttataattaaaatctacctttattccagacttaagactgcaaattaaaatacgctggactccaagaatgccacttagtcacaatgtaaacaaaaacattaatatgccaccccaaaagtttctatcaagagaaactagacaagcataagagtatcagaatcctttctacattcttggaggttcctaaatgttgctccaagactatacagctgacctgtgaacactgtgggggctaggcgtgcctactccccacatactcaaaagtttgagtataaattttgactcccccaaaacgtaactactaatatgctgctgttgacaagaagccttaccaataacatacagttgattagcatttattttatacattatatgtattatatactgtgttcttacaactaagtaagctagagaaaagaaaatgttattaagaaaatcataagaaacagaaaatatatttactattcattaagtgaaagtggatcatcataaagatctttatatttgtttacatttatctcaattgtaaatagtgcctgtatggtctttatttgtatacctaagttttaatacattttaacattttatcattaaaacagagaactgtatcaggttttctttacttgataaacatcaaatgttttagcagatgttgtaataaaataatttatgcgtataggaaacatgttcttaaaattttgccaaaactgaaataataagcacacattgttttgggggtacctaactttgagcctagcaatatctaggttatggtagataatgaagagtagacaggaatatgagttaatattgttaacatttaaaaggtttaatatcacttttctatgggaaaaataaacctttaaatttttattcattttgttatcagttgcttatactttttaaccaagcaatgtttcggtgtgaatatcatagagaatattatctgtagacactaataatagtatattcaataatggttttaacgcatgttgtcttctcatgttctgattatcatttctattccctcacattaatacatttaaattccttgatctctgagattgtgtgtttaatctgattctcactggtcatccttcctgggctttacaaccccagtcaatcctaaatcttaaatcctatatttcatgtgattaacactagcctcaaaggattatttatgacatttttgatttcagaagtcccttgacctgttgatatattatattatttgatagccttttagtttaacttcatctagaaaattactcacaaaactgttaagtagagaacacgcaaacacatcaatttaactagggcagttgtttctaaagtgtagtccctggtttctaaagttgaggccactggcatcaacatcacctatgacctttttagaaatgcaaattattaggcctcaccaaagatctttataaaaaactctaggactgggacccagcaatctgtattttaacaaatccatgtgattctcatgtaaactatagtttgagaacccactgacctagatagagacctttctagttctatgtgtagttctatgcttggtagagaagcaaatgattgtcacacatgatgaagagtcatgtttatttccatcctcaggtctgcatagcaatgcaaactctttgcattacataattaattctctctcatgtactcagcataagttgtgtaggattaaatgaaaaaaagtttgagtaacctgatttttttataaatatgtctttagataggctctgatatggcttggtactatttattattattaatattattactttattttcaattatattctgtagtagagtcacatgacttatttcacaagacatgcatttccctaaaatgtgtctaccagcttatattattttgccttctgtgtttttctaaatcaaattttacttaaaatcaattttcagtattttataccaataatttgaggttgaattttatgtatttatttttaactgtgtgcttccatgattggttcctgcaattacacctggatacaccttaatgatagttccttctttcttagctaagtgtttaatgttaagtttataagcacagatccaaatccaatgattttcctgattattctgtttctggatattaagatatgtgtattctgtggagtaaagctgtttttattagatattttgagaaactcatataaggcaggaactggttttattggaaaaaatcctttgtgtgatgtagtgtggtagaagtggatattctggttggtgcccatgtttttaatggaaagaagaaacactaataaaggaatgagaaagaggagaatttagggcttagcaatgattggagaaagagccaaggagatggaaaaactgatggtggggtagctgaagagggatttatttggagagaaaacggactaatggaaaagtcttaaatagtttcatacatatatgcttgcagaccttctttctctcccatatgaaatctttagtatgctctacatagtttatgatggctaatgtactggatttttttgggtgggggtaaatattgtaaagattttctaagtcttgctttaaagatttgtgtttggcaagaaaagagtacctgcagcgaaagccaacacctgagttcccatgaggaaaggggcattactaaaatgaaactcttgaagatgcaaagaaaaaaagttttttacagtgtataattacaagtaatcagcatgtgctttggagttttatataattaaactattataaaagaaaaatgcgacatagttaaagtatttttctttatcaaatattaatactttgcttatttaaataatcttgaaacaatagttgataccaagctaaagaactagttcatcaattttcaaaaactgatattggaaaccattttcacagtgctgaaaacagctcttacaaataaatctgcatatctaaatttcacatatcattgaatttcactttcaaaatatccaaatcttttaataaattttttagtggattcaccattgtacattttctcatttatattggtctattataactcaatttaaccttttctttatgagatatgacgaatttagagcactaaatttggtttggcattgaacagggcctgcattaagcacggagtacatatttaatgaatgaatgaatgaactaacgaactataccctttattttcagttctacctaaccgggaaaagatctgctgcttgtcttaagtgattagctaaaaagaaatgcaggaatcatatagtgttctagtacctagatttttatattccaagcttttattattattttttctctaattatggactaaactctttgttttggtaatggaatgtcacagcatgtataggtgagatgtatttgaggtttttaggtgaagaggagtatagcagcaccaaacttgtagagctgcccttgaagataaactgctgttagacattttcaggttgtcttcatgatggagaataggtaactgtttagaagaacctttatttaaatcttatttcttactcctgttttacccccggtattcagactggctgagagagaagagtgaaatatgtaatggaagaaaaaatggcataaaatgagtttcctgattattcctttattatgtccttagttgagaatgtaatgtcttagcgacccagtatatgccacaaggctgcttgattttttgttaatgccatgaaatattttaggcataaacaaatagtaaataatgtaataaacatctatgtgtatacaactcactttaacaaaaaataatacagatattattgaagcttcttgtgttccctttcttctacccacagggaatcaccatagaatttggtatttcatattcatatttctgatttaatatttttactacatacctatgtatcaataagtttcatataatgttttgatagttcttgatcttgatataaatgctattcttctgtactcttttaaaattaacttttgtgtgtgggatatttgcatatgttggtactataatccattcattttataccattgtatagcatccagttgtttaattatactacaaggttttacccatattgtggctgttgaaattttgatagcttccagttttttggctatgacaaaagattcttcagggaataattttgaatgccttcttgtgtacatttaggagaatttctctgaactatttcctaggagctgaattgtcgggctgtggggttaagatatcttcaatttcgcatcacatatgataccaagttgtttttaccaatgataccctcagcagcaatgttttatatcgttgctgactagatgatatttttaaacttttaatttttgccaatgtcctgagtgcgaaatgatatcttattgttgttttaatttgtgattgattaaacagtgagcttgagtatcattacatgtttattggccattcaagtgtcctctcctgaatatattttttatcaatttttctcttgatttgttttctttgtctcattgacttacaatgttcttcatgtattatggatgctctctctcttttggtatattcactacaaatgtattctcccaatttatagcttgtcttgtcattctatcgattcatctatttatgatgacaagtttatagttttaatggtcagaattatcagtcttaaaagttttatagttttaaaaacattttacttaaagaaccttttatactccaatattgtaaatatatttctctgtattttcttctaagcattttatggttctgcctatcatgtataagtattaatccatgttcaaatgatttggggacatactagttggtggagatctattttattttattttcataaggataaccaatttttccagcaccacttattaaatagtgtgtcctttactcactggtttttaatgcctcccttatgatacgttaagtgtcgtgtgtgtgagtctgctcttgttggttttactttcttccacgttctgcattccaccttttctttacttcctatactttatataaccttctacctttcttgcttaaggcatttctttagattttatgtcagctctgtcacactcttatgaaattcagtaaatgttatatgattttaatggtttgtcattatttttctaccatggcatgtacatttgtttgttcataatatgtctctttgttgatggtgttttctaaaaaaaggatccatcattttcttttgcattctgtttattgacagaagtattagagttgaaaccacaactgaaaatgttatagtcttaatttaattataaaatgcaaaagcacactttaaaatgcattttttataaataaattaagaataacctgccttttctaaaccactagtattttgattaacacttcagaaaacaattattttagacaatttgattttttgtgcaagtaaagcagtattttgtttttcttgaaattcattaactattagtcctatcatgctgttgttaactgatcttcttcatttttttagatggttggaatccattttcgtacccatacaaaaaactggattatggaaaatgggagctgtatatcccaccaaagcagaataaatctgtactcgtgcctcatggatccaaattaaaggtactttcctccctcctattttttcttgaacttatcattttctttttatcttgtttgccaagtttgatttaaactattagaatgtacaactgatgcatgataattgtgggagaaacagtctaaatgtacaaatagagggaaatttaggaggaagtcttgagttgaactgggttagattagaattgtttggctggtaaggaaccaaacttagttgtattattatcacaagtttggaaacattatataagaaatgatatattaaaagtgattttgagtaattgtaaaactttagcttgggaaacggaaagtttaatggaaaaatgaaacctgtcttcaaatcagccaatgtagagaggatttttatctgtaaagaggtcgggtgaaattgatgtgggaggggatgctgtgttggacgcgcatgcattttggagactgcttcttctgcttcttcctctttctggcctctgacatgctggtggtatggtcttgtttatcatattcttctgtgataaagccacctgaattagcccaggggtctccctgttggaggcaggctgagcgtcctccacactccctctgctttcgttgaccatgtggttttgcattcaaggtctgcagagcagttagagtcggctgctcttgtctcatcaagggatgtctgaaggatgggttccaaagtctggattacagatttaaggcatttgattataagagaagcgatctaaatcttttcacacttacttgattttactccatggtcatataattatataatatttccatgtcccttgtgtcttccttccttagacatttaccatgataaatcctatgattgagttgtttttattggtatttgttatttaacaatattaactcagagttacttaaatatattaaatcaaaatgcacagtatgtttattttgtaggttgttaaaaatattttataaataatgaaattataagtgtatgtaaaatttaataagatattgccacacattataatagtaagcagagaagaatattgtttgggataagaagatgtttagcaagagatggcagtcaaggttccttttaatctatagtgaaaaagagaaaaatactgacagtatacaataagaggaattaaaatttaatataaataatcccctttccatgtcagtataagctccatgagagcatggcctttgctgtgtgtgtgtgtgttttttttttcctactcctgtatactctcaattctttgaacagtgcctggcagagtagacactcaaaagatatttattgagtgttaaagccattttgagactcagtctttgaagaagtaaatcaaataatttgattcttcgatagtttataagggctaattttatagaaactgtggcaaggcaactattattgttttcattgctgctttaagtcttaatggctgtttttttaacctttgttttaggttcggaactttttttgagaactgaacttactactttttaaaaagtgttgcaggaattttttctgcctgtttcctttttatttttttgagataattggcagattaactttactgagtttttacttgttacaatcaattaactaagagaactaatctaaatagcaaacagctccttggcaccagctgcagctgtgaaatctctgaattccttgattctgtgaccctcaaatgttctagttgaagccgaggaaagttcccaatcatagtggagctttggttgcagggttacactacagtctatcacctcataaggttgatttttagctgccgagttctatttattcatattttcactagttcaacaaatatgtgttgagtatcttctgtgtacctggtactgtaatatgcatagggaatcagaattttaaaaattactgcctttaaggaaataatctaataaatgagttatttttaatttttatctgctccaataagcctaagagctaggacacagtccactcagtagaagcagcttcctgtggaagtaactatcaagctaaggagctaggtgtgtggaagaggcaggatgggctgtttcaagtttttaaatttgaaaaacagattttccttcttttggtggagaatcactgtaataaacataactaaatagacataaagctcctttccctctcaaagagggctctgtatgattatattattaaacactcattacctcattactagacccagcatcatctattaaaagataagaataaacagctcatcgatttttttgctttgttagctcaagtaggaggcatgaaaaataccaacataagcagctaccacttactgaatgtttcccattgacagctaactaatttacatatattttgtcattgactcattacaagaactcgatacagtaagtacttttattactggctcaccctacattctgctttgcctgaacagtaccagtgtatacctgttatcttaattattattatttttgattaatatagctttattttcattttttattttgattttactttaagttctgggatacacatgcagaacgtgcaggtttgttacatagatatacgtgtgccatggtggtttgctgtacctactgacccgttctctgagttccctcccttcacccccaccccacaacaggccctggtgtgtgttgttctcctccccgtgtattctcattgttcaactcccatttatgagtgagaacatgcagtgtgtggttttctgttcctgtgttagtttgctgagaatgatggcttccagcttcatctatgtccctgcaaaggatatgatctcatttctttttatggctgcatagtattccgtggtgtgtatgtaccacattttctttatccagtttatcattgatgggcattagggttggttccatgtctttgccattgtaaatagtgttgcaataaacatatatgaccatgtgtctttagagtagaatgatttccctgatgaacatcaatgcaaaagtcctcaataaaatacgggcaaaccgaatccagcagcacatcagaaaagcttatccatcaagatcaagttagtttcatccccgggatgcaaggctggttcaacatatgcaaatcaactaatgtaatccatcacataaacagaaccaaggacaaaaaccacatgatgatctcagtagatgcagaaaagacttttgataaaattcaacatcccttcatgttaaaaactctcaataaaataagcattgataaaccatacctagaaataataagagctatttatgacaaacccacaactaatatcatattgaatgggcaaaagctagaagcattccctttgaaaactgatacaagacaaggattccctctcttaccactcctattcaacatagtattagaacttctggccagggcaatcaggcaagagaaagaaataaagggtattcaaaaaggaagagaggaagtcaaattgtctctgtttgcagatgacatgtttctatatttacaaaaccccatcatctcagccccaaaactcctttagctgataagcaacttcagtggagtctcaggatacaaaatcaatgtgcgaaaatcacaagcattcctttacaccagcaatagacaagcagagagccaaatcatgaatgaactcccattcacaattgctacaaagagaataaaatacctagaaatacagttaacaagggatgtgaaggacctcttcaacgagagcaacaaaccactgctcaaggaaataagagaattttaataatcattgtaagaaatgagtagcattctgtctctagttcagaataatattaaattttaattttcaaataacaatcagaaggtacaaattttagtagctgacatctgtcatctctaaacctatttttcaaaatctaaatactataagtcttttgtcacatttttattctacaattgagctctctaaaggagctggaacagctttcattttattattgtagatcatgatatttttcatagatttaactgtgctttttaggcaattaaaatcataaggctaaaataaacacataatttagagtttttccttaaaattattttctagataagttctgtatttgagtagatcatttatgtgtcacattgatatgtttgtggcagtgaagttatatctccctcttttggaaagccaaggcatggcattttggttgagtttaaattgttcttttcatattttcagtttacatagtttcctgaacttacagattgaaaaataatatttttctctggaatagattttcctttgaaattttttacattaataaaaagttaaactttcatacatatatgcacatgtatatttctttggatgtgtggaaaacaacaggacatttgacatgtgtttcaacccaggaaaactttttattttgatatttgaaatgcctttatttttagttgaagagagtcagttttactttttctgtaattatgcaacatgattcataatgtctgtttaaaaaataggacttaatttaaaaaatatggaaagaaaagtagcccttcttataatcattaatggcctggccctccaggctaccatccactcttgacagattttatgggtattcttgctcatcagtttttaggcatttgtaaactgtccttgcccttgtcctctgcctccctgtatttatatgctttttattatcataaaaatatgattatactgtgcctattagtcttcagtttgctgcacccctcctaatatatcatgcaaatctcaaaaggtacattattatgttagttacttgaagaatcaagtccatacccattactaataagagtgatgtctacaaggtataaattagcatttattctggctaagcattcgactataaaaagaaataaaatgtattaatatactcattctagatcactcaagtctgtttcttataatagctaacataattttataacaattgtatgctttcttgaggtattaaaatcagggctgcaccttcattaccactgcttagaagaacaaaatgttcattttctaccctccctgcttcctgcatttgggtcatagaagtgctctgaatttaccctgtaaattgttcaacaatgttgagtgttttgcgggatgtggtttttgttttttctgtgtactcctttgtaactttgcctacagattataaagaagtgcttgagatttaaaatttaaaattaaccattaacatatcccaagaagaccacttatatgtaatgtagaaagaaaatgtttacaagagctaacagtaggttattttagtttaacaagtctcatgtctttttttttttttttttgagacggagtctcgctgtgtcccccaggctggagtgcagtggcgcaatctcggctcactgcaagctctgcctcccgggttcacgccattctcctgcctcagcctctcgagcagctgggactacaggcgcccgccaccacgcccggctaatttttttttgtatttttagtagagacggggtttcactgtgttagccaggatggtctcgatcttctgagctcgtgatccgcccgcctcagcctcccaaagtgctgggattacaagcgtgagccaccacgcccggccaacaaatctcatgtctaacatcaatctagtaattttcatttgtttaattttcataaattacttaaagaacttatttaatcagcatttctaagaggttagaaacactacttcaacccacagaaattaaatggatgtgtagtataatatatgtgaatatatgtgtgtatatataaatgtgtattactattatgaaacactgttgcaaacttcctttgaattaaaaaattctctcagaataggcattatttcatatacaaactagaatgtaatgaaataatataaattgaagaatatacaggtgatggcttttgtttgttgcctttgtaaataacaatgccattgacatttgcatacttatattaaacaaggtttactctgtcattatgctaaatatagttagtttgtgattgccaattctatgtcattgacttaagaagtcacatttacagtcatgttgagaggtttgaagtgataataataatgaaataataatccgtaatgttttgcactggtaattacagtgggtgatttttgcaaatatctgttcatgtgaatagaactataagcaatctcatgaacacattgttctcagctgagcagcacctctttccatttgatcctgagacatgaactcattttaaaattaataatgagttattatataaaaataattttaacatctgaagaaattttgttggttttctttttcttttcaaaatgttggggcgttttaggcccagctgctctcaggtttggacatatctgtactatttgtcttcgtagtgctggcaggtttttttttttttttttttgacacattcaagttttctatttttgccatttaattttccaggctctgtcatttccttaccattctttaagccttcaatccaggttctgcctccagctttgctcatgtgaaccttattccacttcttctctcaaacttattttgattccaaactttctgatattccagatgtgttgtgttcttctgaaatgaggtcctaggttaagtcaaattatgttcttcttatttttcataaaaagagtactgcttctcatcttagttgaaatacagattgaccctcctcttcatcctctctgcccctagcattcctaggtattgccaacttctgtgtctttttgcataactgtaataaactctgcttataaaaaataaattttaaaatttgaattttgaaaccaaatgcacggagaaaatatttttttttctatgcacagcccctttttatgattatttctcatgaaaaagctgattccgaatgtgcacataattatgtgtaggaaggtacaaatggaaattattagtgtcatgaactaattaatgatgacattgaaatgggaaaggttcccttgtcccctcacagggcgcgcgatgggggtgtggctcactacttcagtgccccgctgctcaaacctctgcgagaactcacagacgggcaggctgtggggctccaaccccacggcagtgcctgggggtgaatgtttacagctcatgaagccccagtgggcgtgtgctaccgtgtgcttttagtttgctgtctatatgctgcttgtgttaaccagctcaattagaccctctgccctgtcacaaggacagagggttttctgtatcccgggttcttgccttggtatactggaagaataggatcacatctgggcttggagaatgaatgcaaggttttatcgagtggaagtagctctctgctgatggcagagctagtagggaggtggttttcccctggagttgggcccttcagtggctctggctctcctcagattgccccggccaaactctgtcttgtcccaccagtatatggcctgcgggcatgctgatgtctgttagggtgctcttcagctggcgtgccccctccgcgtcctcctgccttccagctgcttacgctgatgtggtcctctcgacgtctggccacctatgtgtctgcccactggggtcttgggtttttataggcccatgatggttcctggcgggccagggtggtattggaaaatgcaacatttcggctggaagggcaggagtgcttgtcctcacctaggtccatgagagtggagccctagccagggacccagctttctctacccagcacttcccttccctcttctgtattatttaaagggaccatacttttcccttcctagcacttccatatcagctcgataattatctttgagttttccactctttgtgactatgtagataatggattttattacattaagcatcactctgcattctcaggcaaaaccaattgatccctatatgatctacctcacgtacttgcttcttccttccgtttcttatatgagttcattaaccatgttgaaatctagctgcaagagagggagaaaaatgtgatttttaagctttccatgttctctaatacaaggaaagaaagcagaaaggcagtttgactgactaaagagccattatctgctacaattttaaaataaaaattatgtattgagaagaaaagtatcaagttttagtaatggcatttaaagtaacattggtaactttcattttcttttttctttttttttttttttacaaaactgttaatgtttggcaaaatgattgatgtgatgcatagtatggaaattgcaaaatttaaaaaatattgatgggttagaacaacagggtaagatcagaggcttgagtaaatttaccagactcttttatgacagcattcccaagtatagtggaaactttttcataagtaaatgatgtgagtttaaggacaatcataggtatgctcaggaccaccgatggataaatttctgagccagcatggaagccttcaatgatttgagtgagattaacttaagtttataaagatatttaaattttattatttgagaataataaaatagcaggaagggccgggtacggtggctcacacctgtaatcccagcactttgggaagccgaggcgggtggatcacttgaggtggggagtttgagatcagcctgaccaacatagagaaaacaggtctctgtaaaaatacaaaaattagccgggtgtggtggggaatgcctgtaatcccagctagtcggtaggttgaggcaggagaatcgcttgaacccgggaggcggaggttgcggtgagccgagattgtgccattgcactccagcctgggcaacaagggcgaaacttcgtctaaaaataaataaataaaattaaaaaaatgaataaattagtaggaagattaggcaatgaaggattaaatataattgtaaatttttgttaaaacataaatatatttaaaatgcaaagtagagattgagacaaattttattgtgaaatatttctgatttgcaaaagtattattaccagggttttaggaaatatattccctgtaacctgatgttttctttcctttatgataatttattattattattttttaaaaataaagatctatcattttgttactggaacactggtacttgtagctactctgtcttttaccttctcaggtctagcttttatctcctaaagcattagactgcaggtcacaaaatctgaatcaagaacaattggtaggatggtggcagtggttagaaatcagtctaaggcatctttaagatattcctcaggagttcctactgcttttcagggttgaaaactgctgtccaagatacatataaaagcctaatattttcttactgaattaaaggggaaaatgtttgtattccaggcacgtcggagtatacaaatcaatctcaacaagtgtttaatgcgacaggtggttgtgggatacattttagaaaaataattataaaaagcattctttttctctgttttatttaatgcttgtacaaatgaatcaccattatctaaaaaattatactgtccataaagttctgtttcctgattgatcccttaatgtaaacattgattccatagatattttaaatgtattagcaagcttacttttcttgtatctgtgtactgtgaaatatgttgtattttatcatctttttttctttcttccttcaatgtgggcatagtatattttaaatatgattataaaatctggaaaattgaacactttctcacattttttttagaaatactttttttaaaaaataaaaatgtttcatgcttttttcttctaaattatgtagtcatccaattttttttcaagagagcttttgtttggtatttgatcttttattggtgtgccagaaaaaggaagaaaattacagtttgtgactgtttaggtgggcattatttttggttatgtttaataaaagtatttgcactttgaccaagtataccttcaaataatgatgaataaaggtatgcctacaggaaataacctttttctcctgataaagtacatactatacaatctcattcatgatttaaacatttacatttaagctgggttcttttattgaatatcacagttaagtttttgttaaatgtcaaaattaatgtttaactttcttcaatttaaagtgtgtggttcagtgtatgtgtgtgtgttttttttgcacttcagtatgttcatctttatccatcctaatatgtcagtagcattacatttccccacgtgactagtgctcaaattgaaaattatatgttctcatgaacatataattttttttaaatggtcagccataggtcactgcgtctcatcttacgaatattccccatgcctcactcattggtcaggtgagtaattcccagacctgtgctttattgactgaattatattcactagtttattcagtagttttctctacttttccagaggagttgtcacatttagagatcaagctcaaagtttgctgccttgtgccttggctttatctacacaagatgggggcatttatgtttaaatatttagatatatctgaacaaggaaggatgaaagtagcaagcttcattgtgtagaatcctattatttaccactgtttcttcccatcatcactgtttccacctctagtgcctgagtccattatccaaaggtcactccaattcttgaccatcttttataacctactggaatgctgttaaaaaaatcaattgacaagaaattatccaaatgcatatctagtgctacttcttactgatagtcattatctctttcccataatacaaactatttcatcgctttcttatttcttgatggttgtatttactttcatcattgtacatacatatctatttccagttctttttactctaaaatcacctatacctggcaaaatacagattttttgtagaagaaaggagagaaaagaatgatagtgttccaacctgtgagaccttaatttgtaaagaatatttaaagattcaagaggaattcatctcatcattaactgtttatttaatagtcattaactatattcttggatgtaatagtcttaatgtttattgaatatgtaattgtatgttttcttaaaagatcctataatttttagaattatgtattctgtgtgtagtcttcggaatttctctagatttcttttaggggttgagttatttcttttttttccctccatgctttatattttacttcattgcaatggcacttagaatgattgcttaggggccgggtgcggtggctcatacctgtcatcacagcactttgggaggccgaggtgggcggataactagctcaggagtttgagatcaacctggccaatatggtgaaaccccatctctactaaaaatacaaaaaaaaaaaaaaaaaaattagccgggcgtggtggcatgcacctgtagtcccagctacttgggaggctgagacagaagaatcccttgaacctgggaggtggaggttgcagtgaggcgagatcacgccactgcactccagcctgggtgacagactgagactgtctaaaaaaaaataaaaaaaaaataaaaaaagaatgattgcttaggaatcatatttttttcttcaaatgattgaatttattaccacatagacttttgtaattatacttaataaaatatttttaaaagaacttcaactcatcctatgatagtgcttcccctatcctatcacttctgaaaatacttcttagatttttttttattggctttataccagattataactctgtttacttaatagaattctaaccttcactgcacatggatgagtctctttgaagcacactctttcagtaatgaaaactcactgattttttccccttttcatagcctttttcttttattacgatattgatctttcaatatcttggatgtttaaatcccatatttttgtatcatgtgtaattcatttgttttctagtctaagacacctaatcaatctttacatgattacaacatctcagcattgttccttttcttttcacttaggagtgtttattctcacttgttcagggatatcgttttcaatgcctgcttcgtaaatctcaaataatccctttggactttgtctttttgtagtgacctcactttgtaaggtttttgttcaggtaatgtacttgaaatgaagcaaacactttatcagtcctacttagttgtttctttatttctttaaagatttgcctcggtagaaaagcagagaaagaaaaccatattacaattgtaatactccttaactaggctagaagataggggaactagggtataaaccttgggggataatactcctttttataggtgcagaagcttctgtctctctaaatcattctaagtcaggacctggtttcagaagtgactactgacctttatttactttcacaatattctgcagtttcttctttctcatgtgtaagtattacagaaatgagattgtaatatatttataattctctaattggtgttgtcagggacaaagaagctatgtgtattatacctcaaaaatagtctttttttttgttctatacattggtgtctgttatcccaaagttttgtataaactggtctgacactcatttgtatcacattacagatttatttttcatagctaatatactcagtcttttcctttaatgaagttttaaaattatgatttgttagtatttatttttgttagagaaaccctttgtcctattcaagctgttgctatggattcaaccttggaaaggtttcttgttttttattaaagaaaaaaaatacattatgatggcatgttttaaaataagaaatctaaaataatggtatctagtgaaatttgatctataggttattgctttagaagtttaactaatttctatccttttttagttaagctactagccaggatatcttcttttctcctgtgtagtgtccagtcttgcataatataagagctcaggggcaaaatctaatcatttaatctctctctatccacctctctcaattcctgaacattgtagatgtaaagagcctcacaaggatgattttatatgcatatgtcttatataagtttatttgattaattgaaaactatgaactaaattatgaggcaaagaaagagatttctaaaatatatgaactttattatccagataaaattaacagaaaattaaaataatttcaagaaaacagttatgtttatttggtacccatagcaggcttaattaaataatatataatgtcatttgtagcctaaatattaccctaatttatataatcttaccgattaactatgtacagttttagaaaaattcacccaggaagtggtcttttatatattaaggtctgtttaattttagtgatctctttattttaattccccattaatagaaatataaactcaaagttcacaatgaactagcagttacgatgaagagtgtttctgattttcatcttcctagttaggaaattcagaatgcaattttttcaatagatattttttttttgttcactgattatctgtttacttaaatagtttcatctctgtttaatgaagcaaatatgtcaggtattgggtaggaaaaaatattccctttgcttttccatatggtaaatttagaggcttcatttacatcacgtatgcagtgattgtttttgtctaatctttgaaaatacttacgtgggaagaaggctaggtataaaaactgtgtattacaaatttattgtttttttttgttttgttttttttttttttgagacggctggagtgcagtggcgtggtctcggctcactgcaacctctgcctgaaaggttcaagcaattctcctgtttcagcctcccgagtagctggaactacaggcacctgctaccacgcctggctaatttttgtatttttagtagagacggcgtttctccatatggatcaggctggtctggaacttctgacctcaggtgatccacctgccttgacctcccaaattgctttgattacaagcgtgagccacacacccgggcacaaattcacatttttaaagtcccttctctcaagtctggaactcagcaatgtttattttgaaggagtttgctttacctgggaatcgtcaaggagacttaccttgtttagtgaagttcactgtaacgtattagtacatatttgtctactttttgggagtaagaacacaagacaaatgtattatttagactactcatgaagataacttatatctttaaactctttccagtactgacaaatttcaactaagtttatttccattttattcatagaaaaattattgtttccaaattttcccttattggctgtattagtttcctaaggctactgtgtaaatatgttggctttaaataatgtaaatgtattctctcatagctttgaagtgcagaagttaaaaatcagtatcaccaggctgaaatcaagttgttgtcagggccatagtccctctggaggttctaggggagaatgtgttccatgacattttcagcttctggaagtggctggcattccttcgctagtatcctcgtcactccactctctccctcctgggtcacagtgtcttctcctcttctatatgtaaaatctccctctgtgattgcccccctgcagaatctggaaatggagtaagaatctctccatttccagatttgtactttaatcacatctgcaaagaccttcttttgtcacagaaggtatcattcacagattcttggcgtagggtgtggatatcttttgggaggccattttcagcctcacacaatggcaaagagattcttgcccacatactcttcacataagcttcattaatgttaaattggctcagcagaaatgacaagcagagctgtggatagaatttatacaaataggtcctgttttaaacaaaacaaaacaaaaacaaggataagtagtgaaagattagtttggttgaaatgaaatttatgagctttactttaaattgtattaagttattttaaagttttagcgattataaattctatctatgcattttaaaataatgtttacactagatatttgtgactattaaaaacacacatttggctgggcgtggtggctcagccctgtaatcccagcactttgggagaccgaggcatgtggatcacctgaggtcaggagttcgagagcagcctggccgacatggtgaaaccctgcctctactaaaaaaaatacagaaagtatctgggcgtggtggcaggtgcctgtaatcccagctactcaggaggctgaggcaggagaattgcttgaacctgggaggtggaggttgcagtgagtggaggtggcaccattgcattctagcctgggcgacaagagtaaaactccataacaacaacaacaacaacaacaataacaaaaacacacatttatttcttcgggattcaggtcattggtagaattgttagcttttcatctggaatatcacttatttttctacttaattacaaatttttgattacttttttcttttttatgttccttccaccctcttctacaaattacttaaaaattaattataggccgggtgcagtggctcatgcctgtaatcccagtacttttggaggctgaagtgggcagatcacctgaggtcagttgttcaagataagcctggccaacatggtgaaaccctttctctactaaaaataacaattagccagacctgtctgtgtgtctctgtgtgtgtgtttcagtcttattggaaatacacatatacatatatatgcacacagaatactgatattcagcattgtacactggtatggctatacttattattaaaataaaaatattttaatatttgataaataggtactgctcagggacttgtgagtacaactcctaccaccctcatgtttcttccagaacttccagaactcgggacaactcagctattaaaggattaacagctggcaaatactctgtggccatcatctcatctgattggtagaaacaaaaaatatacatgttgttaaaatatgttgggtttatgtgtacatatatcaaaacattgttttacaccttgaatatatacaatttttgttaattataactcaataaagctgaaattttaaaagtgaaataaaaaagaagtggaagtagtatttttctataaattagaaatcacttgtttgataattcactttgacctgtagcctatcaaatagttatcttgatcaatatgttttttttcactctgctttaagcaaaaattttttaaagaaaagcttctcctcacaacattaggagatatttgtagtataattggggcaatttgaattatatgattcaataactgtgcgttttctgttagcctgctacactttccttcatgaagcctagagctacattcattaccatctttcaaaatatgctaacagttacttctaaccagctgaacacatccgattttttatataaaactgttggccacctaaggaacatattatctcagtaattttccagtacatggaaaatttgtgttttgcaagaagcactttaaaatatattccaagcatgaatgaacacacacacacacacacacttttttgtcttcaacatttactgttttttatattgtgtatttgagttttaaatgacatgttctaaataaaatttgactttaaaccattcactaagttaatttgacttttacacagttagaagtttcttttattaaattatttatgtaatctaataatgtcttttgatgataacctcctataagtcaaataaataatttggctcattaaaaaggattattatggtattatttggtattattatggtattattttcattatatttctttcaagtaatttgatatattttgttaagttgtatttcttaatgtgttaatatacttaaggtacgcaagatgtacaccttaagtagcacactctgcagatgtatgtgtgattagatgattcatatatttgtaatccttactaaaccgcttatatttttggaatctagaatctgtacaagtaaatgaagtgataatatcaaaacgtatagctaaaaaataaaaactactaacaatccccttacccataggtaaccatattgatatttttatatcttttaaaatactttaggctgtgagtttttgtgcatttacattagaaagatacaatatattctttcatataacttagaagactttttctgcaacctttaatatgcttaaatagtatattttttaacaactatacattattcagtcactctgtgtttgctaatagaagtagcaccaagactgatagacaaggctattgttttttgagcacatatcttgattgtttccatgaggcaagcttttataattagtattgctgattcattgaagttacttttttcttttagctttattttttttttgtagacagggtctttctctgttgtccaggctggagtgcagtgtcatgatcatagctcactgtacccttgaactctttggctcaagctgtcctcttgcctcaccctcctaattaacgaggactgtatgcatgcatcatcatgccgtttaatttagcttaattttattttatttttcattaatcttttgtagagaccaggtctccttatgttgcccaggctggtctcaaattcctgacctcaagtgatcctcccatctcagcctcccaaagtgctgagattgtaggtgtgagccactgtgcctgacctggaattaatttttctgaatttttgatgcagattgtcaaattgctattcagaaattttatactgctttatactcacactagcagtgtatcagacctcccatttgacagtatcaagtgaactcttttaaacattagctaccagacttattgttgaaagatcaatcaagccagttctttctttcagtttgctccatagcatgctgacattttgaggttgtgagttaaatgacataaagttttctctaaaaatttttccgactggaatttgaactcattggagcataacacaaatgcaggatgtaccctccccctcaccaaaagagttttgtgagcaaagtttagtccgtaaaggctatagtctttactctttgcattgtctctcaaattaaatttatttagatttattatgatactcttatttggttatgaagattacaagaatttagaaacagaaagtgaaaagcaaggtgagacagctactatagacaaatgtactagtaagtaaaacctaagttactataacaaaaatacttgcaaaatccaggggcctaaagagtagagatatttattatgtaacaatcacaggtcagtgttccggatttggtagaaagctttgctctccttaacagttggttgcaattccatgaataagagagaaggagaaaatggagaaattaaaatactccactcaacaagcaaccctagtagaaatgactgttagagtagcagaagacagaacctttggaaacaaaatattgaagttattcagtgaatgagcaaatactcctttgtcaagtctgtgatttgattttaccctacctacaaacttagaagttaacctgttaccatattgtcgattctggcccaggactcctagaacagagaacaattattttattactcatggcacagtaggtatcatattttcattggctccccttgtcctccaagccccataggggtgacactatatgacccagatggctgctgctcacacgttgggttcacatcatagctggataatattgagcctggagaatcccttcttttgtagcagctctgtgtcttcaagggcatcattatgttatccttgaaggctgcttgctagaaggacagccctaagaaatggctcccattaacaatggtcagggccttgccttcttggcatacccagcaaaagatataggagcatcagagaaccatgcaggtattgttcctttcaacattcaacacccatcactcagtagcctctggagacatttgtgtgtacagcaagatgaatggattagtgttccaaaggatgtgggggttaaattcagcatgaagtagattcttcatgtcttaaaattgcaagtattttctctgccaacagacacctttagaaattattattagtttatgatgggcctttggaggtattatagagccgtttacaaaacagagaaagcataggtggatagattagccaaagtggtagtcacggaaaactggtttatagtattttgtttcctcataccttgttctgggttgatgagtgagcaaaaggccctttcttaaacatattactgtagcatattatgctacaaattcatgtagcttaagggagttttttttttaagcttaaaatagttgaaatagattggtcttattgattcatgttttgtgataatggcttgaataatagcaacacctggcgatgattagctttaataggtgggaggcataatgaaggagaaataattgtattcatgtaacttagacattcctttcaccacttacttggcctctccgtcataaaccataatttattattttttggcatctgaaggaagtgctgtggaagcctgttcagagaagagaagtgagtattagaagctctgcgttgagcttttggctctgccgcttggttattttgggacttctggcaacttatgtaatctcacttaatatttaggtcacaaagattttctggaatcaagtgagataagaatgtaaaagtctttataaactataaggcattatacaaatatttaattactaagaattgtgagtacttaacctttctctattagaggagactgaagaatacgttctcctcaatgatgaggacataatatagcttttaatctggatttttaaaattgtattctacctccttttagaaagtttagtaaaaaaggcaactttgtgtaaaagctacaatttcagcctgctgcattggctcacgcctgtaatctcagcactctgggaggctgagacaggaggatcacttgagcccaggagctcaagactagcctgggcaacacagagaaaccccatttctacaaaaaaaccccagacccccccaaaattagctgagcatggtggtacatgcctgtagtcccagctcctcgaaaggctgaattgggaggatcacctgagcctgtgaggttgaggctgcagtgagctgcgatcgcaccactgtgctccacctgggtgacagagtgagtccctgtctcaaaaaaataaaataaataaaaagctatcatttcaatcatttggaagttccatttatatggctggataaattcaaaatcatttattcagttctaagtcttaatggtagattcagttaaaaaaataaatttgttattttttattatcaaaaatagtcatattgctggcaaatatgtgaacggatgattaaaggagataatgtttggttttatatggtaaagaatacaacaaataggaggtaaaagaagttgagaaggtgtggaaaatgtatgtgtctgtgcgtgcacattgtgttaatcaaacctgtttttcttctttagcttcctgaacatgttttcattagttgctatagaaagcaaatgaaagagatggttatataactcactaattgctttttttaatggagtaggatgattttctcccattgattgattaattgacagaagcttccaaataatattcttgtctttttagtatctactgttcgtttaagtaagcactcttatggctggtttgcagtggtggaaattgccagaaagccataaaatgttcaagctggaagttactttaaggatgatatagtaacagcagatgagaaaaccaacattgatagaattatgttcctgaaggtcacacatctgtatggtggtctagattcttaagatcagtcctcctttcctacttgtagcagtgctcctaaaccattatgtattatcagagttctggatgtattttaaagcaataacatgtcattctctttttaggtagttattactagtaaaagcggagagatcttgtatcgtatttcaccgtgggcaaagtatgtggttcgtgaaggtgataatgtgaattatgattggatacactgggatccagaacactcatatgaggtgagaacaacaaatctttaaataaattattgttccaatatttctaggaaagttaatttttacttttataacttttatagtaatgttcaatgcttatcttcactgacagttgcgtattttacatcatagtattccttttatactgtatgagtatcatagtctgtcttctgtagccagtaacatatagaagttagtttttgtgttgtctatgtttttgaggttaaagaaaacagaatactaaattgctatatactaatctataagggatactggttttttttttaaactacaatttctgattgatcagagactctttagtgcagtatttctcagggtttgaattaggatcaatgtccttagaaacacggaatggggaagaccatctcatgaatgtattaactagggtaatttttaccgccatattagtgacaagtgttctgtgattgtttgaactcactttctgtcttttaaatcattggagtttgttgatatatactttgcattagataattacatatgtatttcatggctcttacattttctctaaggcctaagttaaaaaaaaatttactcaatgataaggcataagctattacatgatttatcttttaaaataggtccactagcaggaccataaggactttttcctgagagaaaatttagtgagtgtagctggtgccttttatatgtgagaatagttccaagtgtttgagtatattcaccactttttaaaaatatacttgatcaggtagtgtcataccagaattcctggcttaactctatacataattttatattctgtagtttaagcattccagaccaaagaagccacggagtctaagaatttatgaatctcatgtgggaatttcttcccatgaaggaaaagtagcttcttataaacattttacatgcaatgtactaccaagaatcaaaggccttggtaagtaataactgtgatttttattcagataaaattttaatgagtctgttctcttattagaaaagctaattacaagtgtctcttttttgtgttaggagattaaatatgtaatagaaaggcattttattttaggcttctcaaattgccctgtaatagtgatagcatagaaaggagaaatggaataagatagagcataagaattaaagatattattccaatttaaattttaagtaatgtgaactgatgacttccaaaattatagataaatatgtaagcataattacttttttactggaggaaacctttatcaatttaagtgattattgactatagcctgttcattttagtctgttaaggaaaaaaatattttatctgtaatgtgaccggaactcattttgtatcagttattttatatagcccctgcctggatgatttatttaacaaacatttatagaatatctatgtgagacacattttgctagatgttcatgtattgaactgtaatggcacagatcctgtcttcataacaaacaggagagtaaagaatatattgctgaattattgattcagtgtgctttaaatctgttgtttttataggtaatgatatttaaaataatacaacagtatatttaacacctgcttcaatgactaggcaggaggataaagcacatgtaattatgctgcttctgctagagagtccaaattttggctagaagaaaggtttgtaaggcatggttaaagttttcagttatgtatggattatctgtgatggtaaagtcaggttccagaaaccaaaattaattaaatgtatagagtatttagtattaattataattaatagatattatgctaaattattatatttgagatattctttcatattatggagtaataaattgcttatgacccagttcttgcagaacgttcagcagcacaaggattctcttactcatctttgtgtttgaattgtctagcctagtacctggaatgaaagtgaatccaggaatgattaatgccataaaaattaagaataaaactataaatttgtgcttgatacaaggtatcagccaagaagaatgaaactaatatctttgtttataagtgtatttacaaatatagttgtatagttacatgaactgccattaacaatgagcttatataaaccttaagaaaattataaagcttatatgaattggactttgagagcagaataagaatatttactatgtatgttacagaactgtaacttccaaagtaatgaaatcatattcgaacattttaccaaattatacttcaagaagaaaaacctgtttttcttagcttttttaagaccaatactttttcttctgatcatttgcttatattaaaaatatattagaatttttttaatgttacggatttttaaaacacaatatctacttttttgagtcactttatttactgttagagcaaaacatattcagatggagaaaggaaggtgacgtgtgtttgtatatgcacatacatgcatatatgcaacttggaaataattttttaggtgcaaattatgtagtggaaagtagaagcattaatgctgactgtataaaagctaccttgcaggctgggcgcggtggctcacgcctgtaatcccagcactttgggaggctgaggtgggtggatcacctgaggtcaggagttcgagaccagcctggccagcatggtgaaaccccatctctaccaaaaatacaaaaaaatagccagggatggtggcacgcacctgtagttccagctacttgggaggctgaggcatgagaattgcttgaacctgggaggtggaggttgcagtgagctgagatcaagccactgcactgcagcctgggcaacagagcgagactccatctcaaaaaaaaaaaaaaaaaagctaccttatggaaaataagggtttggtgctatttcttatgctatatggaaaaaaggattgaaatatatagaaatacatagagtcaaaataaaaagcgtatgtcatgcaattggttatttttatttagctttcataatcttcaatatgaatattgcaagtgtaactgatgtttagcatatggagattgccgtttttaatatgctaaaaccaaattaagtaaatttgcatattatttattgcttgttaaaatgaagctatatcaaatagctagtcagaatacagctctaagagactatccaatgttgttagaaggtcaaacaaaaaaatgttaaagtagtagaacttttcaagacgaccaaagcttctagattgtttgtaaattttaatgtatttggaataaggatgctttttttccccattactttttttttaaatgtggcttttaatttagatttgaccattgccttatataggatacaactgcattcagttgatggcaatcatggagcatgcttactatgccagctttggttaccaaatcacaagcttctttgcagcttccaggtaaaatcagagactcattgtgttcatttttattttgagccaataatttaaagaaacaaaatgaaattgttcattttttataacatcgtgtaaccttttagggttaacagagttaatagaagctgaacattttcttttactaaggtcatagactctcttctcctccagccttagaaattgtccttgattttatgttactcctcgtgggatgatttgtgatatagaatgtccagttacctgctgaaattgtcactcatttggagcccacgttttagtcagaaaatcttttcctatgaaagccattattgtgagagagcacatcgttttctggaaagagattgactcatctaggaaggtcaccgaagagtcccttggtacaacaattactactcacagaagggctgcccttccctccagactgaaatggatggaataattctctctggacagaaaagacaccaagggattctatgcaattaaagaggtgctgacctaaaagaccacagaccgaagaagtccaacactcagtgtcatggagtttatgatgtatggcatatagacattgctcccatcatcattcatacagattattatttttaactgtaataaaagctaaaatgaaaatgacagggaactataatcagaagtctgatcagtttagaatagatcagaacaaatactgcaagtgagatctaaaacacgactaagagttaactggggaaagcggtgaagtgggcgtaaataggtgacattccagacagaaaaaagatactggttcatttacctgtttctctttatattagttctccctcaataagttatctataatactgtctccaaatcctccactctggttctttcctgagcccactccaagtatgcggtctgcctctttactgaagttgcttttgtcaagggtattagtgaccttcacattgttgaggacaatgaacaattcttagcttacttaagctgtcagcaccccttggtacagctggttactgtcaccttcttgaaacctttttctttccctggcttccagaatattttaacctcctcttgttgcttttcccacctcacttgttgcttattattaatttcctttgctctttcctcatcatctttactaccactaaatattggacgtcccaataatcagaacttagttccattctcttcttcatctgtatgaaatattcgggaggatctcatcaagtctcatccagttttgtagcttaaatatatgctatatgttaactcccaaacttaagtctctctgacctatcttatgaacttcagaaagtatatatttgatgttggagtatctaatacatatatcaaacttcatgtgtccaaaattaaatttctgatcttaacttcaaacttcctccccctgccatcttctctaattcagtaaatgacattttcatcttctagttgttcaagccaaaaatcttggcattatactggacttgtccctttctgttcctccctacacgctagctattaaaaaatctagccatctgtaacttcaaaatatatcccaaatctggctgcttcaactgcccccactgccaccacccatgtccaacttgcaattatcttttacctgggttatttcaatagctctttaactggtcactctgttttctcatgctgtctttccccttctcttacctttgttctaccaattaatggtcaatttttctgcacagtggccagagtaatcatttaaaaattaaagtcagatcatgtcgctcttttgcccagaaccgtaatgaatccctgtctccttcagaataaaagcaaaaggcctcacactggttcccaaggcctcacttgatgtgcttcttgcctgactcttagagctcacctcttttctttcttgaccattccagttagagtagcctgtttggttttcttcaaatgctcttagctcaaccctgccccagtcccctgcacctgctgttcctttctgtctgaatgctcttacccttagatattattatgccttgcttcttactttttttcttgctcaaatgttgccttttccatgaaactttaactgatgaccctatttaaaatagcaaaccttccctccccaccagtggcttttctttgttttctttaggacacttattattatcgacattctatgtattttgcttgtttgttgtctcccaatgggaatgtaaattccatatgatcagtggtgtttatttttttcgctggtgtatctccagaacatagaaaatgtcatggtacgtggtagatgactttagtaagtggcaaacaaataaaggaatgaatgaaggaatgagtgaatggctgaatgaaaaaaaaaactttaaggctgtttattattgaacatgttcaatgagtataaaaatggataggtggctggaataaaaagagggtgtgggagagtgtcataagataattagcattattggaaagagccagtagatggtgcagtaggccacgatcaggacaatggtcttcaccctgggatgaatgggagcacaagtatgattttaagtaggtaacatgatcttatttccagtttaaaaagacagctcttgctgctcagtggagttggctattgggagacttgctgtatacttagcactgtaccatatcatgaggagcctgatagtaacagccgctgccctcaaggagcatatagtcgagtgaggaagagagacagtaaacaattgaaggcaaaggtgactatttaaagggcaaagttgatgctgtggatgactataatgtcaaaattttacacaggttaagaaaggcattcttctgtgagtaatttttgttacctatttcattcagactagggggtacctttgacacaaacacacctgcttgtgagctacccatcttatttacttgggtggtgacaaacgtggcacattgtcttggcccactggtaactgtgggcattctgtttttggaataagtgcaggagggataacctcaatcaaggtaccatggatattcaaataaattcttgaagagcccctcaatctcaaatgtacaccctgtaagtaatgggcagtgggcaaacagagcaggaatgacttgcttcaggtggaaatcagaagctctgaaaatagagaagcagagttttattatttacatcctcaaaatgtgaattttggttggggtataaatctacatttaataacccgatttaaattattttctaacttgatggttttaaatttgcttaatatttgatattaagcaaatttgagttgtatccaggtatcatgtcacatgctgtttggatatttaaagtatctagtactgcgatggtgaaacaattgctgcacaatcggctgtttcctctaaatgtgatgtaatcttctttttgctgtgttcttcattgttagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccaggtaggtacatacaatatagaaatgttttctattgttgctgtttaacattaatttttaagaatttcactaaattcattgtgtgtgtactctctcactggtacttaatgttcttaattggatttatttttgttgtacaggggattttaccttgttttgtatagcacatgtatttgtggtatatttcattaaatttcaattttacatatcttacgccatgtaaaatatattggttatataatcatttaaaaattttactgtgaatcatttttttttaatatctaaaaggccactttatcaatttgacttaaaccatagccagtctccttttactagagaaatacattgttttaagtaggccatttaaaaaaatcatacttcattgcttcatatcttaaaattacatggttttgattacagctaaattaatttataactataaaacaacagttactagtatataatatgtttcatgtatggtgccaagtgttttagatatattagctacctattttatcttatttaatctgcacagcaactctacttacatgtggtaaacactattgttatagccatcttacagataaataaactaaggcttagtgttgaaaccatttgttaagatcagacagatctctgacctcttctaccatttaaggagaagagtgttttacgtgattaaatagcatatggcaaaaattaaaaagacaagttaaaaaaccatgaacttgtgtttattatttattgtaagtgaaaaaatgaaaatgtcaagcatattaaaagcaaagtatcaagtaatgtataatacatatttttataatacatatacatatttgaaatatgtatatgtattatatacatattatatatattttatatatgtgtatgtatttttgaaaaaaattaatgaattttctttccagtgttgcatcatacataaacataaatatacctagaaaataggctgtatagaaaaatgtctcagcaaataattttataaaatgaagaggtctcatttttcaacctaaattagatgacttatatatgaaggaaattcatacattatttctggatatcatacattattttatatttcatagccattcaggaatcactcatgccagataagacagtgtaataggtgagaaaagaaacaagatggtagctgggttcctggcctagactcactctggtacaaactgattaatcattcttattctcaggctttttattatagaaggaggcagagtttggggactaatatagttttgctcatgaaggtattttgtattcatgtcaccttttgaacatttattattatgccacagatttatggcaaataaaaaagactaaatctgtgttaattctgtgatatattaggttggtgcaaaagtaattgtggtttttgcccttacttttattggcaaaaaactgcaattacataactctactaattacattgagtacatcttatagaagtagaatatgcccaagaaattcaattaattgaactctctggtttataattggatgaaggagggttgactctattttgtagaactgtgccttatgaaagaaatatatttattaaatagttagatttttatgttttaaaacaattcttctgtagaattataccttaaaaagaaatacattaagtggatggatttttatgttatacaacatttttattttattcacatgtttattgtagtgtaccttgttgtaccaaagtgcatttaaacttagccaattttctaaacaaaagggatcatacatcattgttttcaaaaacatttctatcacagaaattgagacaaacttaacattgttatttaatactcggcttcttttttattgaattaactattaatctttctcatgtgcatgcttttggtaaataaagcatcctatagttttagcttaatttattttttattgtgaccattttatttgttttttttctgctgtcatatagacttagtcctctgtaaatatagttttattaaattgcatttgtattattctacatgtcattctgtttgaccaatatctaaattttcccattttatagaattagtattttctatataggtttatactattaatgtattagggttctctagcaggagagaactaataggatatatatatatatttatatatgaagctatatgtatttatcaaggggagtttattacgagaactgactcataggatcacaaggtgaattcccacaataggtcatctgcaagttgaagagccagggagctagtctgagtccccaaacctcaaaagtagggaagccgatagtgcagccttcagtctgtggtgaaaggcccaagagtccaaaagctgaagaacttggaatttgatattcgaggacaggaagcgtccagtacaggagaaagatggaggctggaagactaagctagtctagtttttccacattcctctgcctgcttttattctggctgtgctggcagctgatgagatggtgcccaccgagactgagggtaggtctgccttttccagtccactgactcaaatgttaatctcctttggcaacacccttacagacatatccaggaacaatactttgcatccttcaatccaatcaagttgacagtcagtataaaccatcacaattagtcatgacattattaaacaatatagataaaatcctccaaagccagtgtatataaattcatttaaacaaatacttcttagcaatcatgatcaaagtcctactttgctcttttggttatttattgctgcttagtaagccaaaaatttagtgacttaacagcaatatttattttgttcccaaactcacaatttgggtatacctcagtgtggactgctcttcttttcttcaccttgtgtcccctggggtggctcatataggggacagagcatctgctttcaggatggttcactcatgtgacctacggttggtgctggctgtcagctaggagctcagccttggttgtgagattgaggaccccaaatcccctcctcctagcccactccacagacaacttgggctttctcacaagagcgatagtcccaaaagacaggatatgcaagctgccattttatatggtctgggtttagaacatggcagagtgccatttctgttgaaaactactggtcaatcacagtttcaagaaaacttgaaaacttgttagtttatctaataaaacttgttaggtaaagataagagaatttttgcacatatccttaaaattccttaacgcccctcccttcgaaggggcgttaagtaattttaaccacacacaacgaatatgctactttacaaattcaaaatagatgtattgaaatacctgttcatgtggaaatattatttactcagccatatttctgttatgagaattatcagagagttatgtctgaaatagccattttttttaaaaaaaaatacacctttcattataaaataatgccattgtaattagaaaatttaaaaaggcacacaaaattcaaaataaaaaaactatatttgaaaaatgtgaacaacatacttgtatttagctatatgtgaatgcatttaatgaatattccttacatgcatagaaatacataacccaatccttcactttcaccctcttcataaaatagctactctgcctgtaattttgagtttgttccttattcagatgaaatcagaaattacaatttatgtttcatattttaaatacaaatttttccaccccttacatttgttaggctgattaattttataacccattgacaaacagacataaatatggcacatggcttgcttaagacctaagcctcttctttgaaaacttttgtcataatttttgaaattattatatttactgtttgaaaaaattgatgttatagaattgcttctgtagagatatgttgctgatgctcattttatcctatctatatgtcacaacctgtcaccatttagaatctgtgattcaagtgccatcatcaaagttaccagaattaaatctcttactctgagtaataccagagatcctgactgtgctatttcattacctgctatgaataaatttccaatcaggagctgcccatgtttaattttctgtctactcagctgaactgccttctagctttgctaaattagtaatgacagttcatcacagagattgggttgtcctttatttggtaaagagaactttctgacaagtgtgtcacccataagtttcaggagtttctagaattagtaataatgaatataatgtagtggtcccagttttaaattctgtttgcatattcctctggcactacataaatgcacttttaagacaatgaaaacttgttggatttaaataactgctatgccataaccattactaaatcttcaaatgaatatcttttgttcgttaaatatttctttcaaagataaaatactgacttctaaaggagatagcaaagtagatctaatgctcatgtttttcctccttaaacttatgtttggacacaaaattaatatagttatatttcatcagcttgagttcataatatggtaaccattaggctaaaagatactctcttttcttgagcaactagagttgttttcagaaacaaaagtgagtccaattggtctttttagggtcataagtatgtagaataaagtactcttaggatagacactatatataatatttgggacttcttaaccatggtgggcattttctacaagttagtatgtggaaggaaattcaaggggttctccctgctcagagtggatttttgtatctgaggtaattattctatgatatcttaccatatggcttttctatggttaattagaattgatttttaatggtaagccagtcttgcattcctgaggtaagccctcatgaccatagatgtaagtattctaaacaaaattttagcttaattatatatgatattacatcatgaccaaatcagttctcaatgataaatattaacttgagggttattatgcatcagtatactagctaacgagtatatgacaccatcatgattagcaagattatttaaaaactaagcaaccatgacatgaatggaaaattctaaaattatttttaagaggatttttaagtcatacactactttttgattttgtcattgaattacaaagagaacaattcacccaatgacaaaaacaaaaaaaatacagaaaaaatagcatacaaaggataaatatgtacaaccacatttgaaaacaatttggtattatttggtaaagttagagatacacatatactatgctgcatttttcaatatatatgcttggagcatatgtttgtcagaaattttggagagatagacttaaaaaaatcactcctttcagagaacagtaggcgcccccatttatctgtggttttgctttctgtgatttcagttactcatagtactttagcttgaaaatattaaatggaaaattccagaaataagcatttcataagttttttattagttttcaatagtagcctaatgctatgtcacaatgaggtcattcacctcacttcatcatataggtaccttatcttcatagcatcacaagaagaagagtgagtacagtattacattttgagagaaagaaagattacattcacataaattttattacagtatattattataattgttctattttattagttattgttaatctcttattttgcctaatttatacatgaaactttatcataggtatgtatgtataaagacacagtatatatagggtttggtattatccatggtttcaggcatccactggcagtcttggactgtatctcctaaaaataagggagagctaatgtatttgtttttaatttcactggatagatttcaaagcactgaatttttttataattgaagtaatatagcatcattttagacatataaacacctgccttatatgctttacaaaaacaaatgatggctggacatggcggctcacacctgtaatcccggcattttgggaggccaaggggggctgatcacctgagattgggagttcaaaaccagcctgaccaatatagagaaaccctgtctctactaaaaatacaaaattagctgggtgtggtggtgcatgcctgtaatcccacctacttgggaggctgaggcaggagaattgcttgaacctgggaggcggaggttgcagtgagccgagattgcgccattgcactccagcctggacaacaagagcaaaattccatttcaaaaaaaaaaaaagccaaaaaacaaatgatggatgattaaaagacattttggacatagtttagcaaacagctaactattccaaaggaagtcagacagtaagaaataagcagtaacttatagcctgttcttcactaagaatattataatctcacagtatgttaataacttttgagagtactgagtgtcccattaaaagtcttcctgttttcttaatattttttctttccctttcagcatttcttccttgttaaaaccagaatcttatttcagcttgattaaggagaacagttaaatctactactctttcaaataaagtagagttagcttcaaaattcagacagactaattctcttctgtaaaagagattaagaaagttgctatatcaatccaatctgtctggatttgagtttgaatggtagaaatataacttctctcacagggtttatgagattactcagtctagcagaaaagtttctgttgatgcagagtgtagcacaggagtaaggatttaccgtctttgtataaactttgttcctggtattatctgcctcgtttattccccacaagcctaaaatttaggagcacagggatattttgaaagtatcttgagtatttacgtcttactcacctataacattcaccttctcaaatccaaactcatgctgaagtaggacagttctgctgggtaatttaccttaagtttaaaaatgctgctcattgccctaaaacatctctctattttctttctttcgcttaaaacaatggttggtgcatgcttgtgaaaatggtcctaaggtccctattcaagtgattatccatttaagtctgggaattatgtggtatctataataataatggttttgtttatgacctttttaaataagcaggttaaaagtgggaaaaaatcaatttttctgtttttatctgggtgtagcaaaacagcttgtttaaacatgtctattttctacagaatagactagcagttttgaagttatgaagagatatttcatggttttctagctgaatgatttccttagtgttatgctgcagataaataactcatgttacattgagtcacttactttcagaaaatataggtttttcttataatttcgaaagcatccatatataagtaatataaaattattcatttttgaggaccttattcccattaacttagattagtgagcaggcagatttttatctaacttctgcatttcccatccacattttataatgttgaggcatcactattgagttgtaacttggatcttcggtcttccttctgtttctttcaccatatgtaagagaagccgatagccacaggatttggttccttgtctacttctaggtttaactgtctccccaagattagacttttacctgtatagcctttcaaattctgtctgttgaaagcatcattaaaacttgggggcagttacagttacattttctcatagcacgttaggaaacaaaacagcatgatagccaagttgtctgagactggagctctgttcttaacactgtgttaagaacagtgaaggaggccgatgagctgtccaggtgggttccccttgcctttgtgagattatgatattcatgatggttactgtcataccttcattcatgcagttttgaagcattaggtgctttagaagcttctcaggccacttgatataaaataattcatctagtccctaccatgcttccctgccacatgttccttcactaacttttctccattgtctttcccaccatgtgacatttggaatagttgtttatttttaaattttagtggtatatttgttgtttccatattaaatgtgaaaggaaagttaataatttgttgtttctcatgggatatattttatgtaaagtaaaatacctctcttttttccccctgtctcttgatctctccttctctctctttttctctctctctcaagtctctgtcataaacttttcaccatcatgcttgccatggcggcaacactgcaaagtgatgtgatagattcctgttcgttagtactgaaaacagtgaagaaagccacacaagatgtttccccccaaaatgctaattacaacactaataatagcaataatcatgtatactatatagaattaagattaattgatttaatacacaatataaagtgggtggttttagaattggatgatctttacctctctgctcttgaaccaagctgcttacatttgagtttcagtttcatgtataaagaactcataatgatattatttatgtgccatagggcggtggttcagactgcataaaataatacgattgaaaatgtgcaacaactagaatatagaatatcatggaaagtttggagttatactttcagatttttactaaaggataaaagcaggactcgcgaacgaggcaggtaactgagagaagcaggccaggtggttcttactggcaacctggcaaacggatctcctctgaggtggctgccattcacaaaccatttcgaatacaattgtcagttgctttcgtgttgagaatgtggacccatggagccacatcttctagttatttaagtcaggagcccacattttatatgaaacctccctatgttaaaatgtcatacaattagtttaaaatgttcattcactgtgcataccaaagcaacatacatgcaggatggataaaaaccagtcactaaggctatctctgggttccaaaatgtgccttaggagacacgcaacaaatcagattctaccaaactaccaaataaattaaggcataagtcaaatctaataaggacaactataccttcatagattaaatatagtatttaatactctattttgtattagcaatggtaattttataaacctcaactattagtatattatcacctagcagaattgtgtaatatctccttgattttaagtagtagaggaataaacaaaataaatgtcttttaatatcaggttcagtaaagcagaatacaactttattaaagaaatctgtatagttaaaatttggtaaccttgtttcttttaatgctttgcatctaagttgctgttaatttgtttttaaaatataaatatagatactgaccttgcaggcagtatagagaataggtataggcctgggctcaaatactagttcatcacttactagcatgtaaccacagccaggttaatctttctaagtttaactttaatttccccctctgtaaaatactaataagattatagtttatctaccttgtataattgtgaagggctcattacacacttcccccagtgtctcaattatagttgtgataattgtcattgtcactgtcatcacaatatcattgtcatgattatctgtggtcagacttactagccaccctcgttctctgaaacataactacaagcattgaaacaggtaataatatttttttcatgagccaaaccatgtgccataatgtttatggatatttgttcgttgttgtatcacactatttttaaaaggatgtcaagctattttttggtagaaggacaaaattcagaacaattgtggaactgaccaactgtgatcaatatctaacagtattgagaagtcacagcaaaaaacaatggaagaaagagaaagtgcctcaaggtcagaaaccaaaactgaatgcccagcattgtaaggccatttacgtgcagcagcaaacagctccgcacagtgtaattgtccctctgggcattgttagactgcagtatagtataataattgatgataatgagtctgagtcattaaaaaataaacttcaagtcatgttcaaaatttctttttaagatgccaggaaaaagtaaaatatataatcctttgggtatatacctagtaatgggattgctgggtcaaatgatatttctagttctagatccttgaggaatctccacactgtccacaatggttgaactaatttacacccccaccaacagtgtaaaagcgttcctatttctccacatcctcccagcatctgttgtttcctggctttttaatgattacctttctgactggcatgagatggtatctcattgtggttttgatttgcatttctctaatgaccagtgatgatgagcttttttttcatctttgttggccacataaatgtcttcttttgaaaagtgtctgttcatatcctttgcccactttttgatggggttgtttgtttttttctcgtaaatttgtttaagttctttgtagactctggatattagctctttgtcagatagatagatcattctactataaagacacatgcccacatatgtttattgcagcactattcacaatagcaaagacttggaaccaacccaaatgcccatcaatattagactggataaagaaaatgtggcacatgtacaccatggaatactatgcagccataaaaaaagaatgagttcatgtcctttgcaggggcatggatgaagctggaaaccgtcattctcagcaaactaacacaggaacagaaaaccaaacactgcatgttctcactgataaatcggagtcaaacaatgagaacatatgaggatagagaggggaacatcacacaccagggcctattggggggtgggagacaaggggagggatagcatttggagaaatacctaatgtagatgacaggttggagaaatacctaatgtagatgaccacggcacatgtatatctgtgtaacaaacctgcacattctgcacatgtatcccagaacttaaagtataataaaaaaagtaaaatataatttcaaagtgtttccattaaaaattttttattttttatgttttttttttttttgagacagagtcttgctctgttgccaggctgtagtgcagtggtgcaatctcggcttacgacaatttctgcctcccaggttcaagtgattctcctgcctcagccttctgagtacctgggactacaggtgcacaccaccacacctggctaattttttgtttttttttttgtattttagtagagacggggtttcaccatgttggccaggatgttttcgatctcctgaccttgtgatctgcccaccttggccttccaaagtgctgggattacaggtgtgagccaccacgcctggtcattgttaaatttttaaatgttgttttagagattaagttaaagttaccggtctactgtgttttaatgagggattactgtgtagattttatgtggactactttgtttccctccaatgtcgaataaatgaagcattcctccacttatgttttaagtgtccaggtgccaaaggctattactaatcagttattgaattgactaccttgcttattttgcattttatatcagggaatatctttctttttttctttttaaagagagagtctccctctgttgcccaggctggagtgcagtggcacagtcatggctcgtgacagccttgacctcccatacccaagcaatcctcccacctaagcctactgagtagctaggaccaatggcaaatgccaccatgcctggctaattatttttattttttgtagagatggggccttcctatgttgcccaggctggtctccacctccagagctcaagtgatcctcccacttcagcctctgaaagtgctaggattataggcatgagccaccatgcacagcctagggaacatcttatatatttcttaggatcctattttatgatgctcttttctgagaggaaaacaggattttaagctattttctataacattggctagtttaactctactgattacatgtttaaagtattatttcaacatgtaatcaatggtaaaccaatgtaaaaatcagttgagaaacaaggtatttgacgtattttagaggtattacgttttggaaatttggtgtgtattttacacttagggcacatctcaatttggatgttaatttttcatcagaaatagttgatgtgtatttaatattcataattttacagcaaaaagttgattcacctacctgagttgtttcaaacatacttaaattttgtagtaatggaactgggtgccagtttttaaatctacatcaatataaaatagtttgaagtcaggtagcgtgatgcctccagctttgttcttttggcttaggattgacttggcaatgcgggctctttttcgtttccatatgaactttaaaatagttttttccagttctgtgaagaaagacattggtagcttgatggggaagtcattggtagcttgatggggatggccattttcacgatattgattcttcctacccatgagcatggaatgttcttccatttgtttgtatcctcttttatttcattgagtagtggtttgtagttctcctcgaagaggtccttcacatccttttgtaagttggattcctaggtattttattctctttgaagcatgtggcactattcacaatagcaaagacttggaaccaacccagatgtccaacaatgatagactggattaagaaaatgtggcacatatacatcatggaataccatgcagccataaaaaatgatgagttcatgtccttggtagggacatggatgaagctggaaaccatcattctcagtaaactgtcgcaaggacaaaaaaccaaacactgcatgttctcactcatacgtgggaattgaacaatgagaacacatggacacaggaaggggaagatcacacaccggggactgttgtggggtggggggaggcgggagggatagcattaggaattatacctaatgctaaatgacaagttaatgggtgcagcacaccaacatggcccatgtatacatatgtaacaaacctgcatgttgtgcacatgtaccctaaaacttaaagtataataataataataaaaaatatataaaaaatacaattaaacatccagttttgtggcctccctagccaggtttccagggctcagtagccccatgtgaactgcattgaatgacacaggtatagcaagtagtctgaaggctcttgctgttaacagctttgtaatcattacattgggtaaatctacatccatttattgagttaggtggttataatattttatttttcaataaacccttttagtagcaataaactaaaaaagtgtatgttttatgaaaagtactaaatgtctcttaagaaattaaacatgtaatagactggattaagaaaatgtggcacatatacaccatggaatactatgcagccataaaaaatgatgagttcatgtcctttgtagggacatggatgaaattggaaaccatcattctcaggaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatacacctaatgctagatgacacgttagtgggtgcagcgcaccagcatggcacatgtatacatatgtaactaacctgcacaatgtgcacatgtaccctaaaacttagagtataataaaaaaaaaaaaaaaaaaaaaacttaaacataatagtcactaattattaatcagttgccaagaattgttttatacaactaccagtaaaatcaccaatttgtcagccagtaaacacatgtaagtaattattttggcttgtttttacctctcaaatatgactcaggcataagtgaattagaatgaatgatttagttgtataaaatttagttatcctgggattaagatgaaataaataatttagtaacatactctgttgctatatatatatatatatatatatatatatatatatatatatgcaattgttctttctcctttatattttaaagggtaggctatttgcttaaatgatgggtagaatatataaatatatggtgaaacagactgttcaattgagttttgtcatgaattttcaaagaagtttcattaattaaattttgtaaatatgacatgatcatttacatagagaaaacaatgttagcagtaatgaagaaactcatcactggctctttggcattttgcctaactctgatcagaatttttgatttctatcatttgccattcttccacaatgatcacatgaataaatcagttttcagatttcccagagctcttgccctcactgttagagtccacaagattccatctagggtcttcttcatgttcttatctgtatgcttttcctgaggtctccttcatggccatgatattcattctttcaagaattcagtaactttttgttgtagagactatgctgcacctggtcaccttgaagaagagaaagacatggcccctatttcaggaaattaaaagtctaaagaggatgatacacaatatgtatgctaatgcaacccagggtgacgtattgatagttgaagacacatataagggggccgcctgagtctgaaaggggttggaattgtcatgaaagcctctggaacaaatggcccctccctgtctctaatttggagtgggcaagtctcataaactctgtgtctcatattcttctttaaaatactaatttaaagggtgcctatctcatggagctattataagatttaaaatattaaaaatatgtggccaagcaatgtggctcactcctgtaatcctagcctgtagtccagtgctttggaggcttaggtgggaggatcgcttgaggccaagagtttgaagttacagtgaggtatgattgcaccactgcccactgcattccagcctgggtgacaaagtgaaaataacaagaacaacaacaacaacaaatatatatgttttttatatatatatatatatatatgtaaaatatataattttcttataacagttcttggcatattataagaattagtattgtttcttataactgccatggtttattctaaaattagacttctcagttgagctcgaattgatgtatcacataaacaacacacatacatttaactgttacaggtccttccctctttattttacttccacatgatttttcaaatccagattctctttcttactccccaccctgtgttaaaaatgctgttattattcacctccattctttgttctcttccatgtgagtatgtgttttattataccagttattggattgcattattatcatagtttgcttttctcctttatacgaagccaataataaaagtttcagcagggcaaagaccatgtttatcttgtttcccactttattcctcaggactggaatggtgcttgacacatttaaacacagatttgttgaatgaataaataaatgaatacatttatgctaattctcccaaattagaatatagatcttataatcctcttccttaagcaagtacctcagaacctgctagagaatagactgtcaaagtttgtccagatgagtagaaatgaagcccattatctctatgaagtaatactttttgaatagtttagatccttttatacccagatatagaaaatggtgtttcacttcattcacgaaataacaatggcatccaggtttattatagctcttcgttccatataatttctttgggaaagtgggaaataatccaccaaggaggaaagttcagcaggaaattaggaagtgtgatacatgaaaggtgttcagtgatcaaatgcacttggaaaaccccaaattaaatcaaattcagcacatttctttagaatcaaaattcttggaatctaattagctaatatacattttgaatctccaagtaagtgctatataataatacttcatttttcaaatgtattagaccttgaaacacttcaaatgcacatagaagagattttttttttttttttttaatgagtctgaacatggcttatggggttttgaaggatctggctctagtctcatcttgacatcctttttctcttgcttactacgctctagccactccagtgcttttcatgcactggggctgttgtgcatgcttttatctttgcctggagtagttccctggtatccatctcctgtttattttctggtcctcagtgtaaaagccccttctccttatcttcgctggtctaaaatcagttcctcaggaacgcttgctcaaggcttcctctttttatcctttacttacttataatctgtagttaaaagttgcaattgtatttgtgttttatattctgaaatacaacttacctatttttcttttgattttacctttaggagctatttcattgcataagtgtacatatgtaaattctgtgctataaacattgttaatggtcgttttacttttgttttgtaaagaatatcctgtttgaaccttatgtccttgaaagaaaatgaagatttttactactaccttaaccaatacagatatagtgataatagcttgagctagtgagtggatgaaattagaatagatgtgctttggcattcaggctctgctgtttccgagcatgagctgctccttactgagcagtgccggcattgttttgttgtttactttattgaaatcttaccgcccctaaactagcatcaacatgtagtactatttatttacaacatacaagttaaggaaatgaagtctctttatggttatttcctctagcagaagataatagcacaacctgcttcagtatttacgctttttaaaataaaacacaatttcaccttttcctcatcagcccatcagaagtttctctggctgcctttcttcctctccttctctttctttctcattacctttccttttctccccgtactccaatagatatcagctgtacatttggtgattaagctttgtgatatttgaaagaagatagccaaaaaccagaaataaaagtcaagggctaggcatggtgactgtcctgtaatctcagcactttgggaggctgaggtggcagaatcacttaagcactggagtttaagaccaccctaggtaacatagcgaaaccctttctctacaacaaaattaaaatgaaattacctgggcatagtggtgcatgcctgcagtctttgatacttgggaggtgaggtgggaggattgcttgagcccaagagtccgaggctgcagtgagctatgatcatgctgctgcactccagcctgggcaacagagtgagacacagtctaaaaaaaaaacagtccaggattttattttttattggtacttatcagttttaggaaagatgtaagggaatagttgtctctatgttctttctaaaagtcttaatttacagactccaggtgcctccagtgactgaagtgtaaaatattaaaagatcatagccaatgcaaaaataggaatgtcagaatcaaatatcctgagaagaagctatcagtagtgtctagagtcttagatagtattctcttaactgataaagacctgaaaatatcttctatcaaggcaggagtgaagcattctattcttggtttctgtgtttttcttccccacaccacacatccctccttctccctccccctccccctccccctccctcataacataaaagcaggcaggattctgaggcagggaaggatttgagtctatgtcaggaaaagtgtagccgtggttttattttaggaccctactcttttgtcttccctgtggttggctcttttccctgctatgctgattattttagcaggtagaaaaaagtggctgctgctagaaagtttccttaagaaatgtgaatattttaggctatttgagcataaacgtagctaattcagacacactgggaacaaaccagaaggagacttggttcttttccattctttctgcagggtacattaacatcccatagaaagtagagatatgcttcttgtattgtgtgtgtttttaagttatgttaccttatagatatgaactggctcaaataaatatctactaggttattttcttatttatttacatgttatgtgtgtgtgtatgcatgtgtgtgtatcacatctaaagtccaaaagtttataccggttgatcatatattatttaatattttggttttcagaaattcataatctcaacacacctaaaatttatagacaatagggcaagaatacacatttctagactgtgcaagtgggaagtttactttaaaaatagatatgaaatactgtttctgtattaaatatatgaatattacatgttaggagcaggaggctttatgaacaaatgttgatgcctaagtaatatgcttgtgagaatcctggtatggttaggctttgtgtcctcacccagatctcatcttgaatgtaatctccataatccccataatctccacgtgtcaaaggagagatcaggtggaggtaattgaatcatgggggcatttcccccatgttttctcatgatagtgagtgagttctcacaagatctgatggttttataaggggcttgtcctccttcgctcgggacttctctttcctgccaccttgtgaagaaggtgccttgcttcctctttgccttctgccatgattgtaagtttcctgaggcctccccagctatgtggaactgtgagtcagttaagcctttttcctttataaattacctagccttgggcagttctttatagcagtatgaaaatggactaatacagatcctatattaaaaataagtctgggtcaggcacagtggctcatgcttgtaattttcgtactttgggaggccaagacaggaagaatgcttgaggtcaggagttcaagagcagcctgggcaacatagtgagacccccatctttatttaaaaaatgaaaataaaaatagccaggcatgatggctctcacctgaagtcccagctactcaggaggctgaggcaggaagactgcctgagcccaggcaacctggaggctgcagtgaggccaggaggtttcagtgagccatggtcatgccactgtactccagccttggtgacagagtgaaacgctgtctcagataataataataatgtctggcacaccatatatgctaaattaactaatttaacaaaagtttgagtacctactggatacccaaccttcctgaaccctgggaatgaagcagtgaagaaaacagataagacaccaaccctcacagccctatactttggtgaggaagaccaacaatacaaagtacatttctaggtagcaacaagtactatgaagaaaaaggcaaccagctagaaagattcagtgttatgttgtaaagtggctgtctattagtgtgtggtcaagataagcgttctgaaaaggtgatatttaagcagagacctgaatgaagtgacgtgcaatatcatattctgagaataagcaaacagtgaggagaaaagcaattgtgaagtccctgcaggggcagtggggttggtgtgtttaaaggaaggccagggagatgtagattggtaagtgagggagaatttcaggagactccagagagtttggcagttgtcagatcatataaaaccttgtaggcccttgtaaggagattcagttttcttctgttttattcagtttattctgtgtttgatggggagctgttttaacagcttttaaaaggtttggatcagggaaatggtatgacattactgaaaagatcattttttctgttctagaaggaagagagatgttgagcagatgtagaactggtgggcagatttaagatatttgtattgcaatagtccagtgagaagctgtcttagatcagtgcagtagcatcaggggctttaataattaattaaattaaatatggagtgcatgttgaaggtataactgatttaaaaaaagaacttgctgagtgattggttgtatatgaggggaagaaagaagttaactccgacgtttttgaccaagaggtaaaaaggcctctgaaaatgggacttctgtcataaggtacactgtagccattcacaaatccatggggaactgggaggagaaggacttgggggaaaatcaagaggttagttttggatatcacaagtgcgagatgcatgtttgctatgtaagtggaaatattgagtaggcacttaaaaatgtaagcctggaatttagtggggaggttcggactggcaatttgagtcagaaatcatctgtttgtaaagggcattcaaagcagtgagcttgtatcagatcatctgaagagtgtgtgtgaagaaagatgtggttgagctactgagctccaagttactctaacataaagaggtcaggaagaaaaacagaagctggaagctaagaagataaagaaggatatgcaggtgaaatgggaggacctatttaaataagcatgttttagaaggagttagtgctcaaaatgccagctgcatttgcagagtttaatttagatgaggattgagaattggccattgatttagcatggtggtcatttatttggactaaaaatggttttgttggaatgattggtctgaaattctgattcatatgggttaagaagaaaatggaaagtgagaaagtgaaggcagcaagtgtagaaaacttttatgtatagagagaggatatttacaaagtagtagaaaagtgggtttggtagctggaatggaggtcaaaagtcaaaaagtttcttttaaggtaggtgatagttcagctgatgggatttagctgatagggttcttagaaaaatgcaggggcaatttatctgatgtaataaaaaagtaggtgaagtatattggttttttgcagggaaagaggtagatttgattgggtgttgatgctttttaattgcttccattttctcatttaaataaaaggcaagaccatccagtgaaagtgaatgagggagaggtattggaaattccaggtgagaggaaatatggtattgtccactgcaagagtgggagagtagttcactaaggaaatgtgataggattccttagggatcaaattcaactaaggtggagttttgttaggactaggagagtgatgtaaaggaatgattcgggtaatagaccgtgagaattctaatttggataagtgtggacaggacagccgaagaaggatagtaggtacaaaagatgtggttaggagtaattttctgttggggggtgaagaattgttggatgagggtactgaatattttggcttgtggaacagccttataaggagaccaaagcatgctgtgacttcccttaagtcacaacgagggctctttgaaagccaggaggagggcagtctcttaggatcccctcaaaaatgtttgaatgacaatggtgtttctccatttcccttacattttcatatacttaacttttccaaaatgatagcaacaataaaaagattcacaattttctaggtcgaatctattaaattatagcattaaataataagccacagcaggaggtataattataaggtaaccttgagagacagttgattcgaatacactcaatccatcaccaaatgtattctccaaagtgcagagtaagctttctaaaatgcaaatttgacatgtgactcacaaatggaaaacattcagtggtgtcttttctgttgcttataacagagtaactgaaactgggtaatttataaagacaaggaatttatttcttacagtgatagagactgagaactccaaggtcaggggcccgcctccgtgaggtccttcttgctgagagcgtctccctgcagagttcctaggtattgctgtcctctcgtatactgagtctctgtgactttacacatgacatttcctttcatttggaatgcacttcctcctctgctttatggactatcttatattttaagaccacatatctttcttaccttataagaaactttcatagaagatctcctgtcctcatcctcattcctgcctggttgacattcttcccgccacctcactgcaactcaatcaggacgttccttttttatttaaatactgtttaagtataatctacttaaacaaatctaatattgtataaattacacttcccaaaataaaaaccctccccattttactctttttaccggaccacgtcatttcagcgacttgccttttgactttatttccatagcatatgcttgtgctcaaataaatgctcgttaactattagaatactttctaaaataaaagtatatatactaagtgctctttaaatttcatatattaaaacaagatggtctgccattaattttggcttttgttattaaaaattatttccatgtcttgggaggccgaggcgggcggattacgaggtcaggagttcaagactagtctggccaacagagtgaaaccccatctctactaaaaatacaaaaaaatggccgggcgtggtggcaggcccctgtaatcccagctactcaggaggttgaggcaggagaatcacttgaacccgggaggtggagggtgcagtgggcagagatcgtgccactgcactctagcctagatgacagtgcgagactccatctcaaaaaaaaaaaaaaattatttccatgtcaaaaataatttgaccttctcatgctgtcatatatgacagccttttaaattgctgttttatgtcattgatttaatttagtttcctgaggaatttatgaaagcaatatttttaaataaaaattatgatttatttttaaataaattaatttgcaaagtatatttttttaaatatggagatattttagctcataaatgtatatgttttttaatggtgatgacattttaatgctacgttttttaacttgctatgaaaaggttttactctaagagatctacaaaaaaaggtaaaaagaaaaacttcattttaaatgtaaaatggtattttgtttcctcacattaaaatgcattttaaaatgtcaaaataaatgtgaaaagccaaaattaaatctcttggtcatatttttgaaaagtgataattctattttaattaagtccctaaagaatttttaaatgtgagtgtctccaacctagaggataattttaaaacaattatgtatataattatttgctttataattttcttccatcccacatagtcataattttgagcctttattttaatgagcccccatgaaatgatgtgttaagtgttaataatttccaacctcccattttattttctcttgattaatggaatcaataaacaatttatattaaaatgcaaatgtggacatatacactcaaatgaaataaataatctaattgtcagttttaaaaaattagcatgataatctatagttgtacccttaatatatgtgaaatatgtttctttttattctaatttcaacatggatagatatagcagaagaccataaaaccattttgttccatctaagtgagaaaatggtagattatcttaacatatatgtatgtgtagatatatttacaagataaatttggatcaagttcataaagacttggataatatgaaggacaattttttttatagaatgaatactacatgcatagtttagccatggtgctgaggggtctgcagaatatcgttgttattcttctttttatagggcagagacaaatgctaaatatatcaatattattgatgattttaccagagataccgttttaaaaataagtgaatgaaaattacatgttccttgcaatagatgacaaaattatagtaattttctgcatgtttgcattattttgatataatttaaagagtcatttttttaaaaagaatctcatatataagttcaaagatttccaaaagtatattaggtacagtgtttcttttctgggtgtgtagcagttttccaggctgagaaaatgactgatgagtagatttatgaagagcaaatatcactaaaggaacatcaataactttagctgtagtcttaatttttcaagtaagtatgcaagtaactaagtaatgcttctttttcaaggatttactctacatgtgtaaaatgagagttggcctaaattcatttctaacctcttaatacaaagggagattcaggataggatatgcatcctcaatgaaatttctgaaccgtgagagaaaagtgaagcaaaatgccaaggtgaaacggcatgtgaggaaacagttcctgatttagaatgtcaaaggcgaaagaaacttctcactgctattcaaagtttattcctctttgtcctgcctaaaaattaacacgaaaatgatccttttcagtgggatcatgtagaatcatggagtgtggagttgagttttctgaggtcaactagggatcacttctctacagttttttcatggtgtctaattttctgcaagctttctggaaaacaatttgtgagtacttacgttaataagtcctagagaatgatcattgaattattaaatataaggtaatctattctaaggctgtaggccaactataagttaaaaatgctttgtgcattaagatatttcttacaagtttattaattagaaaacagtgaagatattcttctagaatgatgatcaaattaagacattctcagatgaacgaaaactaagataatttgttgccagcagacttatcctagaatggttaatggacattctatgaaatggagaagaaaaaatggaaagagtaaaagtacggctaaatacaataaagtttccttctctttaatttttaacttatgtcactgtgcagacatcaaaataacagtaaaaggatactaggaataactctacatacatacatttggtaatttagatgaaatggatctatttctaaaaaaacgctaccacaacttaccaaatctgaaatactataattaccctgtaactattaataaaatttaatttgtaacttaaaagcatgtaacataggaaaacctacatgtacatgtgttttcaatgggcaattttctgaaacatttgaagaagaattcacactaatctagtatagattcttccagaaaagagaaaaagaaggaacactacccaattcattttatgaagccagtattgccctaatattagaaccagataaagatagtaataagaagataactacgggtcaatattcctcgtgaattaggagcaaaattcttaacaagatattagcaaatacaattcagcaatatataaaaagaattatacaccataaccaagtagggtttattctagaaatattaagcttgttttgtatttaaaatcccaacacaacacagtaacaagctaaagaagaaaaaaattatattagttgatgaagaaaaagtattttgccaaattaaacacccatttgaaataaaatggctcagagtaataggaacagaggggaactgtcaagtcttaataaagaagatctgttaaaaactgaaatgtgacaatatacttagtggctaacgtctaaattctttctttctaactttgggaacaagacaaagaagtccactatcaccattcttatttaacacagtgctgggaattctggctaatgaaataaagccaaaaataaataaaaagaaaagaaaataagacatagagatcagaatggataaataaaactttcctttctctttgtggttgacatgattgtatatatagaatatagaaaataccaaggaatctaaacaaacccctccagaatttaataaatgagatgagcaaggttgcagttgtatttctatatactagtaatgaacaggtggttattaaaattaaaaaatatactatttataaacacttattctctccctccttctctctttcccttcctacatcccttccttgaagttgtttctctcttaaaagaagtagtaagatgtaaatccaataaaatatatacaggaatgtataatgaaaactataaaacactgatgaaaaaagaaaatttaaataaatggagatgcatactgtgttcacagattggacaactcaaagtagtaaagatgtcatttttctccaaatcaaaagctgtttaagacaattcctatcaaattcttggaagacatttttacagatgtagacatagagattatttcaaaattatatggtaagacaaacattagaacacttaaaacaatcttgtaaaagtggaataaagtgggagcaatcagtctccccaatttttactcttatatagttatagtaatcaagactgtgtggtatcagtggagggatagacatattgatggaacagaatagacaacccagaaatagacctacgcaaatatgcacgactaatttttgacaaaagcacaaaagcattgcagtggaggaatgatagacttttcaacaaatgatacgagagctgttggacatccatagaaataaacttcaacctaaattttctaccttatgcaaaagtttactaaaatagattatagattaacacgtaaaatgtgaaaatgttagaaaaataaaactggagaaaatcttcagctgtaggattagtcaaagagttcttagacttgacatgagaatactgtcaatacaaggaaaaattgataaattggactacttcaagattgtgatataaagttcttgttaagatgatgaaatgacaagctagaaactcagagaaaatgtttgcaaagcatatacccaaagaggtctcaaatccacaatacataaatgtgtcaaaacgctacaattaaaataatcataaaatggcaagaaaacagaatatatagatggccaataagcagatgaaaatatattcaacatcattagggaaatggatactaaaactacaatgagatatcactacatatctatcagactgctaaaattaaaatagtaactacaccaaatgctggtgaggattcaagaagactggatcattcctggtgtgcatgtaaaatactataatcactgcaaaacaatgtagtagtttcttgtaaaactaaatatgcagttgtcatacatgccagcaagcagttgcactcctgcatatgtattccagataaattaaaactgttttcacacagaaacatacacttaaatgttcattgtaactttattcatcatagccagtacctgagaacaacccacttgttcttcagtatattaaacagagtgtagtacatccatatcatggagtactactcagcaataaaaatgagtaatctgttaatacacacaacttgaatgaatctccagaggattatgtggagtagcaaaagctcgtccccaaagggacatattccattttgtttaatcccatttatattatcattcttgtagtgacaaagaaatggagaagaaattagtgttttccagggctgagggtggtggtgagaaaacaggagtgctctggatgcaactatgaaagaacaagaggattccttctagtgacacaattgttctgtatcttggctgtattgatgccaatatcctggctgtgatattgtaccacagttttccagatgttatttggggaaaatgggtaaagtgaacacagtacccctctgtatcatttctcataactgcatataaatctacagctttctcaagataaaaagtttaagaattttggttttgcatacaaattctaaagcagctggaagaaaatatacccacgattaataattatttaagtattccctcttgacggcatttggcagtagtcttcattttcaaaaacctattgacatagctaatacattttcaaatagattctttatttttaaaacaatacaaaacttttttttttttttgagaaaaaagtctcattctgtaacctatgctggagtacagctcactgtagccttgagctcctgggccctgggctcagacgattctcccacctcagcctcccaagtagctggaaccacaggcacatgccaccacacctagctaattttccttatttatttattgagatggaatgtcactctgtctcccaggctggggtgcaatggcatgatctcttggctcactgcaacctccgcctcctgggttcaagcgattctcctgcctcagcctcctgagtagctgggattacaggcacgtgccaccatgcccagctaattttttgtatctttagtagagaagggttttcaccatgttggccaggctggtctggatcttttgaccttgtgatctgcccacctcagcctcccaaagtgctgggattataggcatgagtcaccgtgctgattttccttattttttttgtagaaaagaagtctcaaattcctgggctcaagcaatactccccaccccagcccccgccttggcctcccacagagttgggattgcaggcatgagccaccatgtctggcctcaaatagattcttaaaaagcaacttgtattttaatttagtcaaatcagggacatctgctgcttatgcagtcacttagaacatcaatgccaattaagaacattttgattgagaactaatcttcaatttcgcagttcagaaattatggtagggttttttccccccctagattagattgagatataggggacacacaccaaatttatagagaaagatattttaaaaattgttgacctagtaatattagatgagatagatgctttaaaagtaattgtgaagcaagagtggtggtgtgcacctgtagtcccaactacttgggaggctgaggcaggaggatcacttgaccccaggagtttcaggctgcagtgagccatgattacaccactggacaacagagccagacctgactctaaaaaaacaaaaaaaagtaactcagattttggggttcactaagcaacttacctttgtttcagagtttatgaatgctatcagtagttttaagggtttttttttttttttggtgtgtgtgtgtgaacacgtttagttttattgtaacaaagcttgtacactttcaatgtttaaaactgagcatcatctttcctttccagtgaaacaaagagaaaatttaaaaataaacaagaacataattacaatagagaatgttaataccaagtaagaccctacaggttctgctgattctcccactgagtggcagggcccaagccatcattaggggaggatttattttgaaagtgtcatcttaaactgcaaggatgtctgtcagatatcacaattaaacatgccaaaggagaaatcatattgtcaaaatgcccacttaacccactgaaacgtctcaaactcaccccttgctgaccttctataaccccattgtttaagttttttttttctttttttaaacaagagaaaatagacagatacatgttggtatatgctaactgtccatattcacatagagacacagtgtgctctctgatcccaatatacagagaaaggaggaaaaaactagaattgtatgcactactacacagggacttagcaccctccagattccagtagcgtgaagggagcaggttttttcttttttcccacagagcttgggggtgttgattccatatagttcagacaggaagggataaaaatgaattttgaacagaaaggggtagagactcttttcctgttctattctgctcaaggtattttctccaaaataagttgagaatcatggtgtagagaaaagagacctcaagaacagggtgactgaggacaagattaaaaaaaaaaaaaaagactgcagcttgctcccaaggactggagaacattttaaaaaaggaaggtcggaatccatcagtgttctattagtcatcttctccttcatcctcctctctttcctccccttcatcatcttcatcttcttcaccttcatccttatcccctacttcatcagtatcttctaatccttcctcctttgcgtcatcatcgtcatcatcatcatcatctttttctccttttccttcttcatcatccatatcaggaaccaagtagtactgtaatggttttggccaaatattgtctttgatgaactctcctaactcatccacacctgcatcagaatagtcagcaaatcaggtaaagaagctctctggaccacctcctgctgtgggacccaaggagacatctgctcctgcaggcttgcctaaaaagggacaagaagaacagtaagaagcaattgaacacagtgatgaagtacaaaatgaaatagacttaatgtgaggagattttgaaagtcgaatagaaatgtaacaaactccgccaaccactttttcagaagaggtcagaactgatcgccaacatcccaaatttgggggtaacaacatttctcaaccatccaccagtgttcgcactgcttggggagaaggacgaagatgcactgcattatttgaccagagttgaagtgacagaatttgaagatattaaatcaggttacaggatagatttttattttgatgaaaatccttactttgaaaataaaattattcccaaagaatttcatcctaatgagcgtggtgatccatcttcaaagtccaccgaaatcaaatggaaatctggaatggatttgacgaaacattaaagtcaaacgcagaataaagccagcaggaagaggcaacatgaggaaccagagagcttctttaagtttttttttttttttttttttttaaaggagcgtggatttaacactgtaaaagtggcatgattttagtagatacgtaatcttgataaagaaaatgtcttatgaaccattcctgcctaaaaagttctaatattcctataatttgaaagtttgcgctcttaaactagtgtttgtttcttcccaccactgctaagttagtactgattaatgcatattagtaagattagtaataatgtttgcttttactaggcatgatgtcaaaaatgcttttttccaatatgatttctcttgaggtttttcttgtgtttcttcagtatatcctgtttttcataattcaaaaacttgtcacgttgcttgtgtttggatattccctgactcttcatcaaaaaagcatttgcaaactatgtcttagttatatttatttcttctactaactaatgctattcattatatgcttgtattttactttgacatgccctctttatcagcttgagagctgtccaattatagacaattctcatcctaaaaaattcagactctagacttggaaaggacctcaatattatagtttaatctttagtcttttctttagcatccctaattcacctttcccttgaaggtcttcagaagatgaaactgatcttgtaagatagctcatttcgtatttggacgggtctctccattagaaaattcttttttatattgagtttagaatctgtctaccaatttgtaacccatggaagctcacaaagccgatccaatcacttttctacatcgtgtgcctttgaatattataccctgggctgcttctatttccagagcttgtatttccattttcccccaattgtttttcctattgcattacttggttttgaattcttatttattaacaaacctgaatttgtctatatccctcttaaatgtagaatactgaactgaatgtactataccagatgagttctgacttttcatattatattttagtcagaaatttcttagccattgcccagtacaggaatgcatccgccacatccttgtttgctattttatacttgaaaagtgcaattgtgtcaaaatattttcagtgtattaagatttggtgctgttctgtcttctagactcctataaataatttgtatacaaggtagcaggggaaaaaaaatcactctttagtgacaattttttttttctaacctgacttaatctccattgagagtactataaagattactttttttttttaaagccccagtatatgtctggcaaaatcttaaaatcaatcatttaatttaaattggatttcaaaagaaggtcgctagatgaaatcccttgctgtagttagtgaatgaaggtttatgttaaaggagggaaagccaaccacttttatgtttttaacgggctaaattgggaacttgtcagtgctcacaatccagttcttcaaaattataaaactaaacttgaaagcaccctggtcacctctgacccactgtggaacacggtgccccccattgaagaggaaaggggtgcagttcttttcaagtagagccacctgcagtcacaggtgttctccgcaagccttggcgcttcagagagctatggtatttttgcttctgccagccattgtgatgacagtacctctgaagttcctgggccatattcaaaccttgtctctcaaaagccacattagaaatatatatgccacccccaatttctcaaaaatggtgttctttttcctgttttaataagataatcaaccttcaaataggtcttttcttatgaagtgtttatggattatgagaaacaaatgtagaccttttgtttatgaacatggacaaaattttattcacaagaacatatttatcttcaactacttagtactctttcaactttaaaagagatacttttcagtttattttaaaactattgccaaagactagcaagtgtctgtaaaaggatttttaaaatacttcactgattaacatgctgtatcaaaggtcaaggggttgtatccttggatgatgatagggagagttgctgacttagtactgctattgctctagggtaaaactcaaaatttgaaccagtgggccagacatgtagcatcatgtagcatcataatagttggaaaagtaagataatttggagaagactttatacttcagagcaatactaatttttgtgtaatccattattttcttgacactttcacatgtttctgtgcctattgcattatttcctcacatttgtatctttattgattttaaatacctttttactcttttttcctcatttatccctcttgtaactggctgtgaataaatttcaatcacgtttttatgttagtaacaagtctgagtgccaaatttgagctctacgagactctattgtgagcaatttatatgtttacaatctctaacgtctgcactaaaatgttctaatactgcaattctttccaaagtaggtttgaccattagcaaccaacaatattaacagtgaaacactttgtaaaggtataaatcaaaagagaaaatttgtgaataagtgggctctagaaaaggcaattgccataaagtccatgagctgcttgtgacaacatccaaagctttattaacttcactaatatatcaataacaagcaaaataacaaaagaaagcaaaaaagcaaaaacaaacaaaaaccaaaaaaaaacccccaaaatcctagggagcaaacattagaaaataagattttagaagtacagaaatatattacctgtaatcattggtatattttccgtgtctgagagtaaaatctgactttaaagttttttttggctttgagctgtgtttttgagggtgaagagacagacagatgtagaccaatgttccagtccttcatttgtttgcccaggtgattttggaaaatcacttaatatctgtttcagtttcctcattagtaattagaggataataactccttgaaggggttgaggatatgtcatcccaaaattggccacgtaggcatattactggttttgagttttcagtaaaaggcacttgaaaaacaggcacaagaaggacactttcattccccttttttcttcctgaaagcagatgtaactcctaagagctgccctccttatgccaggaggaaagaaatgttcttatcaccagaggtgggactagaggattctgtacaaacagaccttgttaaaaataactctactcttcctttagtgtctccattcgttttagttacttttccatatttgtgattcttcgttcaacccagcctataagcattcaggttttgctacttctttgagtcaacgtttccttatgaaggctcttatattacataaatttgtatgcttttctcctgttaatccgtcttatgtcaatctaactctcagactcagctggataccctaaacaggtaaaagtaaagattttgactaccctctaccctaccaaaagtgtagtgagaaaattaaatatgattatatggataaagcactggacacattatggattcccaataaaggatagttttctcttttttatcccagcatgcagactgccagcagccaaaggggagaggaaatcatcttaaggagttaacagatatatcataactgacagttattatctcatgtatgtattgtttgggggtcattgaataatgttgtgggaagtgttcacaatgacagttctacatgtcagtgaaatagcaaatatcacaaacgtattccgtgacctttagtgaaggttgaaagaggttttgaaaatgtaatttaggagggcttttctgaaaaggagaaagatagtgttgcacaaataagcggctttcctaaatgcctgatttaatcaagtaataacattcagaatttatatttcttaaataaaatacttctcaagaagggttttcaatggaagaagcaccgtggatttaactagatggtgcctcccctttctttccttgtgcaaagtactgacatatggcatagctcataagcagagatgacaggggaggaggtggtagggttgaggttacaaattccttcttattggaaatcagtggtttagcataggaaagttgaacactgacccagaaaacccttgatagttatatgaatagtgacatgctgacaaagagaacatcagtttcagtgagtatccagtttagtgactttcaacaacatgaattttggtaaaagtggatttagtcctaaggacttgtggggttaatacacagttaatcttagatgaacaggagcataacatttcttgtgtaaatctggctcttcttatctgtgatcttcatttatctatactttttatgctgtcctacgataaaatttagaaaataataacaaatacaaaaaagtaataaatgataaaaattctaacataaaagttgaattaaaataaaacttaagtgttgggaaattcaattagaaaagagttaagaaaaaagaattaaattgttaccaattgcataatggatgacattttagacttgactaaggtcaaataaaacgatttttaaactgggaaacattttgacaaaattacataaataaggtaatattatgcaaaagaaattaaagataaaatacacaaatttcaaataattaaaataatatgacaagacgaatagttagcagaattaattgccatatttatttatttattttttgtttttgtttttatttgtttttgagatggaatcttgctctgtcgccaggctggagtgcagtggctcaatcttggctcactgtaacctctgactcccgagttcaagtgattctcctgcctcagcctcccaagtagctgggattacaggtgtgcgccaccaagcccagctaatttttgtagttttagtagagatggggtttcaccatgtgggccaggatggtcctgatctcctgacctcatgatccacccaccttggcctcccaaagtgctgggattacaggtgtgagccaccactcctggcctgccatatttattttttaaataaactttatgaagaggtaaacaatagtttttcccccatttttagacagcaatgactatcagttctaaaaagaaacttttttgaataaaataacaaggcactgtgaattttaaatcattttgtgaggtctaaacaactttttcttttctgtgcatgattgaccaaaatgaagtgaataaaaccataaatggcaatatggtgtagcctgcagaacaatatgtgtcattcatttcttcagtttacaaatatttaccgtatggtttctaagcaccaggccagctgctaggctctgggaatacagcaacaactaaataaacgtgacatctgtacatctacagcatagatttattatattgaggaagattgataatcaatttaaaaatgctacataatagcacataacttaaagtaaataataataaaccacgaaatgatcatagtgtcacataaatgctaagcaaaacataaccaaaagtgatatggttggcagagtaactgggtgtccagagaagtcctctaagagatcatatttgcgtgaaatctaattgacatttggctagggtctgactcaagggaagagaattctaggcagagagtatagctggtaagaaatacctatgtctgaaatgagcttgtctgtgcttcaagaacagaaaaaagggcactatagctggtgcttagtgggcagtagttgaaatattagactggatcagattatactggacctgtaaccaggactgtggactggattttattccaagtgaaatcagactgtgttaaatagcgcagggtcttcctgcctgggcaggattttgacctgaacataaatcattattctcagtctggccatacactgtacatttgcaaatgggcatggactttgatgacaatgtatagcacctggtgcatggttttagcaattcctccgtgtcattatatatgaagaaaaaccctaaaagattccatggaactttaaaaagtatataacagttgaaagaaggctcatttttaaagcatagactgaattctctaaatttcatcagatatcttgatgttttggggagcatagacttttatttcctagagtgtgcatcactagcattgtaaacgcaaggtttcttctagtattttgttttgttttttataaacacatcagtttgccttttactccagaatatatttgtttttattttaccatagaatatctgtgtaaattgctggcaagaagcagatatatgtagtagttaacagctttgatcctgcaataagagacctgaattcattggccagctgtgtgggcatatgaatgttacatactaacagtggtaaaatgagaattttaattgcaggggtctgcaaaggatattgcttgtgggccaagtgtgagtgctgcctgtttttgtaaataatgttttattgaaatatagccatgcccattcctttacacatcgcctatgtcctctttctccctaccacaactgagttgagccatgcaacgctgagaccttacatggccacgaaatctaaaatgtttttttctagctctgtacaaaaaagtgtgccaatctctattattatgtgcacctttgagggttattgagggaattacatgaaataattcatgcaaagcactcagtacaaggcctgccatttatttagtaagcattcaatatatatttgtaagtattagaatttttacacattcattttttactgtcaaacaatcaggtcaaattgactgtcataaatatgcactgttatgtgcgtttccatgtatctttagaggtaaagcacccaagcttgagaagtatttgtttaagtagccatattttggtgacacttggccatttctgcattaataacatgcctggatgttggaacttctattttggccactagtttatccttaattcggatattataaattatatatatgtaaaagtttttggttatattagagcaatatgggtagattgttaaattaatcattgcagaaccctttgaaagtctaggcagcaatgtgcaaatgcaaaatttataactggagcaaacaaaaagaagctgatgattccttaaggatattgatgtttttttggtttcttccttttgttgtcatcaccagagatttatattacatttggggaaattttcaatatttaatcataagcatttttattccaatgtaggccatacattcaccaatatgagcttactctcactagaggctggccatatttttttttgatttaaaaaaaattgaggcatatgtttgcatgaatgcccatgtgtgttaaaacttctaataaacaatacggaaagatgatcagtgaagaatttaatgattttacttcttatggtgttaaacatgttatgaaaggtctctaaagagaaattgtaagctgtggggggaaaggaagaaaagaagaggaaaatctattatttgaacatttcagttaaataatttcttacttaagttttcctcatgaaaataccacttttgtaggtttccaaaaagtatcataatcattgcttatgtgcctttattttagtgaagtaaagagttttgttgttcttaatttccagttccatttccaacgactatgaaaacattatttaactttatatattacttttcaatttgtttatttttactgcttcagagttaatgttgtatttaaaagataaattaatcccagcaatttgggagaccgaggtgggcagattgcttcagtccaggagttcaagaccaggctaggaaacatgacaaaaccctgcctctacacaaaatacaaaaattagcctggcgtcgtggtgcactcctgtcatcccagctacttgggggctgaggtgagaggataacttgagcccaggaggtccaggatgtagtgagatgagatggtgccactgcatatcagcctgggcaagaaagtgagaccctttctcaaaaaaaaaaaaaaaaaaagaaagaaagaaaagaaaagttaatattttatgtgaatgtcttagctttctatgtacattattaatttagttcaggtcagtttgtttgaaactaatataaagaaaaggcacaagatacggttcttaacgtttagacaataatttatgattatgttgggaaaacaggacttacttgcatgaaccagtttgtctcttattgtctctcacatggcattcatataaaaaataagaagattttgtgaaccttgagctgggctatcaattgagattgtgggattcggtgctggttgaatttggttttataatatttttgagtgtggatgtcatttttttcaggccattactctatcattttctaaggcacatttaatgtcataaacttttgtgtctgtattctagtagaatatagtaaaatcattcaaattagtctgtatgctaaaactcagaaatgttagccttgaattaatttttcagtttaaatttaaatttataggctgggcatggtggctcatgcctgtaatcccagcactttgggaggccgaggtgggtggatcacttgaggtcagaagttcaataccagcctggccaacatggtgaaaccccatctctactaaaaatacaaaaaattagctgggcgtggtggtgggtgcctgtaatcccagctacttgggaggctgaggcaagagaattgcttgaacctgggaggcagaggttgcaggcaagattgcgccactgcactccagcctgggtgacagagagagactgtctcaaaataaaataaaataaatttaaatttataaaaatatataagatggagatcaaataatctggtaccctcttttcaaaaattatcacactgattttcagagagattatctgtttatatactgatttttcaaaattggctagaacataattttcttgacttctaattcagtgttatttcattatatattacaaatgcttaattttcattaagtgaagtatgacataactttctcatgaaattcatcaagtcagagtacctgatatctttatttttgcaaaatcgtatataaatatgtatatttaatgaattataagcaattcctaggattgcttgacaggcttttacatttgcttctgcaatcaagatttaagaaggaagagaggctaacaaagaggaaagggagagaggagaagaggttagaagaggaaaatggaaggaaagagaataagagaccatatggatagctagtttaggaatagaggagccatagggagtaaggaggaaaggaatgcattctccaggcagagagtaagcagagtctgggctgaagacgacaagaattggggcatgagtcagccaagaaaagatgagatttggtgcagaaggagtatcgagtgagaagtttctagatatgtgtgctgctggaaagactgtctcaaaagtattttctttgaatagaaaaattctggagaaatgtgattaaaacaagaaagaatagttaagcattatgtagggagtcagtcacacaaaattaacacataaagaaaaatgtcctcttcttatttcttcatcctctcttccttttatttctgaatgtttctgtccctctgaaacttgtatgttggaattctgatctctaaggtgatcatattaggaagtggggcctttgggagggctccacgctctgaatgggattagcgctcttagaaaagggaccccagagagctccctcacactctttctaccatgtgaagatacagtgagaagtgggcactttgcaactcgtaagaggaccctcatcagaatctgaccatgctggcaccctgattttggacttccatcctccagaactatgaggaataaatttttgttgtttataacctactctgtctatggcaatttgatataggagcttaaactaagacaaatggttaatttaatagatacctttccacaaaatctgattttgttgaccatgttgaatctatctttaaaggaagtcctatgttaacgactacactagtgaactgatagtatgtaataaaaatatattcctgctgtgcctgtcaaaagtggattgagggcttttcggaactaatgtaagatgatttccaataactttgaatgagtgttatattgtccaatttatcctgtgggtttcaactttcactctcactttctgagaagcttagcttcacttcctcagaatagattaactgtttctctctcaatacagtctcatactcccatatttattctttgtgttattaatcactattgtaattaaatgtgtttgtgttagtagttgtaaaatgtctgtttctcctgttagaccctaaactccacacaaagtgatactttgtatttgctgttcatagctgtgtccctagcacctggcattgtgcctggtacaaagcaggtagttaagaaatgcatattgaatgtacaaataggtaaataaaataaaactctaggaaaaataaatgctgaatttaaaaaagggattatttagctttgatgttagcttaaacatgcttatctttatgatttatttcagtatgagaaaatcacaactaatagaacacattgatatattacagccataaatgtaatttatatgtaatatttaaacaaatattcaaaatttgtttattatttaataggaactctcatggattggcagtataccaagcactgccatcacgttatacccattccatttaatccccattcaggagggtgcagaaattatcttccattttacgttgtggaaaactgaaacttagagaagattaatacagctagtatgaccacatattaaaattatagatatgtgggaattacagggttttaaaagatgttgtaccaggacaattgccaaaaacaagaaataatttttaatgtagtcatgctgaatgtggagtataaaattgcagttaagaggtgaggtttttagattcagaaggttgagctgcacctgtacctattacctgagtgatccaggacatggttttttaacttttctaagcctcagtttcccaaaccataaaatatcatttcacagccttattaaatgaggctgtgtaacaggtggagtctggaagctagtagacacttgatgactttgaattcctttttcttttctatataatatcacatttcccctttctattctgctccactccagtcagcccattgaaagctagctccttttgcttgtgggaatgtatccaaatataattagaaacatatatattatttagcaaagctagtgcaaattcaaataccattgatgagtgatgttcgaaatttaaatataatcaatagcagaccctatatattttccttgatttcccactcctagaacacacacacacgcatgcatgtgcacacacaccattcattttttgaagaactaggtgcctctatattttcacctttccctacctcaattgctgtacagctagtttttcccagttcatctcctctctaaaatgcttatccattttttggtctccaagtacattgttgcatctttaaaataacttctgtagtattatcctaaatatctgcatctttatatacattatagtagtgttttccttgaatattgtcctaaaatattgttctgaggtgatagtgaaggaaaatcctgttgtagtatatttaaagtcagtagtctgtaaaataattgtttcagactggaataaaaatcagttcccagatactttatgtttgtataagatctttattctaatttattttttatgctgattagagccaagcaccatggctcaggcctataatcccagcactttgggaggctgatactgtttagatgtatgtatctctgtaagttgcctcaagtcatcatttaaaataaaactggctaaatataagtaaataaatacatacacataattataaatttaagtgagataatgggaaattatcaaatcgaggggtgtattttttcaatcataaaattattataatagcttatttagtcatttatttatttatttatttatttgtttttgagacggagtctcactctgtcaccaggctggagtgcattggcacaatcgcggctcactgcaacctccacctcccaggttcaagcaattctcctgcctcagcctcccaagtagctgagactacaggcatgcaccaccatgcccagataaattttgtatatggggtttcacaatgttggccaggatgatcttgatctcttgacctcgtgatccacccgccttggcctcccaaagtgctgggattacaggcatgagccactgcacccagccaatcgcttatctaaatatgatagttaatctattagaaataaatcagaagggaaaaatgaaaaaggagtatatgaattgttaatgtttccaaacttttacctttaaaataagctctttaaagctgattaccaattatggtattaatatgacatttgtcatgatgtatattacctatgttcaagtcactgccacttgatttgaactagtcattagctttattttatagataaggtagaattttttaaacttgtttgaaaaacatgggtgtgtgtgtatatacctatgtctgtatatatgtacagtcatgtaccacatgacattttaacaagctaccacatataagatggtgatctcataagatgataatactgtgttttactgtaccttttctgtttagatatacaaatacttacccttgcattacaattgcctccagtattcagtacagtaacatgctatacaggtttgtagcctaggagcaatatgctgtataccatatagcctaggtgtgtagtagtaggctctcccatctaagtttacataggtgtgctctattagagtgggttattttttcttttacacttgtctttttccatcctatccgactaatagccttcacttttgttctcactgctgtccactgtcaattcctacacacacacacacgcacacaagcacacacacacactttatgtacatacactcacagtcacagacacttcaggtttgccttttgtgaatcttacgtggcagataaccaatttttaagaatgcaggttaaattagagaagaacatgacttggaaatttctcaagtattttattttttagtaaaagtctaattggaatcatttagccttaaaagcaccatatcatccttttctacttatttcctagagaatacctgattggaattacatataatacaaatagagttaattttaataaagtatttaatatgctaagtacaatttaggccttatgggaagaaaatgctttattttgttaatggatatagataactggagctcagtggatataatctgattaaacaatatattaatttacataaaataaagttgcacagaataaaatccagaaaattatgtgatattgaaaagaaaacttcaaaaccataatttataattacctacattctgaaatttctattattacaaatttttagtagttgaatgaacaatttatctcactagttttgtgctactcattatttaacagtatttgaaattaatatatacaatagcctctatataattctcgtgtctaaaatccagatacactttattattgatgatactgttatctactactagatatgaattactacttttcaatcatttcaagttttctcttaattccaattggctgagtttgtaatgtaacttatacaaattatgagcaaaacataatatttttaattgttggttaatttaattaaaattgattaattcttttaattttaaaaaataaaccaggtagtttgatgttacctgttattatattaaacattgacattttagaatacctttgtaaaaatgtcatttttattataatttaagacttttttggcattctatacctttctcatttttcctcacaatctactgcctcgattgaaatacatagatcaaaacatgaggtttttgattcgtggttttatgatgtactgtttaatacccattcagcctaaaagcctatggaatatctaagaggaacatcattttttcctttatatttttttgatatttagccattgcttagtaatgtctcttatttattaatatacaatattagtaggtttagtaacatccagtgaactaagttgcaaattttgaaaatctcagaggtatttttggaccacaaataaatagaacattaggcaaataagcttggattacaaaatgtaatgtcattaaataaatgtcattatatttgattatagttgctcactgagaaaatttgtctatgtttcattataaagattattggcagaatgtaagacaatcaacagtttttgattttagggatatttcctaaaaaccttaatattggaattatctgtgtgtgacaaaatttccttaataaatcctcattacttgattacaggttgaatatttcagacatctaagccaattagaatcatgattgttttgattgccagaaatccttaaatgtatgtattatccatcgatgtattcagtttctatattaggcacctttgacttaaacatttttttagtggtttatgattcaaaagaaagtcaactgcatttcattattttttttctggatattacagattttgttttgctccaaaaaataaattgggagtgtgctaatcaattgactatgcacagtgtgaatagcacagtgctagtttctaatatatgtgttaattactttaagatataaagctaagagctaaaatgggctacttcttaaacacattcattgtgaccaatgagatatatatatatatatatatatattttgagatatatatatatatttgagatatatatatatttttgagatatatatatatatttgacatcaccatctaaaagttagcatctagctcctccaattgttcagaaattaggcttctggacagtaagtggtttgtaaagacaggctataaaagctgtaagccaatggagtaatctaagtcctggcttgtctgttggaacgcaccaaaataaaactgtgtcttaaattctgctgtatatttttatgagattctaatcaactggatatatcaactgtgttatgggctgtttgatgccattttgaggtagaaaaagtaaattgccttttttattgtactttttaccagacattgttatactctgactcaaggcaaaccattcagttgaggtgattcagttcatttactactagagagaacattgaacaatatttctaattcagtcacaatctggaataattcataactcctctttctctcaacaccccaaaaaaggaaaaatggaatttatgagctttgaatttggaaattatgagagtagaaataatattgaacatctttcagaaatcagtattttcactggtgacgtattctttaagcttgctctatttcaaagacaaatcttagattcagtgatctagttcattcctgtatgagattattgttttcattctccatgtgactgctggagggtagggtgcagaacagggtacctctgctggatgtccttacatacttggatctttaatgtatatttgagaatcttccacttgattttgaggtctgggtatctgtgacacaaaatgattagggaagaagttttttctccagtaatgtgtcctaagtattttataattatatccaaaaaggttgtgcttttgtgcagaaaatttaacatagcataactaagactactatccttagaaactgacaattcattttttcttatgcaacaaaggctagttatttataaaatgttacccttataagactagttattttttgcataactgatacaaataatctagttttagaaaatcgacttagcggggagagatagcatttggagatatacctaatgttaaatgatgagttactgggtgcagcacaccaacatggtgcatgtatacatatgtaactaacttgcacgttgtgcacatgtaccctaaaacttaaagtataataaaaaaaaaagaaaattgacttagccagagaattaatacttttaacttttgctttgcacttgctgctactaattttaaattttatatttggctttttcctagatccatttcctgatatttggttaaaaaataaaatttctaaatttttattctttactattttgtcctacatagtttactctcataaaattttgtctattgtgtttcattaatgattcataaaatataaaagaaattaaaagcactagaaatttgacttatcactttaatcttgtagtagtttttaaaagactttatgattttcagacaatgtgtaagagtatttcagagatctgaagaatagaatacagtttctaactcatgagaactttttaattaggtgctccattgtcactattgtttcttttctgattatcacaggaatttttttgttgttcatacatgctaagaatctgtctactaacatagttattcccaaatgtgtctttttattttaatattttaaacacagtttatttcctgttttggtcaagagtagaatagattaaatattgtagtaaaaggaatcaacaggacttgcattacctttgactttagtgaaacctgctgtgacactgggcaattctttctattcagtgatcaggttcacatcctttccctcttctgtgtttcactgaattgcaatataattcacttatctttccctttacttagaagagtatattcttttcaaaaaattaatttcaaaggattatttgtatgcaattttattcaagtcttctttctgaaattctcatatagcaaacttgttacaaaatatcgatatatgcttggggacagggaactctctgtatcttcctttcaatttttctgtgaatctaaaactctgaaaaataaaatttattaattataagaaaactataaacaatatggtaatgaaaattcctatgcaaaatagagtgattttgattttatacagttctattatatctccttgtttctattcatttcttctgttaaacaggatttcccccttaaaccgtatgaacatggaattatagaatcataagcaaatactaccttcaaggttgcttaaccttaaaatcttgaacctcctgtctcccttttatatctattagattgcttggatttcttttcttttttttttttttaacttagtaaattttcgaaactcaaagtaacttatttaaaacagttaattactaacaacactcatctttccccaaagtttggatttacaattctgaagttaattttgatgacttaatcttcatttatgtcagattattctttaatatatggaaggttttaaaaatacatgaatttcgactggggtaaagatttgtgtacactattacggagctttgtcattaaactaaatgaggtattaaagtcttaaaaccacagttataataagatagagaactcaaccataactatatgactaaagaaaatactaattgatgatgcctttatttcaactgtccaaaacagacttgtttcgtgtggtgtttttaattgagttacacagtttctttgttttccctctctttttatggatgtaggactcttaaactcataaaactttgtactttattacacatgtggtttttggtaattaggttttctttttttaccttcacgaaacaacagtctagtcaatgtaatattgcttaccatgtggttgattttctgtttttatcttttactttttattctgaatcatatctatttgaaattgtagcatgaggaaatattttaaacaaaaagtcattgaaagtactttttctactgataatgaaaatgcattttctgaaaggagaaaaatcacataattatggttatattacatgaaaatcctttttaaaaattcagggactggtaatagattttattcctttgcttttttcgagcactactatgtagtaatcacttttccggttgctgagaacacagcattgaataaggcagggtctctggttttggaattcatgttaaaaaatgttttccctaaattttcttagatattaagtgactttgtggactataaaaattaataattttccttttagaatgagtttcatcaaccaactgagattcttgttagttttgtgacttttatatatgttatgtttcttgaacattatgattcttgagatagagccctataattttagttaatagcaaacatttataacagttaaggaaaatgctcttcacattttgcttaaatacatatttctcttatattttagctgggaaattttaagattccttctgtcaaacataagatggtggttggaagaatatcgctttgatggatttcgttttgatggtgttacgtccatgctttatcatcaccatggagtgggtaggtaacctgatataatcaggtttggggttaattgcagaagctgcaatagccattactggtgtcttggtttttattagttccattacatatgctttctctgtagtaatttattatcccattttggcaaaaggtagattataagtacattttataagtaaacaaaaggtaatcatttcctttgaaatatatctgctgaatatgctataattcgtgtgtagcttaaaatttttttgaggaaaccatttattgtaacactctcaggatgtgaacactacagcacttccaatgaaaataaaaaataatagatgagaacagttgtgaatgcataggtttttacatattacacattgaataaaatatgtattttaattgcagatttacctggttaaaattaaattataaattaatttgaaattaaaaatatttatcagactctcagcttaaaagttgtacaaagaagtagaatcacagaatactaatccctcaatagatgacatgggaacaattattattattattattattattattattgttcttgagacagagtcttgttctgttgcccaggctggagcgcagtggtgtgaactcagatcactgcaaactccatctcttgggttcaagcaattctcctgcctcagcctcccgagtagctgggattacaggtgcccatcatcacacctggctaatttttgtatttttttaatagagacggggtttcaccctgttggctaggttggtctcaaactcctgacctcaggtgatctgcccgccttggcctcccaaagtgctgggattgcaggagtgagccaccacacccagccaattattattattttttaatggccaaatgttcactagcaataaacagaaaaaaagaaaaaaacaaagggggtgaaaaacgtgactgtaaatcttgaaaagtgactgccaaggaaagaagctaaacattcaaagtgtgctactgcttgatcttactcatgatgctgcccacttgaaatgttcctgggaaagaagttgaatctgtaaaacacaacagattttattgatatccattttccagtttcggggaagctgacttacggtatgcaaaggcaaaagttaagaaaaatcttttcctagatttaaacacctacgtgcccctgcagaaactacctcaccgagagaggagtatcttccaagaatttgtggtattagagaaatgaaccaaagtttatggatatgggatgtgctttttatagatacagaatccaagaaatggttaaagaaaaacattctgagttgtttaacatttttttcttccttggaatgacagagaaagcaacaaacaaaatccctgaaaccgcacagcagaagatcaaatagaataccagaaaagttgagatttaaggcagttaatatcaagacacagtatttgatttataaactcagtaataaagggaaatttatcaggaggtcatgaatttacctgcaatttacttgcatgcatgaaaaaaaaatggttggactcatagtattctatttacagaagcaatgtctgccaaattcttacaaagtgtgactcaaacatttgctagttgaatgatggttgccaggggctgaggagtggaggaaatggagagatgttggtcaaagggcgcacttttgttttaaggtgcataagctaggcggaatctaatgtaactatagttaataatattacttggtatttgatgagagccaactttaagtatcctaaacacacacacacgcgcgcacacacacatacacatgtggtaactatgggtggtgacagttgtgtcaatttgagtatagtaatcagtacacaatgtatgccaatatcaaatcagtaccttggaaaccttgaatatatgcaatttttatttgtcaattaaatattttaaaattaaagaacgacagcatcaaaaatgagaaacttggtagttatattgctgctgaaatataaacatgaaagaacttgaagtataagacttccataattatacttgaaaatatccctcagtgatagaatccagcaaactgagaaaaaaaaatcaatagaacttagatgtagagaaatggtaaaaggctgatattgagcacaaatttgattttattataacaataagagtaaattactgaaagaatagaaagtaaatggtataacccaagtaagtgaaatatactataaccaaccaaagttaggatgtgagagaagaggaggtaggaggaagtttgagaatatataatctctttatcatagggaactccatattgcataaattgaagtgtgtgtttgaaataatatataaatattatgtctcagttttatgatggttttcctattttcttttccttacctcagagggatctaatacaaactaacattaacatcttaatgtgacagaaaatgtattgacaattatttgatatttagaattccctttagtatgatttcactttttgccatataatttagctaaaattaaattaaatctttaaagtgctttgtttttctcatgcgtgtgcatttgtcaaacaaaattgatttgcagaattgtctgaactctgaatgttgacatgtagtacttttctaagtcagtatatttgctgatgcttatgttattaaactgctacaataacaaaattcatataaacaaactaattggtgaatgtatttgtgcagagttaagacttgcttgttaacataatatatccgtattgattttctttttctaaggtcaaggtttctcaggtgattacagtgaatatttcggactacaagtagatgaagatgccttgacttacctcatgttggcaaatcatttggttcacacgctgtgtcccgattctataacaatagctgaggtaaagccatagtgaagtcttaccttctgaccccctttaatagagagtattttgtcagcatacagtatttgattaatcaatctcatgttgtcaataattgcgtaaatgaaattctaccctgagtatagtgcagctatcttgtatgggtggcacattatttagaattcactgtttccctattagaagataatgtatactaattacttgtcaccattctgttgttaaaaaagaaaatgccagtggttggagagttaaatgtcctaatcagtggacaggcccttcgctatgagaccttcagcagagaaaagaattgaatattaatgtgtgtctgtccatttattattatttttttcttttttggctcaatcattaaagataggatggattgctgcctgcaagcttctctgaagcctttcttgttctgatgtgattacctttcttgtttatgttattgctctcagattgccaaatgttcactagttattcatgattgttgaaggttcatgattaactgtcccaaagctgcactgtaatgatataattccatatatgcataattgacaattcccctcttggtgataaatgtgataaattaagaagtttgttaaatgcttatgctaatttagatttagtgctaaaatccctctggttttctaagttctctaactaggaattattattaaaattgaatttagcatgttaaaactgttctatacaaagtatagtggttgagatataaaaatagtaagactactgttaaaaatagttagaattaaggtgtgtttttacattgttggtgtttagcttattggcatgaaatggaatagtctccttcctgtagtatttattttttgtatagactgtttttatatccaccatttctcaaaatcagaaatctccaattttataaatggtatgatttcaccgcttggatagaggagaatagttttattcccttcaggcattttactttttaagtattttctgggaataaagcagtagccctaaattcctgaaattcgttcttatatacaattaaaaaacaaacaacctaccatacaatttagacacccagtattttttcacagtcatgacctacctacgtttgatcatagcacatcttactaatacttgtgctaatattttttgtgctgaatatctttaacatcaatcagagtgtattttaaacttttgccttatgtatatttgaattttatatgtcaaacatcaaaaaattaattattttgtcaatgatatttatggcaatccaaagcagagatattacaaatgacaaattactacaaacaattaatgacagcacaaatcaaaagtgagtactgaagaaaaagaagcaatgatttaatacatgaaagttaaaattgttacattgatctttccattcatttcaagtaaaatagtttcatcatctagggagctctggtctgattatcagtgtttctaccaatgaaactttgagactttagcctactttatattacttggttttagattttttttttttttaaaaaaagatgtgccttcaatttattccacttaaattgaaaactacttcaatttcaatacgtcacttttctgtctagcgggagtctcttccaaatgtagaattgatccccatgaacttttttttttttaagaaaaggaatgtatttgaacgaataagcaatgtaattttatttaaattcctttagtagaaatatgaatttatttataatgacaattacaaaaattgcaaccttattttgctcaagtttatctaccattttacattattatatttgctatattaattaaaacatttttgattgatgtatctttccctctggaatggttataagtgctctttagatagtaaaaaattagaactattttaatttcatcccaaacacagaatcattttcatatgccatatgaataggcatcaattgttttatatttagagtatgtttattttgatgacctttatgatttaccttttttttcttaaaaattttaaaagaacagtcacaaactttccaccttcaaaaggagggctgaaacaactcatatgcattaatgaggcaactttctagaagtcagatttaggagtcaagactatatgattgttaccaaatcaccaggggtttagtctaggtcctgctgcttgctgcacagaaagccaatcacggagacaatgattattgccgtagaagaaggctttgatcagtctcaaatccatctctcttaccaactaaaattagaggtttatatagtaagaaataaatgtaacaatgtgtaagaaaacagaactagagaggggtaaggaagcaatcatgaggaatgaccggtctggcatctcattgcatgccatgatttggtgagcttcagttctttgatacttttttttgagaagacttgagggacaaatgtaggtttcaagcttttcaaaaggattcaattctatgtttatccaaaaaaatatgtctatgggatgtttgggtttcatgattaccatatgtttttcttagcagattctatttcctaaaacaacattgggactggatacagaacatgccttaatattttcttgagaaaattcatcttgatctttaataccagtccatcaccagtcattcttgacagtttggtctttcaaaactcttttcagaaggcattgtgtctgtaattctagttcctaatatggtgcctgatatttaatgcatatttatccaatcctgtctgtggaaatatgacttatattttgataaatagaatgattgaaatggcttcttttctactgatcttttttctactttataaaccatgaagaactatgcagaaataagattactggcaaacattttattttcttatggatgtattctaccatataatatatttacttataccttccttccataagaaaaaaaaaaaaagaagcatttgacctgagtcttagagagcctatggtatgtgatagtcttttataggaagtaagggtcataatctaaggaagactttgggcattgacagatgcagaaaagctcgtaacaagtacatgcaagagggaatatttcaaagtggccgaagtacttagtaattaaaatgaaatagtaggaaataatggtggaaagatgtctttccatttcactttctgtgcactttagttaatgatcacaactacatcacatggtcatttcataattatgtttgtgtgtatttaggtcctagtttattaatctttgaaagtcagatattatgtcttatcttttaatccctcagagcacctcactcattcactcaacagatactgaataacctgcttgtgccaagtattattaaactagtctagattcttagggtatatcggtgaacaacaactataaactcttgccctcatggatcttacactataacagggagtaggggagtagctaattggatagtaaatcatatagtaaatgcttaatgtgtaattgttgaatcgaatcttaagctaaggaatttgaattttctattgttggctattgaaatccattgaagggcagtaataggagcggactgtctcataagatatgaatttggcagcagttagtataaagagaaggtagagatggggaatgccatttggatatggtctaggcaagcagtaatgaagattaaataagattgtggttgtggtaatggagcaaaggaaagtaacttatttgaaagatattgtggaattagaattgataatacttagcacatattttcctaaagttgtcttaatatcttttgttacatctgggtccctgtacctatctttgaaacccatttttaaattacttttatttatttgattaattattggatacttattgtctagagtagaaaggaccccctgtcaaaaagcttgatatctgaatccggctctaccattaagaatcctctctctcgactgggtgtggtggcttgtgcctgttgtcgcagcactttgggaggccgagatgggagttcggactcccgtctcgaacggtcaggagttcgagaacagcctggccaacatgatgaaaccccatctctatcaaaaatataaaaaatattagctgagaatggtggtggacatctgtaatcccagctattcgggaggctgaggcaggagaattgcttgaacctgggaggcagaggttgcagtgagctgatatcatgccactgtaaaccagcctgggcaacaagggtgaaactctgtgtcaaaaaaaaaaaaaaattctctatcttgagagatcccttcacctcaataaacctctgtttctatatctgctaaatgaagataatccctacctaatctcaaaaaccccttctaagtgtaacctactctagtaaaagctattgtactgtttcactgttaatgtactaactctacattccatttcatcaaaagctagtgttcacaaaaatacactccctatcagggctacatacagaaagaacaactataacagatttatgccacatgtattgttgtgcttggtgaaagcaacaaaactaataaaaaatgttttacagtagttcaaaaataagaaactatgttttagcaataacagttttgctattttgtgttctctaggagatactgaagaaaagaaataaatagcttcatgagatcaaagtttgcctggagtgaaaacattaagcaaaaatctttctgggaaatgagatatgctatcacaattttatcgacttttatgttaccaaagcagcccaaaaatatattcccctattattgttttcatttattgacctgggctttacagtcagaatatttactaaaagtttgatcattatgaaccgacgttctttgttgtaggatgtatcaggaatgccagctctgtgctctccaatttcccagggagggggtggttttgactatcgactagccatggcaattccagataagtggattcaggtaagagtccatgtaaatattttttgtttctgtgaatactgtgttgcttcatttatctttaatttatttcttagttgtaatcattagttacagatattataattgaagtattaaattctttcattagtctgtcgattcttatgctttttaataaggtgcttctcaaaatattaaaagttctgatttaaagtattcatacgtattcaggcaaagggaaaatatgattaatatcatgttagctgtataaatggaattttgcattatcaatgcaattatatgaaacttcagtgctctatatttaatacatattagacttcattacagcattcatttatgcctacagatcatgcattaatgtaaaagttactccttaattcccagtacttgcttaatagtatggtttttcctcaacaaatttggattggattcatccattcctttattcaacattaaaaagtccttaccatttgtcagacactaggaatgaataactgtacatggtactttgcacatcatttatcaataaaattttattaactttaatgacagttcaagtagtttggtgttttttgtttttttttcatttaatgtttgcctaaaggactaaagtcattatgtagacttaggtttgatatagaacatttctttgcagccatgtcgacattcatgggctgaatatatataaggagtcagatatatatacaaataatcatagctttctgatgagccctttatttcagacatgaactggtgccatgagaccacagttgtagaagggcttaattttgggtagaaaaactgtagcgcctactcttaaggaagtggttactataatcatttcttagctgtctttcctgtccccctgggcaatttgtgcaatgcatagctgtgacattaaacttggaccaacataacttctgcttctacatttataataattccttaaacattatcaggtcaaaaagcaagtattttataaagatttttacttagaaaacataaaaacaaaggaatattctcctttaatacatgggaacgtagccttgtatttgttactttaaaaaaaatgctgtagttttcaattttctcaccttggtataaggttcctcatcagccccatctcttactatttctagttttttcatgtagacttttttccctcacaagtgacaaatcttactttttaacctcctgctaaaagccttaatcattctttgttcacattcaataatgttttaaggtgtacgtcaacctagaattatttttcagtcagtaatagcacaaagtgaggtattttctctctgagtattcatggcagcttaaaaaattgaaatttaacctaataaacattttattacattgtatgatgaaggtaatgcattaggcaatgtatcatacttacttattatacatgataactataataatcatagttatcaaatagaaaaatattttatcctaaatttaggatatgaccatcctgttttagattgtaaattctctgaaagcagttatcatcttctattttatgtaattatttaaaattcttattgtatcaccaaactgggtccccccttagttaataaaactaaagttaaaatagtattacaataaaacccttagacatagtgattttcctctacttttgtaactggtgcatttaaaaacaattcaataagtggctcccattctccctatatgtcaataaaacacacaagagttattaaatcagatgacaactgtactcagaatgtatatggcctgtgatgttgtctacccatacagtatgagttaaattagaatgctagattttattcatgtttttgttgttcaaaagcaaattatgtatcatttcctagttgtattatttcaatatcattagttttgaatatcattcttagtttaatcaattactgaacaaatatttgactatctaaattatgccaaatttgctgtatttcctttcattttatttgatcatttttgaagtgtttatgttaaggtaatgtatgtgtctaatgaactcattcattgatctgttaattccaccaaatatttattgagcacctagtatttttaataaatatagtttttctaattaaacatttttgagatattaggataattgtagattcacatgcagctgtaagaaataatacagtgagatctggtatgctcattcatcagttttccccagtggtagcttcttgcaaaggtatagaacaatcttttaaccaagatactcacattgatatactcaaggtgcaaaacacgttcattgccacaagattccctcatgttgcctttagagtaacgcctacttattttcatcttgcttgcttctaataatgccttaaccgctggcaaccacgaatgagatctccattcctataatttcgtcatttcaaaaatattatataaatggaatcatgcagtttgtgacctttctggattggcattttcagttagcaaaattttctcgagatttatccaagaaaacctccaatgttgttatatccagcattcttgttgcatatatcaacagcgcattcaacagcactgaataggattccaaggcaggggtataccacagtttaaccattcacccattgaaaaacatccaggttgcttccagcttatggctattatgaataaagttactgtatacatgtgtgtactcattttttatcaacataagttttcataactatgagataaatgctcaaacactacaattactgaaccatacagtaattccctgtttaattttttaagaaactgctaaactgttttccaaagtagctgtaacattttacattctgactagtgatgtttgagagacctgcctctatacatcctcaccagcatttggtgttgtcactatgttttattttagctattataatcagtgtgtagtgacatctcattgtggttttattatttttcaaatggtttatgatgctggataccaaacatgtgcttatttgcctcctgcatatcctctttggtgaggtatctgttcatatcttttaaccatttcttgattgcattgtttatttactgtggagttttgagggttctttatatattttagattcaacttctttgccggatacatggttgacaatttttttctcctagtctgatgcttgttctttcatcctcttcacattggcttttcacagagcaattttttaaaaattttgatgaagctagtttatcattttttcccttgtataggtctctcttttggtatcaagtttaagaaatttttgactctcttatggtttttactaaatgttttatagtttttattttttatatttaagcccatgatccattttgagttaagttctgtgcaatatataagacttagctcaaggttctttatcgttctctttttacccatgggtatccaattctttaagcatcatttgttgaaacatccgcccaccttccattgaatttctgttgcccttttatcaaaaattagtctggcccatttgtgtaggtctatacattagtttcctattattcccatatccaatttaccacaagcttagtggcttaaacagcacaaattcacaacagttctatgtgttacaaaaatgaaatgggttttactgggactaaaatcaaagtgtaaacagggctgcatttcttctggaggctgtaagggagaagccatttccttgccttttctcacttctaaaagctgcctatattccttggctcattgctccttcctctatcctcaaagcagcagtatagcatcttcaaatctttctcttattttgacactcatgcctgctttttagaaagatgctcgtggattaggttgtgaacatctatggatggttgctcttctgccttccacgttctgccctctggtgcccaaagattcgcactgcaatgatcagaactgcttatgttctcataattgtatgacagtgtgttgaattaaagagggagagtaaatttaggacataatcctgaggaacaccagcctttataggacaaacagaggaagagaatttatagtatgtcgggagtggcgggaagaaacaaaacaatataaagcaagagtttcacagtggtagattaataaagggaaaagttcaggggcaggagataggatcagcagtgtcaatatgtatagcaagtatctacttaagggagagcaattactaacttaagctcacaccacaagcttaacctcagcaagttcagttgcataaaagtatagtgttagagggacagagccagactgaacaccgactagaaattgaaatgcagacacaaaatgtgtggtctgttaagagggtaattatttgatgataattaactttaaattttgaaacagttgttttatcactttgtaaaaatgaagcgaaacactctttttactaatttttttcatataaacaaataaatataacaagtgtatctctaccatgtacaagttataggaagacatgccgtgcaataacattactgtgggcattaatcaagaggtggcagttattacagaaaaatagttgcaaagatcctaaaatataatgattaaactgtctgcacaaaagcaaacaccacacacacacacacaaacacactctacaccactgtcatttggacattctgtataaaagctgtgatttcagtaaaagtttaaacagtgataactttgctatatgggtggactaatatgtgcttatcaaatagtttgcactgatataatgcataacttcagattgtgatttaaaaataagaaaaataatgctttactcagaagcttatttttctctcttgtgtctagctacttaaagagtttaaagatgaagactggaacatgggcgatatagtatacacgctcacaaacaggcgctaccttgaaaagtgcattgcttatgcagagagccatgatcaggtaaatgaatatgtgcataaattcatttatttctctctctctctcttcctccttccctctccttaataacatatttaaatataaacatatcgaaatataaacctctgtagttactataatgtgtgtatgtgtgtgtgtgtattaatatatatctttacaggaaaactacgtatattggaaaaaatgttaaatttgtagatggagaaactccagtttcaaaatgcagtagtatgtttgtcctgccaaactataattaatagattatacattgcagttgcaagtattatatgttttcccttgtcataatgaagaaaattggtgctggaccaggtttattttagtttccgtcttaggctgccttctagaggtattcttttatgcttttgacaagcattcttcagtttttcccctcagtcactgaaatctcctgctaattgacctccctgacccctgttccatccagccttagtctgtcttctcgaatacagcctaagttattttctaaagaggaaagctcgtcttgtcaacccagatatactggtcgaagcctgtaattcaaagccactcctattttggctcaagccggtttccagcattattctctgcccaactctccaagcctcctgttcttcaatactttgaaatccctacccattccaaataggtcagctttttccaatcttgtgcttttccccacgcatctgcatctgggaagttcctactcagacctaattgtctggctctgacacattctatataaagccttccttgggtcatgtagggaaaaattagttgtcccatcctccaagtttccattatgttttaggaacagaatttttttttcattgtctttctatttccagcctttagcactgtgactgatcctagtaatcacttaataaatatttttaaaatggagaaaaaaggtcacttatttaaggtcatattaatcctcatacacatcaacataaaatttactttttgtagattaaaatgtagacaataaaatgtttgaagttacttaaagtatctttattaaaaaattgaaactaaataagtttctctatcatttttgcagaaattggccatttaacgcaaacatgattttttcaggtgtctcctctaattgttaagaaaatgtaagtaaagcaggggttgggtaatcaaggcccatgggccaaatcctacctgctgcctgtttttgtaaataaggttacttggaacacagccatgctgatttgtttacgtattctcctttgtgccaaaatgatgcatttgagtagctgagacagagaaagtggcccacccttagagaaacttgatgacctctgaagtaaactcatgttaaattttgcatcttccaaattggggctgtgctttcttatcaacttcaatttacattatccttgtctgtagagcagataagataaatacttatctaaaaaagaagaacccaatctagaaaagaataatatttgtttaataggtgagtggtgggggtggggagggggaaactcttaccaaatacataacaatttggaaattaaaatatatgcataaattatagctttctattgcaaactccttgaagttgcagcacatagtgaattcccagcatatgtttattttatatgaatgaaagagtaaacaaataagtggcatgaacaaatggaagatgaaaaagatagatttcttacgtaaatttctacctaatctgtaaagaaaaagatttaccaagaattatttcatactttaaaaattcaggcaatcctatcttatatattcaggaattctcaggatagcagaaataatgcaagttgcctagttctttctaaaagcaaatgtactttgattcttaagcctgataaaaaatataaatgtatatgaatacataaaaatgaataaataaacatataatttatagtaaaaatgtggatgttattttaaactttttagataaatccttaacaattaaatttgtaaacttaacttaatttcaccagtatctcaacaggattttataagagggcaacttggtatgagaataagctttatctatgaacctgatccaaagttattaaaataattttataatagaatcagagattgtagaaataaataattatagctaaaaacataattaaagaattcaaaacaagtagagaaggtgagttgtttaagaagtaatgatataaatcctataacaatttttaaagaaagatcattttaattaaagtaggttaaagatagaaaagattgtaaacaaatttcttttctagaaaatgaaaagaattgtaatagggtactgagattatggattaatttctattttacattttactctatgttattgttttgtccatgatgaacactgcattagctgttttgaactgtaaataattcagatttttaggaggtctctctgctgttactcagggcatttctgagttacctgcctcagttaataattattatattttcaggtaaaacaaactaaatttagattaaatggcaaatacaatgagaaagcaaatttacacttaaataaatgttctcaacttattttctctgctgagggcaggaaggaactattgtgatatatttatacacatattatattactcatatatatgagcaaaataatatatatatattatatatcaatgatttttcagaaacttctttcaaagcaaataaaatcattatatacaatctattttaaaaatctatttaatattctcaacattataataaatgtttcagaaaatgtgaggtgtcagctcacatataacagatattcaggtaccttatcatgaatctttcaccaacctattttaaaaataaaaatcagtccagtcctgaaaacaaatgtgttgaagtctaacatattttaccagcttgccttgagcctagaaaatcaccagtggaaaatacctgaaattaatattaatctacacacctcttctacgatgtttcctaacatttgtaaccatgcattgttctattgtaaatcacaactacttagcacttttttttttcatttatctccattacttttatttctgtaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaagtgtgagttaaacacatatgcaatttgtgtttaaaatgttaacttataatgacataaatcatgtagaatattttgatttggcttttcagatttagaatataaaattacaactatttatttcatatactgtcgtgtaaattgcaagaataaaattaaatcactgtaaggttattatattaatatatgatacaaaagtatagtctaaaagctgatatttaattgaatattgctgtcaagcgggcttacctgtttttaacatccggaattatggttctgaatttaatcattctgagttaattttattgttatagtatttgcacattaaatctaagaaagatataattatcatattataacatagcaagctagtattattggtcttctttgagataattttataccagtatacttgtgttataaatgtgtgaacttaggttcagagatattgtgttggacaaaaagaaatttattttttaaaatagaaaaatatgaatactgaaaggtcatttttgtctgaaagctcttgaaataaaatataaaaattgacttctagttggtgaacagcagacattgaaacattcgagttttaggaaatttttacagcttttagactagagaaagacacaaagactggggaatatatacaaaaggctgttttatttttctacaataaaagactcagggtgggtggtgcctcacacctttaatctgattcctttgggaggctgagggaggaggatggcttgaggcgaagagttagagaccaacctggacaatatggaaaagccccatctctaccaaaagaagaaaaaaaaaatgctgggtgtggtggtgcgtgcctgtaccctagctaatcaggaggctgaggcagagggactgtttgagcccaggagtctgaggttgtagtaaactataatcatgcactccagctagggtgacaaagcaagaccctatctctaatttttaaaaagccctggatctttgaattattcacttctacttggaaatttttgtaagaaatctcagattgaacttttaaaagcctttattttttactaactggaggttaggaagccaaccccgagaaagcatacacagatttcacgtatactacctgtacctttgggtgtatcctctattctcagggtcactgaaatttgttgacatccctagccttccaggaagtgaccttcctgagttgtgagactgtatcgcatcagccaggtatcaggtcaagttccctggatggactttgcaatgattggttccataaataaagtcagccttagttccttaaaagcaatggttctacctgactcaggatgcatcattctccaatatgggcactccgtaaggccttagttatacagccaatttatgtaactatatcctgatgaataagtaaactgtatgaacctatgcaaataaccatgtcaccatgtaaagtaaggaaactgaggacctagtgagatattttaaatgctttatttcatgtacaaaagtataaaattactatcatctacagaaggaaatccttatgtatctgtagatacataattacataaaatagaagatgataactgctttcagagaatttacaatctaaaacaggatggtcatatcctaaatttaggataaaatatttttctatttgataactatgattattatagttatcatgtataataagtaagtatgatacattgcctaatgcattaccttcatcatacaatgtaataaaatgtttattaggttaaatttcaattttttaagctgccatgaatactcagagagaaaatacctcactttgtgctattactgactgaaaaataattctaggttgacgtacaccttaaaacattattgaatgtgaacaaagaatgattaaggcttttagcaggaggttaaaaagtaagatttgtcacttgtgaggaaaaaaagtctacatgaaaaaactagaaatagtaagagatggggctgatgaggaaccttataccaaggtgagaaaattgaaaactacagcattttttttaaagtaacaaatacaaggctaccttcccatgtattaaagaatattcctttgtttgtatgttttctgagtaaaactacagatagtaatactgttttagcattagttcattagctgcaataaccagttttagttataagcaaggtgatattttctaatggcatatagaaattaatatttaaaaagagcaatttaagaaattttttcaaaactaagaaacaacttgattgtttacttatcttttaggcatttctaaacttgttaattttctggaattttattttttattttcctccaggagagaaacagtgagtcaaaagaaataaaacaactatacatttgtatagcacatatttttataaaaacatgtttacgtaaatttatttgtcaggcattcagatatatgttctgtttatcaaaagtcattaagattaatgtagattttctcagaataccagtttggctgatttgttttgttttgtttttgtcttatgtattctaattttgaatttcaaaaaaattctttcactctggttatagctgtgaaatatttactatgcttttttgatttgctaggttattgtgaatggttttatgaataaatagatttgtatttttttattctatcatatatgaaataattgaatatagaagggagatcagcaataactaaattatttttgtcagtaacatcgacatagcattctctacttttttttttttttttgagatggagtctcgccctgtcgcccaggctggagtgccgtgatgcaatctctgctcactgcaagctctgcttcccgggttcacgccattctcctgcctcagcctcccaagtaactgggactacaggtgcccgccaccacgcccagctaattttttgtattttttagtagagacagtgtttcaccgtgttagacaggatgatctcgatctcctgacctcgtgattcgcctgcctcggcctcccaaagtgctgggattacaggcgtgagccactgcccccggcctcattctatactttctaaaacacttcatatctattatctaaatgaacattccatttcctttttattttttataccagatatttgttcaaaagaaacctggggccaaaagttataagaataataaggcatgctacgtagacattctaagtccattttgctaaaacttcgactcagagacatatagggacatgcctcagtttgcacaaccagaaaatttcggcagctggtcagttgcctttttcttctgatttccaatttgagaaaaattgtaatgaaaattactctgagatcagtatctagattagttagccacaaatacatggtttatgaatactttttagagaaaaggtacagcatagtggttaagaatactgttgggttggaatctgtgcctttccctttttggctgtgtgatctgggtaagatgcatcaactatgccttcatcggctcagtgataaagtgggtgcctgcttcgtcagattgttttgagggtgaaatgacttaatactgttatacttatataaaacacaaagtatttgcaggcatatagcttatagttaactattatttaaattgacggttactatattttaatattatcagttactccattaactatatggtacctgaatgctgatgtcctaattccatttaattgtgttttttagaatgttgtctgatagtacattgtttaaaataaaagattatttcatttctactttaaaatatcagtaaatgtagtgatttgttaaaaatcaatgttcttttcctaatttatgttatgtgataaattaagccatttctgcattaagtctcaccaatttaccttctgagttttttagtcataatgatgtctactgaacgatgctgctgaaacagccttagctttcatgtgtgaggaagtctgagggttgcctcaatttgtttttatttttgggataagccaatatcatattgctcagttaacatttattatgaattgactgtttcctttgtgtgtatataattatgtgtgtatatatgcatcagatagagcatcagatgaaatttactgtttttatggtacctgtgcacagaatttctacacacacacacacacacacacagagagagagagagagagagagaaggcaaattgacttagagcaaattcagtctgaaaagttagtgtatttgaggtgtatattaatttaaactataaatttaatatattcataatgcattctaaaatgttgtaagatttctttatgcttaagacatttatatgtatctatgatataccaggtattactaagtggtatgtattcagagatgaaaaatagttcttgccctcaaggccttaaaacccaaaagggaatacaggcaagtgatagacaaatacctttatagtaatgcatgcactaggttcagtgatacagataagcagaaaatgctgtgtaaatatttaggaaacttgttttggagattgttggtaaaaatatgatatgctttagccaaaccagcttggaataggaagccacaggaaagttatgtatgagatcagtaatagtctaagtaagagtaggcttgaagcaattgactgataatttgagattacagccagttaagattattaaactttgaataaatgaaaaaaactggggcctaaagaaaacaatttacatgccattctgattggcaagtttaatgaaaagatgagtttcaatcactttaaattactttaaaatattgttaactcttcagttagaactagtattaatggttatgtgacattatggtttatttttttttaaataatcattggctaagtatgcttcgtgttcaaaaataaatataaaataaaaaacatcaactttatgcataggatgacctcagtgaatgtattttactcagctttctggtgcttatttggttatcacggaaatgctatcctttcctaattcagtcagctgaggcagagggagtagagtcatatggccttatcatgtgacccaggaatgttgctatgaacatgctggtttaggcaggcaaattgactactatgtccagtgatcacattagggaaaaaaacaccaaccctgatactgcaattttaattccatataatatgaaaataagggcattaaaggattttcttattaaacgctacatagaattataaaaaacaagagaagaaaccaaatatttaattcattttaaatatataaacatgtacagatgttttaaaatatcaagtaaagcataaattaaaatataagaattaagaacatatctttctgatttaaatattgacaggcaaggtagaatgtaattttaagaatctgctaactaaacaaaatttaaaaattaatcataaatttgaaaatgaaataatgtctaatgactttttaaatgtgaacttaaaaaataacctgcttaaaaatcttgccatcattgagacacaaatggtattttgtgaaacattttctggcttctcagaaagatctttgtaactttatactacattgggcaatagtaaggagaaagttatactggacagctaaatacacatattttattcattcttttattagtccattttcatactgctgtaaagaactgcctgagactgggtaatttataaaggaaagaggtttaattgagttacagttaagcatagctggggaggcctcaggaaacttacagtcaaggcagaaggtgaaggggaagcaaggcaccttcacaaggctgcaggaaggagaaatgccaagcaaaggtggaagagccccttgtaaaaccagcagatcttgtgagaactcactatcacaagaacagcatgggggaaactgcccccatgattctgttatctccacctggtctctcccttgacatgtggggattatgggaattacaattcaagatgagatttgggtggggacacaaagcctaaccatgtcaattctcaagtaatcaagtctctaactttaagaatttttttaaaaataacctttagatttctttatgggtactggaatcttttttatcaatagcttactgccagttttgttttaaaaaaagttgttttgttttccaccctggtttgacttcttctttagtttcataacgtataggtaaagattcaaatgtagagtgacctgaatcacttttagtactgtcatgttaatattccacttgttcagaatactttgaactaaagtaaaaattattcttggaacagaagctttactttcatcagttgtcattttcttcttcctcctggggattgtagtgttatagaagagcactttttaaatgagtatagcttcactctatttgaaatttaatgctttttatataactctccgggtatacctcgaaacataaatgattcacatttctcatttaaaaaaatactgaactagcagacttaaatcaagaaaaccagcaacatttcacttctgtaatgtagctcagtgctccatataactgaaaacctgtgttgtcattataaaacatattccccatgacatgagatgttaacacataagttgaaatatcagaagaaatctggaatcaactaaacccattggtttatttgtttgctcattcattccttaattcattcaaatcaaactcattatttccatgtctaatgtcttccctcttcaacggagaaaagtaataaaaggaggaaataagtaaaaaggtatatgaggagctgtgtgtgcagataacgctatgggacatgatgtaggaagtcagactcctggaattctgtctcttttcctatccttccaccttgaatttacctcctttttccctccattttatttttgtttgtttcagagtaatatgttgcttttcctgttaaagaagactttagatcctgagtgtatactgtcttgactttaaaagcctaattcctactattaaaagcaatcatgttatcattatcttttatatagggcacttggtagaaaataaacatggagttatttttctacttgccagcatgtatggggacacatttacagatataattatgtttatggttttttaggctctttagaaacccataccttcttttattctaactgaattaagagaattaagaactagtggtgttccaattcaggcttttaaagacatactgtatacacatgatcaatgaacttatagtgcaatgcccacccctttatgaaggcctataacatcctttatgatccaactactgcctacctttccacccagatatctctgcttcctacttcttgagtactaagttacaattacaccagtctccaatttcatttcctgatacacaggaagtaaaaagtaggcaggcgttaaattataaagatcatgcactttttgaaaatacctgtggtaactttatgcaactttactttgtgtgaaatccatcaaccttcatcttctccctcttaagatttgggaatatctttcatgcttggagattcataacatcttgctcacacttatgagaaacatctgtaattttagtacaacaatcatatcctgagagccaatagatcagttatgagttctgaatctgtgttggcaatcaggatactttgaacaaatggtacaaattcttaatcccatagatttctgtaaaatatgtcaactgcatgcctttaagaatttttttttctaatttaacattctgtttcttaggttaattagaagttatcactgtaaaagaaacacctagtgaccgtatattttagtctgaaaattaatattgtctttggctttataaaaataagtaagcaggccagtcatggtggctcacacctgtaatcccagcactttgggaggctgaggtgggtggattacctgaggtcaggagtttgagaccagcctggcaagttaaatcctatctcttctaaaaatacagaaaattagccaggtgtagtggcaggcacctgtaatcccagctactcgggaggctgaggcagagaatctcttgaacctgggaggtggaggttgcagtgagctaagatcacaccattacactccggcctgggcaacaagagcaaaatcttgaaattaaaaaaataaaataaaataagtaagcaaagaaaagtggcaattattttctttattagaaatcaatgtttgaaacagtttttcagttaagtgtttactaatgtgttgtatttgtgtgatagatactccgtctgctctctcatagctgtggtcgtgactgctagttttctccattaacacttttcctccaaattttaactgggtacatggatggccagaataacaagcacattccccaggttctttggaagcctgctgaggtcatgtgaccagcagttatggccagaaggatgttaatggtagtgctgtataagcaactcacaggtcaagctcttaaatggcaagggcatgaacatctctgaccccttgccacatcttctactcactggtggaatgccatatcatgtaaatggcagaacaacaaggtcaaaaaatattagttggcctttacatattgctatgtattactgctataagagaaatctttttaaatggcatatttcacagtttacatgtcctgtaacattttttatcttagcattgaaaccaaagtaaaatttaattcctaatgtcctacatttaaattagtttttttaattcccctattgtttacccttattagtgctaatgtcagtaataactaaaaacattaaaaaattagttttcaaatgtaatttggacatttgggaaaaattaaatttttatcatataaatataaatgttccataaaacagttgtgtcactagtgaattgaagtaagatgttaagtatagctcctttctaatattggtcacatgtaatttggtattttttttagatctttaaaatgtcaattcatattttgggggggtggtagctggaatgtttatggcattttaatagtcaatagtttctcctagatagctcacaatctgtgtatacatgttatctctccatttagctcacaatctgtgtataaatgttatctctccatttatatatgtatatatatacacacacatacatatatatgtcttcacatatactcacatgcacatatatatatatacacacacacacgttcgtgtctaacacagatacagacacacaatattttttaagtctttttcctcccttaagtcaaccttttaagaacaatccttaacgcatttgggaacttttggaatgcttgctttcattcactcattcattaactcaggtagttactaagtacacattccgtactaggaattgttttagttactctactaaatgcttgacatgcaaagtggtcaggataaatatagcctctttcctcaggaagcttaatttctgttaagggcaacagagagaaatggcaaaacaaaacaaaacaaataaaaaacctgcaaatgataagtgacacaaagaaaacaaaaacattgttaaaattgagaacacaattttgggaggctgaggccggtggatcacttgatgtcagaagttggtgaccagcctggccagcgtgatgaaaccccgtctctactaaaaatacaaaaattagctgtgcatggtggcacgcacctgtagtctcagctacttgggaggctgaggcagtagaatcacttgaacccgggaggcagaggttgcagtgagaccagatcgtgccactgcactccagcctgggtgccagagcgagactccatctcaaaaaaaaaaattgagaatccaaagatggctgtaagctagatctttaaatacttgaaatatacttcgtaaagatcacagaaaaacactctctaaagagaggttacagaatgttcaaaagcccaggggtgggaaaatgctgggggaattcaaggaaattaaaggagactagtgtcactgtaacttagtactcaagaaataggaaaggcaggcaggagttagatcataaaggtcattataggtcttggtaaagaagtggacattgcattataacttcagatgcattttaaagagagtcatatgaaggtgcaatctgtttgacaaagataacctttgttgctttttaaggattgactagggcaagagtaaatgcagggatactactcaggaggttgttgaagtagtcaaaagagtgacaatgatagcagtggagatagaaagaggcaaaaagagtcaagatataattttggaggtagatttaatcaagaagtcttagtaatagtctttggccataagacaaagagaggaatcaaagaatgacttcaggtttttggcttaagcagccattacctgttggtaccactttgtatgagacaaataaggctagagtcaggttagaagtgaaggtgaggagtttagttttaggtatattatcttcatgtttctttgaaagactcaaatgaaatggcaaacagtttgaactcagagaactggataaataaaattggtatttctcaacatatgaattttgctagagccatgatactaatgaggtcagctcctgcaattgagaaccatgaaccaggaagaaaagaaagtccaggatcccagaggaacactgatatctcaacaaagagaaggcataaaagcagactgagaaggaatgatagggaaaaaagaagacatatcctgagatttcaacaccttgaaaaccaaaatatagtatttgaaaaaagaggagatggccatccatgttgaataatgttaagcagctgaatgaaatgaggacaaataagttgccagtggtgaactagacgagactgattctgaggggatgatgagcgtgagagccagaatggagtgggtttaaaagtgaaagtcaagtaatgcttttgcagacagctcttttgaggtgtttgtctaataaaggcagcagataaataagatagcagttcgagtgggatggggatcgagagaggtttgttttcttatgaaatataagaacatgtttgtgttcagaaaaggcctattcaaaggggatgattccgtggtgagagcaagatcaacatagaagggaaaggggctgcctaaaggagaactgtagttccaaagcacaagtggaaaggtaaatgtttatacagaagtcctccttccccccagaaaaaagacaaaaatgaatacaggtgaaggttggttgtaagtggggttttgtgaagatgaaaaaattcatgattgataacttttatattctcagtgagattatcatttgagagcaaaaggaggaaggaataagagatgtttgaaaaaatagaaggtatgagatagacatctctaggagtgaaaataccagagaactatagtagggtgtccaggtaatattgcatgttcgttagatatttgtaatcaggagtacaaattgatccagcctcttggttgtgtgccttttttcctagagggctagtgttgatcaaggattgtagttttgtcaggcacctgtcaaaaaaaggaaggattttgaaagtactagcaaataactaacatattaaagaaccaatagccaactggttctcaaaatggtctgtacattggaatcacctggggactttcaaaaccactgatgtctatgacaaatacctagaaattgtgatttaattggtcttggctagggctcgggcattgaaaaagaatcttaaaatgattcccaggtgattcttaaggctaggaagtgaagagagaattttaagaggtcgtaaaagatataggaaagttctcctgttttagaacagaagttgtagtgagcatagcaagaggattttggaggaagagaagaaaagttcagattgtggtatgtggtgagttcaactatcagtgcctggccaggaggctgaacttggatttcccgtaacaaacaaagcaaacccgaatggggctgctgctgggtattattgagaagctttctaaaatatattttcatcagtaaataaagtttaaatcagaagcctttctgcctttcttatattgtttgtatataaatagatttgtatacaaatatatacaaaatgtatgtaaatagatttatatgcaaacaaaaatcatggcaatagagaacaaagtattttttgtttataatgtaggtcatctgatatgtgtacatatgtttttcctgctttcttgtttagcactcttattatcatgatgttattctggtttctgtaatgagtgatacctgtggagaaaaaggcataattacaaactggcaattttctctctcagcagtattatgaaatttccattactaaatttaaaggattttctcaatataattatattgtattttgacatttgataattttgtaggacattctttaatgaatatgttacattctccccaaagccacaggggaagttggatggattttgtcctaagtgtcagtctgcatttgttgatcgctacattagacttcagtataaaatgtgtgatcttacttcaaatcttccatctgtggttgtttagtgtcaaacttgtaaattcttctatttttctgatagataggaatacaataaagatttaaatgtcttcctgctaagcgctggaattaaggcagttatagaaagacaaaatacactctcctgaacagtgggaatgctaatttttggcattttcttttagcttgttgaggcaagtttgctgaatgtaacatgactcatagaagtctataaaactgagctgtgaaaaactgcaaaattctcaatatgagcagttgtaaatggcttgaagttctgttaaaatgctcagagatacaaatagcgtatattccaaatggcacagacttaaaagcaatggccctgatttgattcacagcacactgttaaccagggttagctggcatttaatgagaacctaccatgagcatgacattgcactaggagttaaggaagtgctgctacaattacctggggagctttaacatattgaagcccaagagcctgaccccaaccatttgagacagaatcgctgagtgtaaggctctggcagtagttgttttgaaaaatctcaccaaataattttaatttgtgaaagtataacatagagatccactgatggaagaacatgcaaaaatgaagattgagagagacagattgacctggactgtgccggagtcactggaagccaggcgagagaatgtcctcagccctctttcccaggtgacttaaatgcccactactggaaaaactcctgccaggttagctttcataagaacaatttcacctcagatccttcctgatgaccataacctttgagaagagtcactttagagaacattgcttatgtaacttacccacatttttttctacccacccacatttaccaaactgaatacagaaaatcttttacaaatataaaaagattatactaatattctggagaggaaaaaaagaagcaactgaacctaactatctctaattctttcagtcttggtcttaggataggatgccccggaaatactgctacatttcttcctttgggatatttgtgattgtcagtggccgtggtgttgactccttttgaatttctcctcagttgggctgtatccagctgaggcccttttaaagatggagtgagaaccataggaatacacccactgcggtgcccaggtgtgaccaggtgcagatattctctgtttttcatccatctaagctaggtccacctctgttctcatgcctctgaggcaatgtccatgtgaggatgggcattgtatcctcacatggagaaatggacagaggtgcaggaaagtgttcctttaaatgttgagcccttttataaaggtgttagttccattcgtgatgtaagagcccttatgacttaatcacctcccagaggccacatctcttaatgctgttccattggtgattaaatttctacaggaattttagaggggatattgtcatttaaaccataacaatccttccttccttcctccgttccttccttccttccttcgtcccttccttcctccctccctcactccctccctccctccctttctccgtctctccctccctgaatgtattcattatccacacaactctggcttagaaggttacttatatatctaaacctctccagctccattgttaggttatagacaattgagtttgcagaatggaggtatggtttactttaacattatatagaaatatataaacttttatcaagccttatttattacttaattacctagcattttataagcacttcaaagtttcattttctaaccgtgagccccagtgactcacaaaagattcccttaaatacagggaactggataggtcacctttaagggctggtgcaggggaatagattgctactctaggaataaagataaattaatatacaatgggcattaattctagccttgagtctgtaatttggtgttacatcttcaattaagccttccctcgatttgatcccaaagacccacctgagtgacagcctcactttattgttggacatgcaaacaaatgaatagccctaccctttcctgacatcactctacagagtaccatggtatgggttttcttcacagtatttctgccgtgttgttaattcttaaatcatctctcaccttcactaattctcgcctttctaattttgctatattagtaatgcttgttatttggctcacagccacttagcacactttctgtaagtttctagaggttaccagaaaacctacagatcttctttccaaaaagaattgatcagaggcttcattttagctcaaagactgaataccggactctgccagtgttattcatgcaggctggaaggatccataggctgaaaaatgtgagatgtattgtcaaactggtgagctatatggctgtcatctcatagaacgtagtgatgagtgctctaaacacagatatcttgctctggcaacctttctcctgaacaactcgacaataggagactaggagtttaaaagatgaatttctctgcctctaaaattttagattattacctgagtccttacttctccatcccaacttggtccccctcccattaaaaaaaaaaaagatgaaagtgacctatacataccgtctcaaaatagtaaagagaatctctcagttacttagaaaatacagttagttttcatttttccttctcactaagagagacataggtttctctttggcgatatattttctttgagaggttgaggggatacagattatttagatgacttgcctcaacttaacagtcttttagcaccctactactgtaaaaatggctataatttcttgaaaatttactcagagcaaggcagtgcactgagtgctttacatataatatctcatttaaaactttgtcatactcctgagaggtagatatgattcccttctcttcacacctaggggaaatgtaaggttaagtggctttcagatttataaaggagccagaatttgaacccagctggtctgtctccaaaatgtaggctctgcatcactaccctatataagacagtagtattattttgcccaaaaatgaatgctaatgttggtagtggtgttggtgcagctctaactacagtcattcatccagaggagatgcaacaaagaggaaaacaacagatcaaattttgtattgtactgtggtctatcaaacaaatcaagggagaaagtaatttgtttccaaattatgaaccaatgttacaaattacttaatggtcctctttgtttacttgtgatagttatttcttcattctacactaatttggcacctactgctgagccaggcactatcctaggaactgggtaacaaaagagaacacttagtcttaactcaaggagctcactatccagagaggaaacaaagcaagacagatgcgagtgtgttcggtaataaatttcaccttcaagatctgcataaagcaccgtgagtacttcaagaaagatcacgaaaccaatatttaggcaaggaagttgcaggccatgaagaaaggcctgctttggaagaagagattaagtttaaagtatccgtttcacctccatgctgatcctctgtgtagtcccatcactggaatggtggctacacaaagctaagaaggtgaaacagaatgagggccttactaatttagatcatgaatgatgagagagaaggctgaacctagaagcagaggccaggtcgtagagggcttttgaagggttttgcaggagattggcatggtcagatccagtttagatatgttacttgattgataatgtaaaagatggatttgaaggggctgtcacctcaaactaaatatagaaatgaccttttgccaccagaattctttcatattagtttaaagttgtaggtctaaattctttccacacttgtcatgtcagtcagtaaattttatataccgccactctggagcagtttgaaatcatccacttcatttttttaaaaaaataaggtcttgctaaagattacgagggaagtaaagtttctatccctctgttgactcaaataaaagagatattcattaactctgcctaacttatcatgtacaaaatgaaatactgttccattgtttcaggtaaattatttttactgcatattcatattttaggtaatcaaacactggaaaattgttttagtccatgagacaagagttgtgtttctttgactgtacaagtttgaatcaacttctgcattatatttcacaactcaaaactgacacagctacttgatttaagcaatttaaaaacataaggtagtataggtgtaacactttatacgttatcatctgtaattttttttaatttggtgtttgtaaactgagtaatgataggtgcagttgaaaaatgtgtttattttttaaggaattttgtaatacagcaaaaattgccacctgattcatcttttgtaaaagaggttttatataactatgtgtcttaaagtaagttgtacccatagaagtataagttataaatgagaaaaaataatactatagcttttaaaaccataaacagttctgtagaaatgcttataatacttgtctttcccctaaaaatacacttaggaaatacgtctacaattaacaaaaaaagactatactattaagcttaaaaatataagccttatttcagtttttacgaaggaattttatagcataagagaaacaacccagaaacagcttttcaacttcgtttgcacacaattatctgatagactcttccaagttaaatttaataaagccaaatgtgataggtgcctgagcttcaccaacacacacaaaaccaaaattcagagataccattttgaaatacgcagagatgaccatgtggaggtgaagagatgaaatgacaaagataagtttgaaaacctaggtaattcataccttttcagaactttaatcttttatacatcatgtttttattttatgtgggtcatagataaaattttcatggtataattgataacaaattgataaatttattttgaaattgttatactgagtcatttttatagtctttccttcccagcatagtaggcagctgtattatcaactttctataaacaagaagacagttagatatcttagattattccaatatgatttttatagtttagtaagaaacattatctgatctatgtgattaaaaatgttattttaaagtgctatgactttctccacatttgaaattttatttacctttttgttataatgtagaaatgctgtgcacttaaaaatttttttttagatcagcttattttatactcacctatagactgtaaaattgtggtacgatgagaacttaattattatgtgttgaacaaataaacattcataagcctggtgcattctgagaaatccatttattgactttttagaggacattttatttattaaagcaagactctcatgaaagctatgtgaacatataaggatctgtctctttgtttctttcttttaattaggatattttaaaatcctttgtgtatggactgtactataaatgaggccaaatagatactagtagaataaatgaaaagttgaacatgttattttgcttgcaacattggaaagctactgttttgttattcattagtcattccaaatatttttggagcagacttttctgatagcttctaaagagagtttgatggtgtactccttttgtattctctttgaagaggtataatcaaacaattacttgattgcttgatacaggcagagcacctcctctacacataaagcagagtgtataaaaccaattccagcaacgtggctatcttcaagtgtatatcatctgtgcattctcggcggggtgatatcaaccccaataggggcaaaaattgatttttctggtagaacaaataaaaccttagatacaatagtgtgtggctctccagagtgccacagcatataaacagatatgcaatagtatttggagcatcaaaacttcatggggtgggtacaatttggaaaaaaaatggctgaagaggcttctgcagggtaagtgagggagtaggtagggaggatacataatgaaaaaagaattgagcaacactgcattattcatattgtcatttctgggccttctacaccagggttgcccactagagtctgattacctcaaaatagtaccttaatgataattgtttcagttttctagtttgatgtgtaaatttttcttttagggcagaagggtaagattttagtcctagcctaggcattcgcattttactaaatgttctactttgtaaaataaaacaaagactttgtccccatattgttccttacattggcattgagaatacttattctcttgaaaatacttctcgagtagctaaaagttaagatatgttttactgttttgaaaatgaaaaaaaattttctatgactgccagcctacttccaacttaattcctttattcttccttgctttttctccttctcttgccagtatatgctgcccccaactaaatgagggcaagaattgcctgggcaaatataacatcaaaggccagacagcttaagataaagagctgatacttttaaattctgatttctttcctacagacacccatcattttttgagtaaaagacaaggacatctgttcattttaatcagttgacttcaaggtcacatgtttaaatataaaaaggtctaatatagaaatattactatatggatataatgaaaattattttttagtgaagaaaataatcattatacacattaacatttaatatattgaaatctgcatgtttaagcatggttttgtttcctaaaatcagtaccttgggtacacacaagacttgtttcctcatgagtcacaaatattttcataactgctatcttgttttgtcttggaaagttcaattgtaagaagctgatataattattaggacttacagttagaaaactgaatttttgaattttgctaattagcagacattttgctattttctgacccttagcaaaaaatattttataacaaccagaatttcctttgcaacttgatgagatagatagatagatagatagatgatatatatttgatacctaagttgtttttgtttttaaattgtaattaaataaaacagtaaatgtcgtcttttttagggtggctaaaatatgcaatatcagcagtaagcattggactgaacatggttctttttaaccatgattttaatactcatttgttttaattattttggtaattataataaaagaactaggaaatgaacctgagaaactataaacacacacacacacattgacttaaaatacatactttacaaattgagaaataggttaccaacctgtaaagctcattactattttatcattttttctcttatttgccaaacttcattatatagttacgtgtgctgatcctgcttcctcatacgctacccacctctcaaactcttgtactttccctgatgccgtctcacaattcaggaactttggtttccaagatcatcattgacttgcagacctctgcacccactacctgaactcctttgacctcttggttcagtttgactcctcaggttctccttctctttcttctttgttatgttatgattctcctgtctgcttcacagactccttctcctcagtttcttctataatgtattaatacatctttctcaggtgttctactggttctcttttattgcttccctacctctctcagaaaactcatctacttttatgctttgaccatttctttaatgtaaataactcctatatcattatctcaaaatccaaccttttattctgaattacaaacataaattttgaagctgcctgagatctctacctggttatcttgctggctcctttaagtcactaaatccaaaactgaagtcatcctccctataaatcttgataccctttcttcttctttctttttgtccttctcccttctcctttctttcttcttcttttccttcctccttccctcttcctcttccttctttcttctttatcctcattattctggtaattaaccattgaaatctgggagtcattttagttgttccttttatttgtttatttttaacatccagccatagctaagtcacagtatccttattcttcgtgaccttttccccatatacacttccacataattttatatgtctgttgcatttgtttaggcttttgcagtttatgcagcatttttgcatgcataatgtcactttttacaaacaacgtgcaaggtcggtatcttttttataatttttattttgggacagcaaaaattaatggttaaaagttcagctttggagccagtctgtctacattctgatcctggctgctttgcttcctggctgtatcatttttgacttgttactcaatttttctgtgcctcaacttcatcgtttaagaaaggggattataatggtacctattttactgggcatttgtaagaaaatatttaattatgttaagagtttatgttgatgctttttatttaataaatgttcgataaacaaaaagttacacagcaggaggttacacattgtaagtgacatattacaaattttaagttgtcctaaaatttatgtcctttgtatccatattccatgcttcacccactgtatgacacatcattgtgccttttaaaaaattctataggagaaattctttatttaactggagactggactaatttatattcagagaattattagaaagcgtaaaactgcaatataatttgtaattaaatacatcatttcacagggtttaccttcttgatgtttataccctgtgctcccaccattcctaaaaagtatttctttaatgggtctcaggaagaacattaaagtaagtatgtatatattcctggatagtagtctagaatgtctcccgagttatgaatatttagatattcatgagtcttgacatctgtcacttggagtattaaaagtttctcgttacccccaaatacctgacacatttaatgattctttgtaaagtttcaagaaataaagtttcctttttatacattcatgtgccagtttatgagggactccaataactgttgtgccataattctggattcttattttaatctttttagggtaattaaattctcttggattttttttttactctctaggtgaggaatttcatttatctatgaatagctttgtttatattgtttaaagttgaatatattatgtttatttgacattaagtaaacattaaatatgtaagatatttgatctgtgataatagcatattttattttaagtctccttctgcactacccaggtttcttactggaagcttggaaatttacttggaaatttacaagtttaggtacaattacgttaaatagactttactgtatatctacatgtacagaacatctcactgtacaaagtaaggcacacaactgaaaagtccttcctacatagtccagatcaaagctctaaaccagaaggaagaagaggagcaaaaagagactatttatattggacttagctcctttgaaataattttcacataacaaccctgtttgtgtgtcgttgaagaagacaaggagccataaagggacgttaggaaatgtctattctctagaaagcagtttatccagctaaaaaaattatgcttttctgactgaaggaaagatacttctcagtcagaggaggggatatttaacttggttaataaagaatggacagaatttctgtaggcaaaatcaggctttgcaagtcaaagaactaactggacagaaggcttcgaagcaggaaacctgggtcctgatcagattattacatgtcatctggctctttgaagcagggtctgcatattgggagatgaagtacaaaagatagcaaagaaactttactcagccaggtgtgaatagtagagatgagcacctccagatggcataatttaagtaatgaaactgttagatatgacaaaaattaaatgcagcacccattaagttactaactatattgcttcacgtctgtgttctttcctttgctatactatttctgtcatttagaactttgtctcctgtagatgtacaaagaatgagttagccatatggaagagtttatggtttacctatatggagggtggtagtttgtaggttgtgacaaaagatttgtgtttaagcgccattatcttaaagatactagattgtttgtttatgtatgttcaacctatatatgtttgaattctcccttttattgccttcaaagccatttgatagcccaattcataactttatagtcacatttttcaaaaatcaaaatcagcattacccagagcaaagcgagagagctgaagcaagcaagtacaaacactgagaaccttttcttcttattgtgggaagaagttcacagtgtttcccaccagctgtcatgctgctatggaacttttttctcctttctttggcaccagtggcctgagaggaagcaagagctgatagcagggaagcagacaaggctaactagctgttggcaggaacctggagcaatagaagcatcatccaaaggcaaaccaatacaggctctttgattaagttataagcaggtagttacgtctctctacttggggagttagagctctgatacagaagaaaggctgtgggagatggaaacctagaaaagtagcagccggctgtgccttgaacaagccttggattcttacaaaaacactccaccagcctggaatgataccagtattcaattaaactgatgtcagttatcaaattctgagtatttaaggaaacatgttcttactaatcttttttatttttttcccctgtggctatgtgctttctttttaaatgtctgtgcttagctcttaaagagtaattgactagggaagtttgttaacctctgtcactatgtgtgtttgctgtgaccacaggaactcactctgacttagcggtagcatatcctaatcataggcaaacaaagtagcacagtctgtcttcactactaaacttttgagtctaaacctaaagttgcaatagccacaaagccacatgtgtagaatcaatttcatagttggctaatttattccttgctttcatatcccatttttctgccttattttctactgcttaaaatggtgtggaatctttcagttggtgccttattcacatgcaaaacatttatacatttttacaaggttctccattagcaaattattttctgagttatttttaacttacttgcaaaaaatctgaattcagtttgaattttataaaataacatttttttccccccaccatttcctttgtgtggctaattttctcccaatagagtattttgagtctcctgttccatgcaacatcaaaatggcctcaaaatgactggtgaaagcccattactgttgctatgaaaatttgtattaagaaaataatatctggttcttacaacattgtgtgcaaaagtataacactcattctcgatttagtctcatttgctttgttcattgtcttatcctcgtcttatatttttattatttattttaaatttaaaaatgtgccaaaaaatggcatataggtcaaagtttgaatagcaacatgaacatttgaaattgcatctcctattagtctggcattcagaaaaggaaacctaacctctgataaatagacaactgaagtgctttatctgttctcttctgatttaaatatttctctccctgatggtatagatatgttcctctttatccaccccctttctaccccattgtactttctgtctgtttttttttttttcttatggctctcatagaaacccattttgcatctgtaaagaaacatttttagacacttttttatctgtctctatacttcaactgggtattcaaaaaaaaaaaaaaagacattttccatgaggaatacatagtctactaatggaagcagacatcattgactttattttttttctttcaacatttatttaataaatctttgagtgtatactgaatgcttgctgtagtagaaataatagatgaaaatacaggatatctgtccccagtctaatagaaagaggcaaaaacaatataaccacacacatacaaaacacagcataatgctatttaaatactttcattagtaaagaaaaaaatatatatccaagtgcaagtggaagcacaggagaacactcaagcctttttgcaggagtttaaaaaaaaaactctgaagaggctaaacagctacaacgtggaatcataacaccaatagtagcagcatatgcaaggtacaaagaaagcagaggtcagtaataaatacacttcattcgtacatttgatagtggaattggaagtacattctttttatagctctttcattaccttccctaatgcctgtacattcataatagatttctagttaatgttgttcaaatcatgtacttagtgccagatacaatgaaaagtacgcagagacatctaagttcgaatactagtcttgatacttcatacctgtataaccttagaaagtcacattactttcctgatctattatctgaaaacagaaataatgttccctcccatattgaagggtttttgtgaagattattttttaaagtaactgttaataattgtagcacaaagcctgtgtatataggaggctctcaataaatgactttgcttttattttaatattgtgattattttacatttcatttatttaaaatcatcttccattttctcaattttaaaaaaaggaattaagagatgtataattacccttcaatacagtaatgctaataagtctttagcatttcaaataaaacttgtttataagtgtgtttatattcattctaccacatttatgtggaatatagaaatctgattttgcacttatggacattgctgatgaagattattttttgtttgtttattttgacagccttcttttttttttttttttttttttttttatataagatagagccttgctctgtctcccaggctggagtgcagtggcacaatctcagctcactgcaacctccaccttccgggttcaagcaattttcctgcctcagcctcctgagtagctggaattacaggtgcctgccacgcgctcagctaatttttgtatttttagtagagacaggatttcgccatgctggccaggctggtcttgagttcctgacctcaggtaatctacccgccttggcctcccaaagtgcagggattacaggcgtgagccaccacgcccagcctattttgacaaccttcttaacattggacctaagaatttacttcacccactatcctgtctttgccttattgatgagaacttaaccaccccaagcaattgtaatcatgtagataacacaaaggattgatgggtttggccagatcaaccaaagttcaagttgaaaattgttttccaagtgcccatagctcattcagctattacttcaagatgttacacataatttatcagggggaggactgggagagcaggggtagagtgagggtatggacccagcatgcttccctagttctaacattcagcaccacattcctggcccctttcagctcttctagaattgggggtatggatatttgtcaccatggcatgattagatggaacaggagcatttgtctcatatcactgtgaaccctgaatatctaagacaggtctcagttcatttagaaagtttattttgccaaggttgaagatgtgtgcccggacacagcctcaggaggtcctgatgacatgtgtccagcttggtcagagcagttttgttttatacattttagggagacatgagacatcagtcatagtaagatgaacattggttcagtccaaagcagcaggacaacttgaaggacaggtgggacaactggaagtggggagggggcttccaggtcataggtagatgagaggaaaatggttgcattgagtttctgcttagcctctccaagggaggcaatcagatatgcattgacctcagtgagcagaggggtgactttgaatagaagcggttcccagcttgtcttttccctttagcttagtgattctggggccccaggatttgttttcctttcatactctcctactactttctttaacttttacagatcctttaagccttcttttgatccctcttgtccagcaccccccatcatgttaaggaaatggatatttttatggttgtgtaaaatctctcctattaaattgtgagttctatgagaacagggatgatgctgatgtatattaagcaattaagcatgttatctgatgcacagatacacttaagtagttctaaagttgtattcttctgttatagttaaacatatgaccactttaacatggggcttagaatatattctttggcttgtatcttttaagggaggagtgtgcaggagaaagacatgagagaacgtggagaccaaagcattttgttttaaaacagtgaatctgttaccagaaaagggtccctatacagaccccaagagagggttcttggatctaggcaagaaagaattcagagaaagtccatagagtaaagtgaaagcaagtttattaagaaagtagaggaatgaacgaatggctactccatagacagagcagccccaagggctgctggttgttcatttttatggttatttcttgattatttgctaaacaaggggtggattattcatacctcctcttttaagaccacatagagtaacttcctgacgttgccatggcatttgtagactgtcatggtgatggtgggcgtatagcaatgaggatgaccagaggtcactctcattgccatgttggttttggtgggttttagctggcttctttcctgcatcctgttttatcagcaaggtcttcatgacctgtgtcttgtgccaacctctgtctcattctgtgacttagaatgcctagtcatctgggaatgcagcccagtaggtctcagtcttattttacctagtccctattcaaaatggagttgctctgattcaaacacctctgacatatattctccctccattttataagagaactcttaaaggttatagagggatgaagatccatcttctgtaacttcttcaggctgaataagggcaatgatattcctacctaactgttaggtctcttgcattcagggtagagaggagctcagtcagaaagcattggtatggtgatagccattcgtaactattgagtgctgaaaaaaaggtgatatctggaagattaataactgtccagtttcagagaacattgagtaagcttatcctgcattcctacatgtggagtaaaacagcgatgtattccaaaagagtaaagtaaaataagtaaaattatctcaagtaaactgaattagaaggctttccatgaactgggcaattgttggaaccaagctgttatggggttgctagccagttccagtgtgcccagggttagaatattgactccagatttttatattactcatcctttttatttcttttgagcagcatccagagatcactggttggtttataggagtaagcagggtcagcctaaattgcaggaaaaaactcaaaaacaaccgatgagactagaatctattaataacaagtgtactatagttcttgaaacttaatttctctctccagtttcccatttttactagagacaaattatggtaagactgatttgctttattatacttggcctgtttatttgtataaagtacagcaagaataattatttttgatataaactttttggttggctttgatggaattctgttgcataaggaatctcagataagacttttattttttaagttgagcccagccttgtgtttgtaacctcagacatctatgagttggataaattcctctactcttgaagtcacaagatagcttggggctcctgggcttatcagaaagtgacattcgttgcttatcactgtgggtcaagaaccctgtacagagactgtgtagacaaggtatgaggccagttttctcaagaggcttttattggctttaaagtcaagctcaattccttaaaggaaagcacaccattctggtcaatgccttgataaccagtttcaccaattgtgtcctgttacaaaaggaaacagattcttattgcacttatgcaaataactgtattaccataaattaagaatacccagccgggggtggtggctcactcctgtaatcccagcactttgggaggctgaggagggtgaatcacaaggtcaggagttcgagaccagcctggccaagaaggtgaaaccccatctctactaaaaatacaacaattagctcggcatggtggtggacacctgtaatcccagctactcaggaggctgaggcaggagaattgcttgaaccagggaggcggaggttgcagtaagtgagatcacaccactgcactctagcctaggtgacagagcaagactccatctgaaaaaaaaaaaaaaaaaagaatactcacaaatagtttccaaattctggagaaattaggtagagagaaacaaatatgtttcaaattttgttcacaggagtatactttacttaattgtcaaaagctgcaagtaggttaaaagaagttaccttgactctgaaaaacaaagcaaatgatcagcaatttttaagcaaaatgtcaaaaaagtttctttaatcttacattagtttagtccatgcagttaactcatcttctgcttgatagtcataaacatttcagctctccatgagagtccttaatgttttttctctattccaaagttattcaaagtaatcagaaacctgcatttaagagcaactatcaaagtcctgtcactgattatgaaacaatcttttgaagaggatcaaaacaacataacaattttctgtgaatgacaaaatcttttagggcagccacagttaaaaacacgattgacaaagaaatttggttacctttctggcatatgattttatgtaacaattataataacatacactaagtcctattagaattagaggagttttacgtaattttggaacacataccaacaacatatttaaacaaatatagcccaaagaaagccaaacactatttcacatgtgacagtgcttcctgtatgatttttgtaccaaataagccaaatttcacctttacattagtgtactattaatgttaaaaccaattcttaataaaactcattgacatgtctacccaaatttaatgtttgaccataaggtgagatactcataaaccttttttaacccttacaatttttataacctttacaattttttgttaaagtgtcgattagtgctctaagaaaaacctgttttgagccaaattccggttgcaaggcagattactccaaagatggttcctagaggggaagagaattaaaaaatggcaaatgtcacactgatatcaaaccagaaaggactcatttcctaagccaggaattgaaccctgaacctgagcagccattgtgacagcagagaccaagagaaagtactgccatgtggttaaaaggtcatctcccaaggatatagaacaagagaagaggagaacttcatccagttttgtttcagggacctgcagcgaagtttgtaaccgaccagttttctgggccattttgaacagcaagcttatggtgtcctaggccaacattctatcctaagatacccctctttatgaccaaacaatacagaaaggcacacaaagcacaccagatttgctacagcttaagattagcctcacagatccttttttcccattaatcaaacctttacagaggagataaacagtgatttttaccattcattcaaccagtttgcccagagggagaaagagagagagagagagagagagagagagagagagagagagagaacaaacgaacctagaagcctgactagtaagaaattcttatccttttgctggcatgccgggcttctgggttcccttgccctgagtggccccagtgacccggctggctgcaccaaagccctggctgccaagctgcaacaaagaggaaaattatcgaatttcccctttgagggaggaaaaagctccccatttcccatggtcctttacttgtgtaattctgtcacctgcaactgtcagcaaagactgcaaagcagattactccaaagagcatagcagttaacatcccatagtgctgaacccgttcttatccgaggactttactaagagggtccactaaccccctaaatcttataaaggactctaacattcctaagttgggcctcgaacccaagttcagtcaagcgtccttgcctttttctgagaggagcctttaaatctgtcttaggagagactctgcctcccttaaattgggcgtctaatgcaatcccactcttcactcgggtatatgcaccccacgtgccgaaagttcgccaattggtacatgcaggtgattttcctttgggttgggggtctctttagtttcatttcttccatggtctgccagaaagatgttactggaccccagcacttacccaaagttagtctttgggtcaggagtttccttagtattgttccttccatggtggccggaaagatgttaccggaaaggggtcctgatccagaccctaagagagggtttttggatctcaggcaagaaagaattcagggagagtccatagagtaaagtgaaagcaagtttattaagaaagtagaggaatgaacgaatagctactccatagacagagcagccccaagggctgctggttgttcatttttatggttattttcttgattatatgctaaacaaggggtggattattcatgcctcccacttttagaccatagagggtaacttcctgatgttgccatggcatttgtaaactgttgtggcactggtgggagtatagcagtgagaaagaccagaggtcactctcattaccatgttggttttggtgggttttagctggcttctttactgcaatctgttttatcagcaaggtctttatggcctgtgtcttgtgccaacctcctatttcattctgtgacttagaatgcctaagcatctgggaatgcagcccagtaggtctcatccttattttacccagcccctcttcaagatggagttgctgtggttcagacacccctgacaaacctggtacagttatgaggaatgggagttaggtgtttgttttttgtttttaatattctcatcaggactgttgcctataatatgagtgtgtacaggtgtgtgtatttaaagtgagagtgtgtgtgagttagtgtgtgtgtgagtttgtgtgtgtgtgtgtgagtttgtgtgtgtgtgtgcatgtacagtggtttctacttttccactggggtatgttcttcagtggatgcctgaaacttcatgttgtactgaaccatgtatacactgttttttttcctttacatatataactataataaagtttaatttataaattatgcagagtaagagattaacaacaatactgcataataacatagaactattataacagtatgccagtatcactacttgtgctttggagccattcaaaataacataaaggtgacttgaacacaagcacagcaataccatggcagtccgtttggtaactgagatggccattaagtgactaatgagcaggtagtggatagtgcagagatgctgggcaaagtgatgattcacatctggagtgggatgcaggaggacgtcacaagatttcatcatgctacactgaagggcatgcattaaaacttatgaattatatctggaattttccatttaatattttcaggccacagttgaccatgggtaactgaaaccatggaaagtgaaaccatggaaaagagtggactggtggaatacaactggcatgcacacacatacacacacacacacacacacacatatgcttgatatcaacaaagaattacataccatttacagtctggaggcaaaagggaggctgtgatagactgtaatgataaatcctgttctcttgagcactgagttctgttttgttggcctcatctagcatgtcatcctttctctcatcttctggatctgatcactatattttgcttctgtacctccagagaaattatgttggacatttaataattatagaggaaaacgtcaaatcttaacaaatatttaaggagactgtttcaggtacagtgcactggagcttgctgtggagaatgacagagaaacattagatgtggccccttcccataaccacactgattagtatcaaaggcagcaggggcagtgattacaagtttattttttttttaaagaaaaatcacaggccctggtttaaaaaattgctttgtgctgtgcctcacactttggtgagttaagtactcactgcaataccagagaaaagccaaagaatttcattttaatgtagatattttcttttaaaagttagtctttagtacaggaaagaggagtaggcgctaacgtttttatattctcattaggactatacattatttttatatacatgtaaactggggaacaataacaaattatgtaaaatccacagcatggaggttttgatatactttaattaattcctaggtaaaattagtatgcattacagtttacagaaaaaaaatacacaaacctgctaatcaaaatgttcagccaacagagctggggcttttttattagttatattgccttgaatttcatcactgtaccagctggcttcttgtcaagttatagtttggacctttacatcaaacagcaaaaaaattaattacaggagaaggagtcccaattggaattttgctcttagaggtttttcacaattaaccagacatgaatggggctgtgtaaggaggaaatggaactagagagaaggaacttggtagacttttttagaatcattaactatagcaatgttagttacgggcttccgtgattttgttttaaggtttagccaaagttttcagatttctcatttctagaagcacccagttctgttactatattgaatgcaatgaatcataccatgaattctgaattctcttagaaagggtcccaagcgatggctcaaaaaatgattatcctctcttcattttgaatcgaggaacattctatctattacactactgatcataatcataatttaatgagcagaacgatcatgctttgatggttagtgccagattacttgtaatacgtattttggactcagaactattgttcttaactgtcacagtcattgcctctgtgcgctacagttagtttaaatgtgacttttctaagcctcttatctgttgaataaaccagccaaaggttttaaaaatgcttcctttaacttagctttctacttttcttttttattttgcttaaaagcccttacttgtgacccattcttctagttgctggcattctaatatagtgaatggttctttcacaaatacagttaatctttggatgcctggagaatccaaagaacacatttctctcctctgaaaaatgcatgtgaacatacatacaacattttgcatgaaatattagaaaatcattagaaatgcatgagccccaagttgtgaacacctgttgcattcattgaggaacatataaatgtattatgtacatatgtgtacctatcatattcatatataatttaggaatatacatattgcttaaattcaaatgctgattcagatcatattgtttgcattctgtcaagtcatctatgctaaaataaatcaattatattatttgccatcacctgaataaatttagatttctgatccatttttatacacagtagcccttatacacagcacccttacttataggctcatttgggtcaccatatttcactgtactgtctgaattactgccatatatcctaagtaatttgtagcccatagctgagaaggacattcttaacttgttttaatgataatatttttcttcattaggtttgtgagctttgagctagtggaagatactaacaggcattttccagttttctctctcaggccttaagaatggttcactattatcccaaggtcactttgaaagtctttctgtgatttgcttccatttattttatgcttgtgtttatggttttgaaccaaatatgaaatttaatgttgcgtttgtctacattaaacttaatttgccccttgtcagctcgtttacaacagagaaaacattcagagccaccctgtagaatgttttgtctacaatcactgatacaatttttctgtctctctttgttgtatgcaactttctatatttttcagtctaaaaagaggcctctctgaaggaacattttcagaaaatctaaatgtctaatagagattaataaatgattttctaataaaatagaatcattaccgtattttgaattttttaaattaaagttctattttctaacttagaaatttaatttcatattacatattatatgaatatgcttcttgagatgctcttaaagtagtgaatttatactttaaaaagataaatgaaataaaagttaaaatataaacaaaatcttaaattgagttacattaccaaatattaccaaatattttgtgtgcttttttctttttctcagatttttctaagtactgaaattaacctcatgtaattaaatttctccatttaaaaattagttactttttaaaaataatttcaacttttattttagatgcatggggtacatgggcagtttgttatgtggatatattgcatgacactgaggtttggggtgtgaatgtctgtcacccaggtggtgaacatagtacccaataggttgtttttcagccctccctgctttctctctcctgcctctagtagtccccagatgaattttttcttaatgcttactaatttttcaataccattatatggtattgaaatgacaaatattttaaattgatgtatcttagagggcactaaaatgaaacattaaatatacatgatgaaaaatacttttaaagtagaatcctaaacatatacattaagaaatataatttgtgtgttgaaaattattttcaggagaatctactaacttgtgcctgtatcttcgaatcatgagcagtgttcaaaacttgggaaatgtttgatcctagaatatctgctgtttacctttgagcagatattatatttattcagtttatgttagggaaatatcagacaggtgtacaaagatacatataaaagactggtgattttttataacacagaaatattagaaaaagtcaaaattaccaacttaaggtgattggttaaataaaatttcattacatggtccacaatggaataccatcatggagatgcatacctattgatatgcaaaatgctcattttaaatttcaaaataatatataatgcaagtctatctttgttcaaaaacaagttgtaggtagttggtagataggtatgaatgtatgtataggtatcaatatagatatagatataaatatacagatgtggatatagacaaaaataaatacaatgtttatcaaaagaaaaacagattattttgtaacatctgtgtgtgtaattgtgatttttaaaaatatttctatgagtggattacttaataaattaataaataaaataaaaataaaacattgtaatagaagtcaatatttattaagcacatactatgtatcgtatatgcttctaaataatttacatgccttacctatttaattgtaattatgctactcttcagtccttattatcttagcctgtttgtcctgctataacaaaccaccatagactgggtggcttaaacaacaaaaactatttctcatagtctggatgctgggaagtcctagatcgaggcactggcagatttgatatctggtgatgccctatttcctggttcacagatggctgtcttctcactgtatcctccacagcagaagaaacaaggcagctctctggggcctgttttataacaacattaatcctgttcatgagggctcaaccctcctgaactaatcacctcccaaagccccatcacctaaataccaccacattaagagttaatatttcaacatatgaatttgggcgaggtggcggggggggcaacttgcagcccatcaccattatttatgctgtagattataagcatgtgaatttttcacactggaatgttagaaataaatgataataatgtaatttcacatttttatggagtccatgaaccctctgaggctgtatcgtggggtgggtgtgtgtttgtgtgtgtgtgtatgtgttttcctggggagcagttacttagcttttaatcagattgtgcgatgagttaatatcgtcctctgatagttttagtcaaactcaccattcatttctgtactattgaaaactccactacaaagtcaagatactaacagcaagcaaaactatacagtgaaaatgaatttgttgttttcacctcattaatctacccaaggcagttggtaaagatagcaagcagcaacagcgtgacctcaggtcacattttcaagcaggctaggaagaaatgggagttggggaggtcatcaggtgccaggagtgttctagccagagcagaactctacttttagatagtgcctaaaatgttaattttaagtggtatataatcaactgtcagttaaactacaaataacctttgagagcttattcagaggctttgcaaggtgaacatgtagaatagtgaggctttcatgagggtggatataggattcctaacatagtaatctgatttacccaatcagtctgtgtcttgtaacaacattattttcattttcaattctgtcttttaagatctaaaacagtagatgattcaaagcacattaatacttggctttgggatatatgtttgtattattaaaatatgaataaatgcatctgtgcagaacttcagcactttaaagaaaggaataaggccattccatgaaaacctgtatgaacaagagccaaatagctagcaaccctttggattcatccttgttacctgtatgggcagctggttctctcctcagaatgatgattttacagatgaggaaaccaagcactagagagattaaattgcctatattcacatcacttataagtggcatagctgtgatttaaacccaagtcttgctaacttggaaatctgtatccatgggcatcatgttgtctaactgactacttttaaaatattatggagaagttgataaactgtagattccagcctactaatcactccagaagtaatgtatccatatcattgagggtaggggtgaacatttttaacagccttccttggtgattctggaatgtaatatagattgaaaagcatagctttacaccatcttatttctgcatcagaggggagatcatgtagcaagttcttatttatgattttatttttcggtagcatttaatgctactgaccaccatccttgggacttttcttagccttctatgttttcttctaatgtcccctttaccctgctaaccattgctctcagtcttccctaacatggcttctttctgccttcagttccttggtatgctggccatggcgttttttctctggtggctctcattatctttgcttattgaggctttataaattactctttctccccacctacaattctctcttgagtttcagtaccttatttttatcgttcttctaaatctacagatgctgatgtttccttcgtgtcttaaatttagcaggcctaaaattgaactcattatcttcttaccccaaactttctgtcaccgttttcctctagtgtagttaacactgtcactactcagccttctgaactcaaaacttcaaaattgcattccgactttccttttcctcactgtcgccattcagtcagtctgtcatcaaatcttgttatttccatctcagaaatgccatttgaatcgatcattcttttctgtgtttccacagaatctcatcatctgttatacattggattccataccagttttcctatcattcaactttccctgatatccagtcttttttccacatggtaccagagatattttaataataaacacatttggaattctcatttccctactttaaaatagcctttgattccctaatgcctgcaatataaggtacaaaatgtatacggttcatcctaatgatcctgctttatctccttaccacaagtcttattttgtggctaaactgaactttttactacatctcactttctcactctgatgcatttgtgcatctgatacatacctggaatctctgtccaggtatgagaagttggtcattcttagccctgtatttccatagaatttacttgtgcacaacatgctatggtagtaattaagagtcagggggctgaaaccagactaactgggttcacaggcccaactccttaattactgtgtaacatctttgtgcctcagtttccttatctgtaaaattgaaataatgatattacctaccttagacaattgtggaagatagggttaattcatgtgcaatgcctacaatcgtgcctggcacataataaacagaaattaagcatgtgctgctgcttctactgtcatcgtgatgacaatgatgtgacagtctccatggaagagggctaaaggaattgtttattaatactgggatcaacccagagatccacggctgtcccagaagaaaagtattttgcctatgggaagcctggatccagtttgtaggctaatatactatcgctacctcatggcatttctagtctcttgtaaatcatccactagttaaaatcccgctagtccttggattggtatgtggacatatacttgttcccagactggaaatcccttcattatcagtaaagattgctccaattgcaattctgcaggtacattattttgctagtttcatggttgaaggagtaagctgtgccatcggtataccttgggctgatgtgaatcagactttagacctagacaggacctttaaatatagcagagggacattccttgtgtcaatttaaagcatcctaatatagcctcataaagtcggctctctgctatgacacactgtggacaacatcataagaaatattatcatttagactgaaatttgaattgagcaaaatgtttgtagacacttattaatttttaagaaactgctatacacctatttatttggatgatatttttatttggatgaatgtggtcctgaaaagttaaatgtaagttgcagaatttcttagcataaagttcactatttaaagcacctctgcagtaaattattttgaattacatcctagcttattagtttttatttattataatattaatatgcagtgtatttgaagtaggatacgtttgtattggctatgatactttctaactcattggagaaatttataaaattaattagaaatttgcggcattaattagaaatttgtagcactaattagaaaatcacagcaataattaattgtagcacatgaaagaaaagtttggaaagtagcatttaatttttagggaaagaaaagaaggcttaaagtagaaattgaacttaagggtaacaataaaaaccaatcggttagatgactaatatctaaaattgattctcaaaatggaaactatgtatttgttactgttttattttatttttaagtttattgggtttctggttctgatcattatagtgagagataatattatatagatccccagccaggggtctcagctaaacacacagaagaataagcataagcatgcaggcacacttgaaatgaaaggtacacactctagtagtaaaaaatagatctgaaaaagaaatacggaaaattcataataaaagtaatgacctgagtttccttagcacctgaagtttacaagatatttgcctaatgtgatgtggtaggaaaaactggattttaatgagaggaactcaattttaatggttgctttcccactatgtgaagttgggcaagtctcttaactggccagagctttggatttctcatctgtgaaatgaatataatagagagttcctttgaggatcaaaaaataacctacatacaaagcctttggaaattgtcaagaattgtacagatttcagagattatagaaatagatatttcagaaattactctgagatcgcagagattatttcagaaatgaaataagtatgacattgataattgtcttcagtttgtgcttgaggaaaccaagatgtgcaacaagtaatgagcagccaaactgaagctggaccctgggcttctgagtccaaaggtggtacttcctgtgctagaccgtgctatttttgagctacacctgtacatcattcacaggacacaggtctagtaaatgatagcctaaactaaatttaaaaaacattaaaaacatataattattgatttattattagtaagaaattctaatattaataggctgatatttgcatgtgttttgtaatgcaggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggtaagctcttcactctggatgctgtgttttagtcaccaatgaggtacatgcctagaatggcaaccaatttaaatctctatgcagatcttttaaacagcaatttattattcagtgtctagtgtcctgtaccatacttcaggttgtcaaaacatgtcactgaagtctcttcaattgataatgaaaatcttaaacataatgccctgcttagtttcctggtttgtttgttactgtttaaatttagtaatttgtatttttattggttaaaataaacaataaaagctctgcagggaacccattttggaaattgctgtggaaacatcttaattgtttggaacacttttttatgtaaataattatgctgtcataaagaaactactttgacaacatgtaaatttctttattcatttttttttctcttctttagtggcctctaacttgtcatttcaatagatgccattatacctgcatgctgttttgtatttttcatgagcctgtctgtcctctggaattaatgtctcagttttcaacaaattttagaaaatgtaattaacaagtgaaaattttatacaggcttcttttttcctggcaaaagttaacatataatatgtcttcgttataatccatttactttatactggggctgtttgaaattactgttgatgtgtttttactttggtgtctatgattcttttttttttaatggctgaacaaaggtatttatatattcagtaagatttgttccatgacacgaatgccctaatcacgtttattagtaatgctatttccagaagagagagcaaaatgatgctccttttcaataggaacaacgttgaataccaaaaggcaccctgtttactctagagctgtagttcacatttctaaattaccaagagtggtgctgcgggtatgcatggcaataagtcctctcaaagctggggctgagtgagggtggtgttgaaaaagccaaggcttttcacagccaactgtaaatacatgatgatgaagaaaagaagagagtttacagatgtaatttcttttcagaccttatctttttattaagaaaaaaaagtattgtaattgactttaggttgccattgaatctgacaaagttgggtaaaaatgtaaaatgtttaagagaactgtaatttcagaaactacattaaaataaaaatgttacattaaattttgaaaagtaattttatgtacctaaccgcattaagctggagactaaaagtcttacagaaaattcacttataagtagatctaatatatacaaacgaacactttgtagtatgtataggtaccatggttttacttaaaacctgagccacaacactgtttctctatttgtgctatgagggtagcaagtggctggtgagctttgtatactccactaaacaatttttgagactgttcttggctcacagttaggtacagcaaaattgtaacatgttcaaaaaaatatagtgttctgaaatactcatttttggtttaataaccagactattaagaaagacaaaaaataatgtacttgtagcagcatctaggtattatttaaatgtaacatgtgtgctaattcttgcaggcctacgtgagtgaaaaacatgaaggcaataagatcattgcttttgaaagagcaggtcttcttttcattttcaacttccatccaagcaagagctacactgactaccgagttggaacagcattgccagggaaatatcctttttgttaccagtgaatatgactgtccacattcacttctttattacattataggacaaaaaaaaaaaaaagactaaggttgatcttgatgacagaaacattcattttcctcatctgaaaaatgaggaacttaaaatagttgatggataaatctttgctcgactcagttatactgaattattcctaagcttcattttgggtttaaacagaggggttagtgcagacgtggttcacatcaaaggaaagagctgtggatcttgctgtcctgaaggtttcactatggagccctgctctccaggtccccacatccaccaatacagaagacaataaatgaagtcttctgagataatagcagaggctctggacttaggggaccaggctttaaaaagtataactgaatatttcttaaataatatttcttaaataatatttagagcagcaatatgggagacgattgtagttttactctatgaaaatattttgtaagttacctctgagacttgtttcttttcctccactcagtgggagagagcaaacagtagttgtaatgatagtgtccttcctttttctgtttcttctcctaaaattcaagacacagcatacctttgtaggcctgaattggtaagaaggcaaggcaggggaggtgtgagcagtagaaataaccagggagaatgtttttgatgttctctatgtattcatttactccttttttcatgcattttacagatacttactgagtacctatttactgaacaccttatagatacttactgagtacctatttactgaacacctctgtgacagctctgagctgattactgtaaatataggaattctcctagcagatacagtcactgccgtcatagagcttttaaactagtaaagaagataaatattaggcattgtaagtttgataattattacaaaggaaatgtacagtacattttaaagacatgttactagatccatgaaaaaaatgacagattcaggacctagcaataaatcagcacaatttttcaagcaggcaatagaaataatgtgcttgccccctgaagccctaacaatgattagcatctgccacctgagcaaggtgcctgatgccaacatgaagtcctatgtgtcagggtggctccagctacaataaagaaaccctcctactcagctggctcaaataataaggaaaatgtatttgtcacataataaaaaccctaacgtctagtttccccagcacttgtgacagtatcaagttccccagttcattctttttgctttcaattctcagggtgccagcaatgtccaaatggtggcacctgttactaatcattagataagagccatgactccaagtgtcacccaccttcagatacaacaaaatgcaaacagatttttttgtgcatctcttcaagaataaacttacttctttagcaaaatttctttcatattttattgaccagagttgggtctcacatctcccagaaaaattttctaggaagaagaatgatattaacatgagtggcttaatcaggaattacccctgagtctcaggaagacatcccttgatgaagtggacacccagacagaattttactctgacagtaagaagaaaacagacagtgctttttagtaagtagcctgcagcatctgtcaccaccccatgctgctcagtgacattgagggcaaagagagatggttccctactttcttcccacccagccaatcactgttccacataacatcagagcatctaggagaggaggctgtagttgtgactgatagcacaaatgtgctccagttaacccacagaatgcgctgtgttgtctgtctctttatgcctacagataaatcaatgtgatgggttatctacactaaagaagtacagtactattctgggaaacaaatgtcctcttcatttccatgaggaaatccaaacaaatactagacatgtagcaatttgtgcgtgatccttctcacctccagagtgctaaagtaatgctcctagactaaacccttctatacttggtagtgcaatataatcaaaccaaaatacatttacagaatactagtatctacttcaatctttgttatatctttgcagcgctttccttgacccttaagtggagggaaagagatgtataaaacccaaactgcgacgtaagtcttaatgcaataaatggaaaaggaacaaggagcaagaatgttccatgggagaacagaggacaagaaaaatgaaaaaataagtggcaggggaggaggggagagataacgagattaagacaaagacttttaagcctagacttgggaaatggacaagattatagcaggaacaaatgaagaaagccatttcagctattagaaatcgtagactattcttagataatggacagtacaatggattaattggagaatgatgactatagaaagaagtattaagagataaagctgaaaacagatggagatcacataatagaagattttaatgccatattaattagtcttttttctatgattttatagtgagttgctgcaggtttttgactagggagctacttgataagaatgtaggctttagtaaaagttctcatgtaccagtgtgtaagggagctttcatgaggaaagagattggaagtacagatattaattatgagaaattgcagtacacctaaaagataattagggcatgaactaaagtaatgtcaatagaatagaaaaagtatacgaaaccctttcttatagtgaaggaactcagaatctgtttgaacatggagtatagaagggaaaatgtaaggtttcactttgaacaatagaaagtatgctggtggtattattcctgaggatagcaaagccaggagaggcagccagttgcgggagtagaaaatataaattcgtgcaagatggttgaatagaactctccagccattgtcctccctacaggaacaccaaattgaacaattatccacacaagaaagtacattcataagaaccaaaaatcaggtcagcaatcatagtacctcattttaacattatttcaagcaaagaggcacagaagagggtaagaaagacagtcttgaattccctataccaaccctcccccaccccttggcagcaccacatggcacatggaagaagagaatctgtttgcttaggggagggaaaacacagtgactgtgggactttgcattggaactcattgctgccctgtcacagcagaaggtaacatgggcagaattcagccagcacccgcaaagagagccattagaccagccctaggcagagggatattttctgctgtcccagcatttggaacctgagttccagctagacccaacactgcacactaaagtaccctggggttccagataaatttgaaagtctagaccacaaggactgcagttcctaagcaagtcctggtgttgtactgggcttagagccagtggacatggggtacacaagaaaggagagggaagagtaaagaggactttttcttataactcggataccagctcagccacagtaaaataaaacaccaagcagagatctgaagcccctatttcaggctccagctctcagaagacatttctagacccaccctatgccttaagggaacttgcttccctgaagggaagaactcagtcctggcaggattctttaattaatgacggaggaacacttggaccttgagtaaacatcaacagtagccaagtagcaattgccacaggcctttgatgagacccagaaccatgttggcttcagatgtgacccggcacattcccagatgtgttggccatgggaagagactcctgcctgaggaaaggagagggaagagtgaaaagggctttatcttgcaacttggggatcagctcagccacagtaaaagaaaacaccaagcagactcctaaagcctccagttttaggccttagctcctagctggcatttctcaaccttccctgagccagaagagaacccactgccctgaaaggagagacctagttctggcacgattcaccaactgctgactaaggagcccttgggctttgaacaaacatcagcagtaaccaggcagtgggtgccatggccttggggtggtggtggccatggatagagaggctccttctgcttgaggaaaggaaagagaagagtgaaagggacattgcttgcaatgtgggtgccacctcagccacagtaaaatatggcatgaagtaggtttctaaagttcctagtgccaggccatagcttcagcatggcattcctagacctaccctgggccagaagggaacatactgccctaaagggaaggacccaggcctggcaggatgcaccacttgctgactaaagaacccttggcctttgaataaacatcactggtacccagacaatagtcaccagagactttcggtgaggactagtagtgtgctggcttcaagtgtgacccagcacagtcccagtggtgttggcaatgaacttgcttgcatcaccccttcctccaattccaggcagctcaggatagagtgagagatgacctttgtttaggggaaagtaaaggaagagaacaagagattctgcctgataatccagtgaattatctcagatcttaactaagaccatcaaggtagtacctctatgagtcaacaagagtggagccccttaatacggataccactgcaatgaccaaagacttagatcacaacacccaagtcttcaaatacttagaaaaccttcccaaggatcagtataaacaaggctgacccatgaaggctacaataaatacctaattattcaatgcccagacactggcaaacatccacaaacatcacgaccttccaggaaatcatgacctcaccaaacaaactaaataaatcaccagtaaccaatcctggagtgacagagatatgtgacctttctgacagaaaaaaaaaaaaatgaaatagcaattttgaggaagctcgtgaaatgcaatttaacagagaaggaatttagaattctatcagatgaatttaacagagagattgaaatgcttttgaaaaaatcaagcagaaattctggggctgaaaaattcagttgacaaactgaagaatgcatcagagtttctcaagagcagaattgatcaagcagaagaattagtgagcttgaagacaaggtatgtgaaaatgcatagaaaagacaaaaaacaaaaaagaatgaagcatgcctacaggatctagaaaatagcctcaaaaaagcaaatctaaaagtgattggccttaaagaggatggagagagagagagagagagactgattcattcaggtagaaagtttattcaaagagatagtaacggagaactttccaagcccagagaaagatatcaatactcaaggacaagaaggttgtagaacacaatgcagattttacccaaataatactacctcaagacatttaaaaatcaatttcccaaaggccaaggataaagaaaggatcctaaaagcagcaagagaaaataaacaaataacatacaaaggagctccaatacatctagccgcatacttatcagtggaaaccttacaggccaggagagagtggcatggcgtacttaaagtgctgaaggaaaacaaaacttttatcctagaatgttatatccagtaaaaatatcctccaaatatgaaggagaaattaagactttcccagacaaacaaaagctgagggattttgttaacactaaacctgacctacaagaaatgctaaagggagtacttcagttttaaagaaaaggatgttaataagcaataagaaataaccttaagtcacaaaactcgtaataataagtacacagacaaatatggaatatgataaggcctcaactgtgttgcacgaactaactacaacagctttttaagacatagacaaaattataataagatataaatacaaacaaaaagttaaaatgctggcaagatgaagttaaaaggtagagtttttatcagtttttctctttgcttgtttgtttttgcaatcatagttaagttgtcatcagtttaaaatagtggattatatgatgttacttgcaagcctcatgagaaccacaaatcaaaaagcctaccacagatagacaaaaaataaaaagcaagaaattaaaacatatcaccaatcaatttcacaacaaggaagacaagaaggaagacaacaagacaaccagaaaacaaaaaacaaaatggcagcaataagtccttatcagaaataacattaaatgtaaatggactgaactctccaatcaaaaacagagtaccttaatggataaaaatacaaaacctaaatatctactgcctacaataaacatgcttcacctataaaagcactcatagactagcaaataaagggatggaaaaagatattctatgcaaacagaaagcataaaacagcaagagtagctgcatgaatatcagataatatagattgtgagacaaaacttataaaaagagacaaataaggtcattatataatgacaaagggtcaattcaacaagagaatataacaactagatatgcaccccacactggagcatccatatatataaagcaaatattattagagctaaagagagagatacacctcaatccaataacagctggagacttcaataccccaccttcacctttggacaaatctttcaggcaggaaatcaacaaagaaacctgagatgtaatctgtgctatagaccaaatgcacctgatacatatttacagaacatttcatccaacggctgcaaaaggcaagttctcctcagctcatggaacattcttttgttttgttttgttttgttttatgattgtctttttttaaaattatactttaagtttagggtacatgtgcataacatgcaggtttgttacatatgtatacatgtgccatgttggtgtgcttgcacccattaactcgtcatttaacattaggtatatctcctaatgctatccctcccccctcccccctcctcccaccccacaacaggccccactgtgtgatgttccccttcctgtgtccatgtgttctcattgttcaattcccacctgtgagtgagaacatgcagtgtttggttttttgtccttatgatagtttgctgagaatgatggtttccagcttcatccatgaccctacaaaggacatgaactcatcatttgttatggctgcatagtattccatggtgcttatgtgtcacattttcttaatccagtctatcattgttggacctttgggttggttccaagtctttgctatcgtgaatagtgccgcaataaacatacgtgtgcatgtgtctttatagcggcatgatttataatcctttgggtatatacccagtaatgggatgactgggtcaaatggtatttctcattctagatgcctgaggaatcgccacactgtcttccacaatggttgaactagtttacattcccactaacagtgtaaaagtgttcctatttctccacatcctctccagcacctgttgtttcctgactttttaatgatcaccattcaaactggtgtgagatggtatctcattgtggttttgatttgcatttctctgatggccagtgatgatgagcattttttcatgtgtcttttggctgcataaatgtcttcttttgagaagtgtctgttcatatccttcgcccatttgttgatggggttgtttttgtcttgtaaatttgtttgagttcattgtagattctggatattagccctttgtcagatgaatagattgcaaaaattttctcccattctgtaagttgcctgttcactctgatggtagtttcttttgctgtgcagaagctctttagtttaattagatcccatttgtcaattttggcttttgttgccattgcttttggtgttttagacatgaagtcctttcccatgcctatgtcctgaatggtattgcctaggttttcttctagggtttttatggttttaggtctaacatgtaaatatttaatccatcttgaattaattttaatataaggcgtaaggaagggatctagtttcacctttctgcatatggctagccagttttcccagcaccatttattaaatagggaatcctttccccattgcttgtttttgtcagatttgtcaaagatcagacggttgtagatatgcggcattatttctgagggctctgttctgttccattggtctatatctctgttttggtaccagtaccatgctgttttggttactgtcaccttgtagtatagtttgaagtcaggtagcgtgatacctccagctttgttcttttgacttaggattgacttggcaatgcgggctcttttttggttccatatgaactttaaagtagttttttccaattctgtgaagaaagtcattggtagctggatggggatggcattgaatctgtaaattaccttgggaagtatggccattttcatgatattgattcttcctacccatgagcagggaatgttcttccatttgtttgtatcctcttttatttcattgagcagtggttgtagttctccttaaagaggtccttaacatcccttgtaagttggattcctaggtatttgattctctttgaagcaattgtgaatgggagttcactcatgatttggctctctgtttgtctgttattgttgtataagaatgcttgtgatttttgcacatgattttgcatcctgagactttgctgaagttgcttatcagcttcaggagattttgggctgagacaatggggttttctagatatacaatcatgtcatctgcaaacagggacaatttgacttcctcttttcctaattgattaccctttatttctttctcctgcctgattgccctggccagaacttccaacactatgttgaataggagtggtgagagagggcatccctgtcttgtaccacttttcaaagggaatgcttctagtttttgcccattcagtatgatattggctgtgggtttgtcgtaaacaaagacacaacataccagaatctgtgggacacattcaaagcagtgtgtagatggaaatttatagcactgaatgcccacaagataaagcaggaaagatctaaaattgacaccctaacatcacaattaaaagaactagagaagcaagagcaaacacattcaaaagctagcagaaggcaagaaataactatgatcagagctgaactgaaggaattagagacataaaaaacccttcaaaaaatcaatgaatccatgagctggttttttgaaaagatcaacaaaattgatagaccgctaggaagactaataaagaagaaaagagagaagaatcaagtagatgcaataaaaaatgataaaggggatatcaccaccaacccccagaaatacaaactaccatcagagaatactagaaacacctctgcgcaaataatccagaaaatctagaagaaatggataaattcctcgacacatacactctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaggacaagctggtaccattcattctgaaactattccaatcaataacaaaagagggaatcctccctaactcattttatgaggccagcatcatcctgataccaaagcctcacagagacacaacaaataaaagagaattttagaccaatatccctgatgaacgttgatgcaaaaatcctcaataaaatactggcaaaccgaatccagcagcacatcaaaacgcttatccaccatgatcaagtgggcttcatccctgggatgcaaggctggttcaacatatgcaaatcactaaatgtaatccagcatataaacagaaccaatgacaaaaaccacatgattatctcaatagatgaagaaaaggcctttgacaaaattcaacagcccttcatgctacaaactctcaataaattaggtattgatggaacattcttaaaaatagaccatatgttaggccacaaaggaaatcctaaaatattcaaaaatattgaaataatatcaagcatcttctctgaccaaaatggaataaaaccataaattaataacaagaagaattttagaaactatacaaacacattcaaatagaacaatatattcctgaatggccgtataccaatgaccataccaatccaaggctaggtcaagaacgaaattaagaatccctatcaaaataccaatgatatttgtcaaataaatggaaaaacaatcctaaaatttacttgaaatcataaaagacccagaatagcaaaagacatgttgcacaaaaagaacaaaactggaacaatcacattacctgacttcaaattatactacagagctatagtgaccaaaacagcatggtaatgccataaaaacagacacaaataccagtagaacagaatataaaaccagaaatcaatccatgtatctacagtgaactcattttcaacaaaggtgccaagaacatacaatggggaaaggacagtttcttcaatagacggtgctgggaaaactggatatccttatgtggaaaaatgaagctagatccctatctctcattatatacaaaaaacaaatcaaagtggattaaagactgaaatcttagacatagtttatgcctaaactaagcataggcaatcaaagcaaaaatgtacaaatgagatgagagcaagttaaaaagcttctgcacaacaaaggaaacagggaagagacaatccacattatgggaaaaatatttgcaaactgtccatctggcaaaggattaataactagaatacataaggagctcaaacaataggaaaaaatttaataatcttatttaaaaatgggcagaagatctgaatatacatctcaagaagacatacaaatgacaaacaggtgtatggaaaggtgctcagcatcactgattgtaaaagaaatgcaaatcaaacctacaatgagaaatctcaccccagttaaaataacttttttccaaaagacaggcagtaacgatcctggtgaggatgtggagcaagtagaaccctcatacactgttggtggggttgtcaatcagtacagccagtatggagaacagtatggagattactcagaaaagctaaaaatataactaccatatgatccagcaatcccactgctaggtatacacccaaaagtaaagaaatcagtatatggagcagatatttgcgctcctcttttattgtagcactgttcactatagccaagatttggaatcagcctaagtgtccatcagtacacgaatgaacaaagaaaatatagtacatatacacaacggaatactattcagccataaaaggaatgagatcttgttatttgcaacaatatggatggaactggaggtcattatgttcagtgaaataagccaggaatagaaaaactaactttgcatgttttcactcatttatggaagctaaaaattaaaacagttgatctcatggagataagagagtagaaggatggttaccagaggctggagaagggtagtggggtagtgagagggaaatggaatgcttaatggctacaaaagcatagtttgatagaatgaataagacctaatatttgatagcacaacagggtgactgcagtcaacagtaatttattctacattttaaaataactaaaagtgtaataggaatgtttgtaacacaaaaaaaggataaatgcttgagatgatggatactctatttaccctgatgtgattattacatattgtatcctgtatcaaaatatctcaggtaccccataaacatatatacctactatatacccataacaattttaaatttaaattaaaaaatcattttatcattgtcaacaaatggaaatgtatagaattttccatgatgatatttaggagaaaaatcctgggtcaagctataaggatctatctaaaatatattaatatattaactttaacaaatattgaatattatgaaagcatacataataatatatgtattatatatattatatagcatagtgtattactgtgacccccataagtcagcaagacccccaaatgttagtttatatatactgacacagaattacactgtatatgaaagcctggttcggttttgaaaatcttgacacaaattgggtcttctgaaatttagttatctgcttaaatgtctataggtaatttttacatgaaaattttctattttaataaataaatactcaatgtttttacattagtcacctcttctggaagctatactagttataagttgcaatgatacagacattggaaaactgagtcgtctctttatagaaattatagttgaatcctcagtcatctaattggtctccaagagaaccatgaagaaatattgttgacctatttcccacattttgcctgttacagatttgtgcccacttggactttaattattcttaccacccatctcttccatgtctttctgttaacaagtagtaaattcacatacattattgctttttctgagaatatttgcattttaataattctctttgaatactcacaaagtattgaagatgtaatggtctaaataggtaatgggagaattgtatcatgttttttactttatatattttaaatttggggggggcaggaagggagcaggagagcatttccaacataatttacaacgcaccttctaattaagtatattttaataacaccagccataactctgagactgaaatcacaacatcttccttttgtgaggtactctgctccaccctcccagttcagtgcagaagtcccatctagaaatttcttacaaataatcacctgttattcgaatactttgcagtgctaagaatatcactgtttcacaagataaacagtattgttttttaataaataaaaatgttatcttaaaatcaacgcattagttctgtactctgaggctaacacctgttctatgtgccagctattcaaatcagaaaggcatttaacatgcttcttagattaccacctctccctgctttttcctcttccagaccagatatggctagtttcttaaatcgattctcatgatactttccagacctcttaccattgcatctcccttattaaaatgcacccagcattgttcacattcctcctacactaacagcagagtattctagatacggtctggcaagtatgacatacagagccccattaccttcctttattttgatgctgctctcttattcatggagttaaagttgcattagctttcctggcagccatcacattttcctttcacattgtatttccatccaaacaaaaatcttgggtttttcttttgtatcctagtattgtgtcatatcttcctttttctttatttattcagttaataatttcaacctaaaatcccaaatttaacattaaacttggaaaagtacaatattaactttgaccctctaacctattagaaaagataaaagaatattacaggacaattctctgttattaatctgttaggattgtagcatctcccataaccagcaaatggatctcttcttttaactttttgttgttccaagcttagctttaagagtcctttttcttctcccttgcattttttgtctcattttggccttttatctttctgactttattcttgtacttttaacctacagtgtagttcaatattatagaatgaattcagatatacaaaatattaaaaattaggatttcaatggtatattttctgtctttagcaaaatattctatgccattggtatttctaactactgagcaagtgaattgaatacagatttttactgtgaagagtctaccatggcaagattgcatgtgttaatcaagtaataaaattcatcaaatttttaattccctgggaagcaggatttggtgccagaataaatttaacttttctaaagaagccacttaaacttcctctgtccctaggaaatataaccctgctataggtaacatgtctgaatttttgaacaggttcaatttttttgaacctgtagatcttgtatatcaaatagcaagacatcaattttcactcaaacctgtggagaatagatggtgactgccatcccaaaaactgttggaaggggagctgttttggaggtaatgccaggcaaggtagaagaaacactaaggatgcttttaactatctcttcaaaataagagaatacgtttggaaaactgagaggcaagactgatttgtatcaataaagctttgaatgtggccttcatggtgactaccaaaggacatcttataattgtttctgcagtagaatctacagccatattctaggaaaaaaatcaagaaacaaaacgacaacaaaaaccttttgcctgtatactctcacatttgtctttttagctgctaatcttcagtgtaataatcaccaatattctttaatgcaatagatagaaatgtgggtaatgctgagacctacatgtacttaataaataggcaggtttcatatttcatgcttagaaagataaaatacattttcctgatgtattatattcacttaagttttcacattgtttagctgtaaagaaagaaacataatgccttttatatcatcagaatcattattatatttctttagtggcatttcttcacctagaacattatcaagttggcattaaatcagaaagaatactctgttcccaagaccagagtgctctttctaatgcatttgaacaatacaaatgattataccacattttaaatgatgtggggagaatgtgagtattagggcccctcttttgtgggccttctatttgctaatcatttttataaagtattcagtttaatatagtatagtaataatgaaaaagtttgaaacgttgcgataattaccaaaatgtgatgcggagacatgcagtgagcatatactgttagaaaaatggcaccgacagagttgcccagccagggtttccacaaactttcaatttgaaaaaaacacagtatctgcaaagcacaataaagtgaagtgcacaaagcaacttgtgactgtattttgggccacactataaggcacgttgtagagactgaggcctttaattaactgaagccttccctccagcccatggcaggtaaaggttaagcagtgttttccatagcccatattctttctgttacaccctggtgcctctttctgttcctggagtatgtacatgtggttgggggtggtagcaatggtggtattattgatgatttatttctgtaatgttcaaaataattttgaaaatacttctgggaatataagtagaataagaaaattacatacagacttgtggcccaggcaggtttctttctaatcaactcacttttctcactgccctgccataacctctgacaaattcttccccagaaattcttcttggtgatcttgtttgccatcttccacaagaagaaaaataattttaaagcaaaacttacatgtgaagttcaattattgtgatttttttttctgtattctagagtagaatatgaatgtgtcatggttctattttcagagttaaactgatgtattacatcagtttaagttaatacatgatatacaatagaaattttaaccccccccagcttatttataaagtgtttgtgttggtatatacagataaatatcattctgagaccataaacaacacaagaatcaaatgtttaaattatttatcagcatacttttgaggtgggagtggaaatgatagtgtagtaacagccccctttccaaatggcatttcaaactgttacaatgttgtgacgttaagaggagtgttcatgaggtatggcttgtgaagaatatgtgaatctaggactaaatctttaaacccaagagagcagaggtataaatagttgaatttgacctgagatagttgaaatattttcattaaaccactgcaagatgcactttttaaaatgtaaattcatactctgacatttgcaacctgtacacagagtttctaataagcaaataaggtcacttggatgatttactgcagtgtgattgctgaaggcagagatgttgctatgagttgcttggtttacagaaggctttgaagtgtggtgatgtaacactgtgtttattagaatctatgctttttgcaacaaataaaaacaaaggacttaatttaggattagctaactaccacattctatccagattatatatgtaaaggataatttctggtctgactaaatagagcatctcaactttctagttttccaggttttagatactttggtaaaaaagcaaattcagggttttctccagaagttctacacagtgactttcaccagatacaggcatgtttctttttcctttatgttatgctgcaatttattgatgatgagctttatgagagctgagacagatgatcctactaacaattttatatttaatataggtcctccttttttaaaatagctttataatggatgcatgctcattgcttaggttcactttctttagttttgaaatgactaatacttttaaacatagaggtccttttgatcattttttcattgctaaacactgtctaacaatccctatgatttaatgataatgacagaccagtaccctcacctccctggtcataaaaagcctatgatttagcttcatttctctacccaggaattagggatgaatcaccaagtaagaaaaatattttgcatgattaaaatattgcaactgctataacacttttagattgccttaatatatattcataagattataggcagtaatgaatagtgagcaagtccttactgcacacgaatgtatttagttttggggttttttcttgaagggggaccaggggcctgttgttttgaatagccatcacggtgctgtcaaatatttaacagcagttctggtttttttgtttcatagctcagttgtgcaatgatggtctcttcacttcagaaagtcatctaacaatagcccagtcaaaatttctgtcttctatttcttgcccttctggaggaaaaatatatcagaaatattgtcataacctttaaagaagacagtgcataatcacctagtaatagtatccttcattggggtttgggggggaggaacatttgtgcccaaggtgatcattttcatcaatttttaaaaaggagatactattatgtgtttgtaaacttcgagatggatgataagacagagtattacctatatatcaacaatgatatgtttacttagaatacactaggtacctgtaaacagagagctaaatctctgataggagtatggatagaggggttgatgaactgatagactgactgacagatggaaggatggatggataaatggagtatgtagctacctagtggtgaaataactcctgaaggtttaaaattatgtaattaaaagacaaatagtactaaaatgatttgcttctcccttaaaacagtaatttaattaaatggtataaaaattgataagctattatcaataaaatacatcataattttgtagaattcacaattaatatattattatactatgatgtgcttgctgagcagatcttcataataagatctactgtctcttataaacttaatatatgtcctgcactctgaaagtattttatactcattaccacattagctaaccatttcttttcctagactgcaaatatggaagaaggcaatctacaggcataacttggagacagtgcagattgggttccagaccactggaataaagcaaatattgcaatatagcaagtcacacaaattttttggttcacaatacatatagaagttatgtttatactatactgtagtctaataagtgtgcaatagccttatgtctaaaaaaaaatgtacatgccataatttaaaaatactgtatgctaaaagatgttaatggtcatctgagccttctgtaagtaataatctttttgctcatggaggctcttgccttgatgttaatggctcctgactgatcagggtggggtttctaaaggttgtggtggctaagacaacaatgaagtttattacatggattgactcttccttttatgaaagatttctctgtaacatgtgatgctgtttggtaacattttacccacagtagaactctttcaaaattagagtgaatcctctgaaaccccaccacttagttgataaagattacctaggtttatattatattccaaatcatttgttgccatctctggcatcttcatcagtaatagactccatctcaagaaaccatattctttgctcatctgtaagaagcaattcctcatccattaaagttttatcacgagactgcagcaattcagtcacgtctttaggtttcacttctaattctagttatctttcaatttccactgcatctgcagttagttcttccactgaagtcttgagtttctcaaagtcatctatgagagttggaattaacttcttccaaactcctattgtgttgatattttaacctcctcccatgaatcacaaatgttcttaatggcatctagaatggtgaatcctttccagaagattttcaatttgctttgccgagattcattagaggaatcactgcttatgacagctatagtcttacaaaatatatttcttaataagagttgaaagttgaaattacttcttgatccatagggtgcagagtgcatgttgtattagatggcttgaaaacaacattaatttccttgtacatctcagtcagagctcttgggtgaccagatgctttcatcaatcaggtaatatttgaaaggaatcttttttctgagaaataggtctcaagcttgggcttacaggctcagtaaaccatgctgtaaacagacatgctgtcatccaggctttgtggttacatttatagagcacaagcagagtagactttagcataattcataagggcataggtttttggaaacagtaaatgaacattggcttcaactcaaagtcaccagctgcattagcccataacaagagagtcatcctgttctttggaactttgaaaccagatactgtcttcccagtagttatgaaagtcccagatggcatctttcaatggaagcctgcttcatctacactgaaaatccattgtttagtgtagtcacgtttatcaatatcctagctagatcttctggaaaacttgctacagcttctacatcagcacttgctacttcaccttaaaattttatgttatgaagatgtctttattccttaaaccttaagaaccagtctctcctagctttaaacttttcttctgcagcttcctcacctctcccagccttcatagaattgaagagagctagggccttgctggattaggctttgacttatgggaatgttgtggctagtttgatcttagatccagaccaccaaaaacttcttcctatcagcagtaggctggtgttcactgtcctatcactcatgcgttcactagagtagcacttcttatttctttgaagaacttttcctttgcgttcacaacttggctaactctttggcataagggacctagcctttgtcctgtctcaactttgaacatgcctttctcactaagcttaatcatttctagtttttgatttaaagtgagagacatgcccctcttcttttcatttgaactcctagaggctattgtagggttattaattgggctaaattctatatggtcttagacaatacggaggcccaagaaaaggggaagagacaagggaacggccagtaggttggaggagtcaacacacacatttattaagtttgtggttgcatatgtgcatgatttgtggtgccccaaaacaattacaatagtaacaaggatcactggtcacagatcatcatcatagacataatgataatgtaaaaataatataattatgaatagacaatcatatattaatatatattaataatgaaaaagtttgaaataatgcaagaactaccaaaatgtgacacagagacacaaagtgaacacatgctattggaaaatggcacgaatacacttgctggatgcagcgttgctacaaatcttcaatttgtaaaaatgtgtatttgtaaagtgcaataaagtgcgataaaatgagctatgctggtgcagtagtatcattggcctgaaagatttcacattgagcctttccttttaaagttaggctttacttaatttatccaaaatatatgtttttttttctatttaaaaaataaattgtattagtcatctttatacctgataccagtgtgttttaaatagagcattctatgtctaaactaaatttatgacatggatgttatattacttttccttctggccagtagaaattacctttttcaatgagtatctcctgcctgcctacgtgagatattattcgtgtttctgacattttccgtgaagctcttcttaatcagaatctcacaggatcaaactgagtggtcagtgttttatttacataaaagtattacctgagtatcccagatgatttcttaaaattaagatgtgatataattactggctcgctaaaattacctacgggctcctaagcatttttgaaagctgcaaccaaaagaagtttctgtttctcagagaaagttggaaatattagagccaaaaacagtgtgttcttggaagcagtggattcagttgtaatcatgcataagaaccatctctaattctattaatgtagtttctgttggcctaatgatgggaaaatgcctaattaattcctataaataagcattaatttacaaaattaattatggttattttttgtagttatgtggtatcagctgttgaataaggaaagtgtttagataatatcaaataaaattatttaattaacatataactgaatgaaatgattacactcagtacgttttattgtcacacaatgatcattttatttcaagaacattaattaaaatgaaaaattattatgtttgtatgtaaaattataaacattactgggtttttttttctcatgtgttctttattatttagagagagagccaattttcactttgccagcctccctattaacatctgtcctttttgccagctgaagaaaacaaaggaaaaacaattttctcctgtagtagcattattttctaattctgaaacattattttcttcagtttgttctctacttctaacatttttatttcccattggctcatgtaacaaaggtctccagaggtaataggtatttcttgttcttatatttgtaaacataaagaaatttgctctcattgcaaggatagtggttagcttgagctctagaatattgactatctgaggttcaagttccatctctgccacttagttttgttttgaaaatagcctctttgtttcttggttattatctctagaacacctattcatagaattgttgtcagaattaaattagttcatgattagttaacatgcatgcaaggcttaacaacagtgtcgcccacgtttgagcttagcaagtagtaagggtaatggacatccttactgtcatcatcttctaaaaatgcattagaaactttataataaaaatgaatttttataaaaaagaaagacaaataggtactaatcctgtctgttgtcttttttctattgtcctactttttgttttttgttttttttttgggggaacaaaacaataaacacctttattacatgggtgaagacaaaacgaggatatatttgcctttccgggccttgattttcctaagacagaactccaactctttgccctctagcacatagtgttttgttttttgatttttgttttttcgcatgtcctagttcccatttcaccacgacacagtgattcctttcagtcctttcgcagtactggaattgaaactcttctgttccctgttaaatctcttcctcactcttgtactatttgcccacctttctttcttatttccctttctctgtatcctgcagcactgtcttgatttctttttctttccacctattcttcatgttatcttttttaagatctaaatccatttattcatttttcttgcacttttccctgaaaaattcacccacccttcagctatcagctctatgaagatgttccctaatgattctccccaccttgacctatgccctattcaccaagcagtgggcaattttgtgatgtttaatgactgttaggcaaaactgggcagcatggaattataaatttttgaaactgaaaaactctagtataacctagctcagcccattcaaattaaacaaaattacttgggttaagatatatataagcttattttttttcaatttttatgagaatttaattagtcgtatgaatcatgtgtctgaaatacaagcttattttaagagatcaaaattagtaccaaaagttaaatttgcatggcaatttacaatatgcgaatacttttacttacattaacccatcttatcctcacatcatctccagtgatactggttaggcaagcattttttgtcctcaatctacatgtgaggatcagaaagatttataattttcacaaggtcgtatttctagtcattgaataaatgtgatttaaatctagtttctctaaattcagtacagttttacatttggtcaccagataattcatctttttgttgccctctagaaatgccattgaagtacatgaagtgtgtctcactaattttggtttttttctctatttatatttgtagaggttaatgatgcctttgactaaatgtttttctgcagggtaataccatcctggtttctgacactcaaaagcacagatgaatgttagtggaaaaattttttccagctgtatgtatatatatctttttaagttctacttttatttagattcatagcatacatgtacaggtttgttacatgaggttcttttgtttgcttgcttttgtttttgtttgtgtgttgcgaagttttgggttgtgaatgatcctatcagccaggtagtgagcatagcacccagtaggtattttttcagacactgcctccatcccactctcccggctctagtaatccccagtatctattgtttccatctttatgttcatgtgtacccaatgtttagctcccacttataagtgagaacatgcagtatttggttttctgttcctgtgttaattcacttaagataatgacctctagctacatccatgttgctgcaaaagatatggtttcatcttttcaatggctgtgtagcattccatggcatacatataccacattttctttatccaatccaccattcatgggcacctacgttgattccctgcctttcctattgtaaatcgtattgtgataaacatacaagtgcatatgtcttttttttttttttcttgtaggacaatttattttcctttggatatgtagccggtagtgagattgttgggttgaatggtagttctgttttcagttatttgagacatttacaagctgctttacacgggagctgaactaatttacttcccaccaacagtatataagtgttcccttttctctgcagccttgtcagcatctgttgttttttgactttttaataatagccattgtgtctggtgtaaaacggtctctcattgtggttttgacgtgcatttctctaataattagtgatgttgagcatttttttcatgtgtttggtgaacgcttgtatgtcttcttgtaagaagtgtctggtcatgtcttttgcccattttctaatggggttatttggttttcgcttgttgagtgtttaagttccttatgaattccataagactctggatattaaacatttgtcagattcataacttgcaaatattttctcccattctgtatgttgtctgtttactctgttgattgtttcttttgctgttcagaagctctttagtttaagtcccacttgtcaatttttgtttttgtttcagttgcttttgatgagttagccataaattgtttgcaaagactgatgtcaagaaaggtatttcctaggttttcttctagggtttttatagtttgagttcttacatttaaatcttttgtccatcttgagttaatttttgtatatggtgaaaggtcgaggtctactatcattcttcttcatatgactagtcaattacccagcaccatttattaaatagggagtcctttccccattgtttatttttgttttaaagcataactgataaataaaaattatctatatttaaagtacagtgtgatgttttgatatacatataccttgtgagatggttactacaatcaagctaattaacatattcctcacctcacatagtgaccattttcttgtgtgtgtgtgagaatgcttacggtcagctctcagcagatttcaagtatataacacattattaactgtagtcactgtattgtacattacagcttcagaacttattcatcttataactgaaagtttgtataaaatatccccgtgcatgtgtgtttaaaactccctttgcttattttttattttttatttccataggtttttggggaacaggtggtgtttggttacatgagtaagttctttagtggtgattgagattttggtgcacccatcacccaaacagtataaaatgtacccaattttttaaatgcatatggggaaatgtttactttgaatctttctcctcacaataattaatctgatgtagttatgggctatgtgcccagaagtgctcaggaaagactgaagtgatgatgcagatatgcacacctgcaagctttgctttacagtttttcatgggacactagtttagcccctgttcttcggctttctaaagcactgagtgagacctgtactgtgattttctatctagtcttaaaagagaaagaggactatacattaactatatgttacgccaagtaagttaagacttcaaataaagaaaaattatgtttctaccaccacagctaaaataatcagatttccagattttaaatatattaaagtttatgcactttgcaggctttatctgcaagatggtggtagagtggtagaaactgttatacctaagagcatattctggccctgccaaaatattagatatattattttgacaaacccctttgatgttctgtgcttaagttcagtcatttttatagagaaagctaaccagtaaagtagatatggaaagtctttgagtttgtgctgacttgaataaacctggaatcatgtatccatgtcaactaagaattatataaaatgtttctcttcaaggctcataccaatcagaatagttaacttgagaattaattgcttccaactaacatgcatttattataaattatccaaaatgaaggatttttatattataaatattctgttataaatttataaagaatatgaaatcttttaaaatgtctaagttaaactttatagataatgaaatggaattgtgatagaagttatatttatacagatcttacatgttaactctgtgaaacaaagggaaaaattcaagtttggtctttgatgaccaaagtagtatgaaattatttctcaaagtttagcaaaaacatgcatagattaaaaattaaaacccaaggaggagactgcaaaggaaaataatgaaaagacactcactcaaatgccagattctaatctaggtcctatatggcagagaaaaaaaaggaatttcttatatagattgtattttaatagtgagagacaaaaattcaactgataagaacagatactacacttgatcttagccaaaaggctgagaagcaaaaatgtaataattaaatttataatatgttaaaagctgataatactatggtgaaaaatcaaggcaggtgcaggagagtgtgtgtaggtatttaattttcaggtaggattgtcaccaaaagctctctcagtatttctcataaacttgagaagtaccttcttttttataaaaaaaaaaaaaaaaagacaaaccctaaaatttaaaaaaagactctagtcctcaaagagttctatgtactgtatgattaaactttaatgtaaaaatttttaaatagcaaattctagtgagaacaaagacacagagaaagaggaatagaaataaagatcataaaggaagaagaggccaagtcaagtataaaaagtaaaataaagaattaatagacccacttttatatttttcatctcttgagacagcaatttaagtgagccagggtctatagtaataatagccacagcagctagtaatttgagtacttttcccagtgctacatagggtgttaagcactcagtaatagattgcttcagttaatctctacacccaccctctgatgtgttacctccatttacagatgagagactgagcctccaggaagtaagtaacttactcagagacacacagttagcaattggtaggactggaattagaatgcagttgttagaccctaaagctcatggagatactcaccatattttagtgttttagaatgctgtctcctatccctgtctttctgcctgaaatggctcagataatgctttcttactgcttatgattgtctttatttttcagagacgtccccgtttccaattatgtttttatttagctatattgcacttgactgcattgaaggctgttcccagagtaagtttgtttgggggaaggtgtttatagcctgaatcaaaattattttgagtttaaaagcacaattttttttaaaaaaagtgttgagtctgcagggtgtaaactcattttgataataaaagatgtggttaaaaaggtgaataaaaatctgttatttttttctttttcagttttaaataattgccatcgcttcatcagataattgaatttacaagttctttggataatcctaaaggcacagacagacagcagcagttttagggagaggttagtgcagaagtgtgagcacatttttctatttttcttccttctcaaattattgagaaacagtgacattttttagtttaagttatataatcttctaggatacagaaaagtttctaagtaggttagtcagaagtattccgtaaagtatttagaataaatgtcctatttacatagagaaataggtagtactcaaaattttgtattaccatttgatttgctatttactgatgtgtgtcattaagcatgcttaaaaataaactaataatttgcatgaaaatacatttcagaaagcatagtaatccaataattaacctggtagatagtgacatttgagcccctcatcctttgagcttgtcttattgctattttgcattgtacagtttctaaaaatgtatggccgaagaagcatacttgcagggattggagtttattttgtagtgtaaaaccagaaaccttttgttgaagaaatgagcacatcctagactataatagaaatatgcttctgttttgcacttaattaaaatgtacggttgtcatttaaacttttaacgaagacagtgttcacacatttgaatgcatatttagcttatgcatgaagatcttgcttttttcaaggtcattaaaattttaaggtaatctaataacaacaaatatatatatatacacatatatatatacacacacacatatatgtataaagaaaaaagttgcatttggcttttttatattttaaaatttgctttgattacattcgctagtaagttctctgtttttttgtttgtttgtttttgagacggagtcttgctctgtcacccaggctggagtgtagtggtgcaatcctggctcactgcaagctccacctcccaggttcacgccattctcctgcctcagcctcccaagtagctgggactacaggtgcccgccaccacacctggctaattttttgtatttttagtagagacagggtttcacagtgttagccaggatggtctcgatctcctgacctcgtgatctgcccgcctcggcctcccaaagtgctggaattacaggcgtgagccactgcgcccgggcaagttctctgtttaattccacattactttcttataaattttattttagaaatattataatattgggggatttttaaaagctaaagtcagggagattaaaaaaaaaactaactggatattccattgaaagaaatataatcataaaggtcacatggccataaatagttttgaaaagtaattaaaatatcagaactctcatttttttttgacttatgttttaagttcaggagtacaagtgcaggtttgtcatataggtaaacttgtgtcatgggggttcattgtacagattatttcatcaccaacatattaagcctagtacccattagttgtttttcctgatcctcttccctcctcccaccctccaccctctggtaggccccagagtgtgtcgttcctctttatgcatccatgtgttctccttatttagctctgcttaagtgagaacatgcagtatttggttttccgtttctgtgttagtttgctaaggataatggcctccagctccattcatgtccctgcaaagaacatgatctcatgctttttaatagctgcatagcattccatggtgtatgtgtaccacattttctttatctagtctgtcattggtggacatttaggtttattacctgatttttccattgtgaatagtgctgcagtgaacatgtgcctgcatgtgtctttataatagactgaattattttcctttgagtatgtaccctgtaacgagattgctaggttaaatcgtatttctgtctttaggtctttgagtaatcaccacactgtcttccacaatgttcaaactaatttattggtaggaatatatctttcctactaatggtgtttaagtgttccttcttctccacaatctcgccagcatctgttattttttgactttttaataatagcccttctgcctggtgtgagatggtgtctctttgtagttttgcattcctctagggatcagtgatgttgagctttatttcgtatgattgttggctgcttgtatatcttcttttgaaaagtgtctgttcatgtcctttgcctacttttttgttggtgtgtttgtttttttccttgtaaatttgagttccttatagatgctgaatattagaactttgtcagatgcatagtttgcaaaaattgtctctcattctgtaggttgtccatttaccctgttgataatttctttttctgtgcaaaatctccctagtttaattagatcccatctgtcagtttttgcttttagtgtcttcgtcatgaaatctttgccctcgcctgtgtcctgaatggtattgcctagggtgtctttcagggtttttatagttttggctttagatttaagtctttaatccatcttgagttaatttttgtatatggtgtaagggagggtccagtttcagtcttctacaaatggctagctagcagaactgtcatttttaatgatgactgcttaagtttaatgtgtactctagatcacagaagtaaagatagaattacctaaataagatacacaaatacacacacacatagacacacaccccccgaccacgacacccctccaccacacactaacagacctgcacattatctatgtagtaatatatcacaagtctttgccactcctgcatttggaaagagactagagaaagaaactgaaagttgtagttcatagccttttctgtgattcaggacaataaagtaggcataatttggctatgtttataaaataaatggacagatctatttgagatgctagatagctataaccttaggttttctggagtacaaccagcaataaataaaattcaatccatgtaacataaaaagggaaggattgtgttggaacattgtggcaagccctgtgctgtatagatctcttcagactactaaaatcatgaaactctccttgcttttcagcaactgttcttaccctaccagacatttgtttacatttccattaattaaaacattccttagaattttgaacctgatattttctgccttcggtataaattctctttcctggggtcacttagctcctgggcattattttaatcatggtaatatgaatggattgattaaagaattaaatataaaataacatgctaaattcatattccaaaaacctacattatttcacattttagcctgtcttcagttggaatgtatcttacaatattgatgtggtagtgatattttttcactttattagagatatataaaataattcatcttgaaatgggtgatgtcttagatttgaagatacattgtaacttacccgctctgccatcgttatagtcgtctagtcactggagaactcttctttttgtcactcaatttgaaacctcaagggttgtaccttacaataaatttccttagcttcatcagtgggagtgaagtgagtttagtgcagaatgatataaatgatagtacttcttacatcaaaatccttatactttgaacagacactttatcaagtgcctgagcaaacacagcagcttttgaagtatttgaagagccattgaatttaagagtcttcatgccttcactgttctttaatcttattagtacaggcctccttcagaacactggctcttccttggttcaaatttaaggacatggattataaaataatggctgaaaacttatctacttcaacctgttgatagatatatcaaatacttaggaagctcttgaatttaaaataagaaatcataatattttaaaatgctatccaaactgatagggacctatttgatctcctttaaaaaaaaaaactattaaaaaattttcattcttttcccactgtatttttttccagttgaacaaggtaaattttatgatccagtgttttgtatttactaataaaatgatcaaatggaccaaataagaaatggactagaacaagtatagtaaatctcagatattcagacctcaacattacttttaggaatggcaatcttgtatatctaattatgtcagtaatttagatggatatcattttatctgatttttctatttttattcttctcttgtcattttcattctgtcctctttatgcttggaatgtgatatgttttggatatttgtccccttaagatctcatgttgaaatgtgattcccagtgttggaggtggggcctggtagaggtgtttgggacacgagggaggattcttcatgaatggcttgatgccctccccatggtaacaagtgacttctcactcacatgagagctggttgcttaaaggagcttcactcctcctccttgctctctcttgctcccttgcttgccatgtgacattcctggaccccttctccttctgccatgagtgtaagcttcttaaggccctcaccaaaagcagatgccagcaccatgcttcctatatgtatggtctgcagaactgtgagccaaaataaacctctttcctttatgaattatctcaaatataacaatatgaagaatttcaacctgagaaataaacaagaaactgtatatgaaaacactgccgtattcttggcataaaattggtgccgcatatagagagtaaagtaatcagatctacatttgacttacgcgcacctcccaactctaccacttaacaagctgtctgcctttgggcacaactgctcttcccttccacttctgattccctaattcagtctcagtttccttacttttgaatactgtcacttgtacttctgaaactcagtctatgtctctcctttcccacagtcagagattagccatacttaactatccttggactgttgttagactcctgactgcttttcccgacttagtctttccgccgtctgttttatactgtttacaacctccgggttaattttttttttattgtgatacactttctcaagaattttaaacactatcacacttaactaataaaataagtcttaagaccctaacccagccttcaaaagtcttcatatatggctcgtccctcatatttttcttccttgactctccctctcattgcatattgctttttgctctatttacgcatgttcatatgcatgcctaatctccctttacaggctgtgagtcacatgtacatgaagaccatgtcttccttatttttgtttcttgcacaatatcttgtacattgtatgtacttagtaaatgaatgggggagtaaagataatttattgtactttcctcaattataaaaaacaatatatgtaatttggcttttcttggtaagtcagtgttgtcattctgaatatcagtttcaaagttttattgggaaattgggaacctattaggagaaggtcctctgctaggcatagggaggtagctatggataacagatgaccttttaaggtgtcctgctaaatttattttgtgtgctatgtattggaaaccatataacgaaggtagtttaaaataagtatacattggctttgagtcatattttcagagataaattttcacagaaaaaggatgatgtaggaattgtggtgctgtgtgggtcccatatcatgtatgtacatatgtgtgcatctgtgtgtatgtgtgtgcacatgagagagagtgagggagtacccaagtgagagaatgtgtaaaacaaacaaatcagttgctcaaataacctgcttgaaaaggcttgttctaattctaagcagtattcctaaaacatgtagtttcctgatacttgaataatatatgatagcaattcacaattataaagctctttcacacgcattacctttcacttagtgtttaaatttgtagaaatttctggattttaaaggccacattttctaaaggaagctattgtgttccctgggcaatgtagacacagaactgggtgattgcacaattggacacagaaaatttttttctttaaattataggccagagaaacatgtctaaattgatgttttgaaactttctctatggctttcataagcttttcctttatggctaccaattatataaagtaagtagattctaacactttcaatatgatgatctctttcagtgtcaaagagaaatgaatccttgtatagcaattgttcttttactgtcctttgattgagaaaagtatacacaaaaactattaaattttgtgactttaaaattgcattttttggtgtgtgaagctcagtctgtactttattgtgggaaaagcatgtaaaatgatggacacatgatttttattttactataacattgaaaataacgattaaatattatttaattctgtgtcagagaaataattttgttgagaacattctcctttattaagagaaaaaaaaaaaaaaagcattccaggcatggtagctcattaatcccagcactttaagaggccgaggtgggcagattgcttgggctcaagagttcgagaccagcctgggcaacatggtgaaaccccatctctacgaaaaatataaaaatcagtctggtggcatgtgtctgtgtctgtgatctcaactacttgagaggctgaggtgggacaaattgcttgagcccagggaggcagaggtttcagtgaggcaagatcgtgccactacactgcagcctgggtgacagccagaccctgtcttaaaaaaaaaaaaaaaaaaaaaaaaaaaaagtgcccctaagtaaatgagggaattcttacttttagttttgcaaccttaaataattttcctataacattttaaaaattgtaattcaggtgactaaaatgaaagtgttcataggaggaaataatcatctctactattagtgagaagttgaatttggttaggaacgggttcagaacatgctaccccaaaatatgccactttggcttattgattattttgagctgaagctgtttgagaaacaagagatggagaaagagctctttgatcccctcctttctacctaaaagcaaatcataaaattgcccgtgaaaaagttgtctttcctgtgccgggaataggaggacattctcgtcaccagacattgggaagccatgccgaaacagacctgtacaaacaaacctactaaaataacccctgtcttccatcagtttcccccatatatttcctcgttgttttcccacaatttactgcccccggcacaagctcttgtgtcttgtcacattcccataattgatcattcgttgtgtaaaaggcacattaaatgtttgggtctaatggtttctttccttttttctttttaacttttaggttcagggggtacatgtgcaggtttgttactgggcaaactgcctgttgttggggtttggtgcacagatttttttgtcacccaggtaataagcatagtacctgatgggtagtttttccatactcaccctcccccagccttctaccctcaagtaggccctggtgtgtgttgaattaacgcagggacggaaaaccaaatacctcatgttctcacttacaagtgtgagctaaacattgagtaacatggacacaaagaagggaacaatataatctgcattttaatagtaaaaacatgtacgttctttgaaatacagtgtcaaacgtgtataacaacatagtttagtctttagacaatgcctaatgcatatatagattcccaaccccttgtaataacataactacttactcagtgagaacttacaataacatgactaccagtcagtgattcttaacacctaggttgggaaccattgcttttgatgatatgcttgccttacttagccactgctatcaaaagcctacgttgtgaaccagtaattcattaattggtattttaattcagttgttttttaaagtattctagaacattactctctaaactgtactgttttagtttttggaagatttgtcaaagtattttgaagaacaaaagctaaacttctatgttaatagttttttttaaattccacaatatttcattatttgccatgtctttgattatttattttcattatccatatttcagcattaaatatattggtaggctgaaatcattttcagctatattgagtgactttaaatgtccctgtgcctggtagtcatcatttgcatctcagtctttctctctttctcaactcagtaatattctgattatcagtttcagtttgaattagagaaggctgacctggattgactaaaatggaggcaacactactagaaaaagtttctgtagcgtgtccatcttcatctctgacttagacaaagattttcaagggttgaaaatgatggctcattgttccttgctcacagtttctattaatgtgataatgtttgcagtaatgataatatactaacatttctgagattaatgatatattttccaggaaatcaaaacaaaaagcacttaaattatctgtatttctacttaggctagaagaaacaagatttctaaggtaccaatgcatatttaattatagatttttgtatcaagtaccatttctagacattttgagcctaataaatttgaacataatgatagcttttattaattttgctgtaatatgctaatactatctaacaacttattgtgaaaaatcagatgttcagtacagatgcaatgatgcatttcttttttgaatattttttatctgaaattgattcaattcacagatgcaaaatccacagatatggaggactgactgtatgtatttagtaatatatctagcagacacatggagatagtataactattagtaaatatttaaaagatgactacatgttgaacttattctttatggcttgtcttggtagaaataatataatctcaaggagcaaaatttctattcaatatggagaagaatttataacaagtggaatgggttgcttgaagagaaaagtagattaggtatgtttcgtcccaggctgggtgatcacttgtgagtcgtgatggaagtataacagggatctcatgagtgtgtgcagtagatagcctataaagcccctttcagacataaaactataaaagaagaaatgagttcttagcacaaattatgatttaacactgctcaaaaactcacttctaaattgctctctcagcacgtattttacaatgtctcattcaactcctcaactgttgtgaattccttaagagctgtacattcaaaattgtgctagattcagatgcagcggaatatggagggcatcagagactggaccacagcactgactttttttctgaggcttttgaacataatgggcgtccctattctcttttggtaagtaagtttctcaacatatttcctgctattttaatttactcttttattatagtaatgtttttgttcaaataaacaactcttcaaataagcaacatggaaaaaaagcatgaaggaaaggggttagggagaggggactacgcttggccagatgtaatgtgtgtaaaaattgggttttggaaaaactaatagtaaaggatatttaggggacaattggcaaaaattaaatattaataggattcaaaactgtttctcaagaaatgagcagaaggcagttttttatttttctttcaattatgaacatttctattctttatgcaacatttcactttccttctgttcttgttttctccataacattttatattaagcagatttctacattattgactagcagatgaagtttaatttaaaacaccttaaaggagtcaatgaaaaatgtatctttcttttctttcatgtagtaaattgaaggctgaattcattctagttataaaattctctggattttttatattactgaatgaagcattatatgacataactaatttttgcattgtggtgttcacacaaatagaatgttagaatgttgctttaaactactatgtttaaattctttaaaatatgtagaatttagtaagtttctagattcagaggaattcattatttaatttatggccatatagtaggttcaaaaccacatctaccattcctaattctaggacgtacctaacaaatacatgactttaccatagctgttaaagttcttatttcattaaattctctcacttttcaaaggtttagataggagtcaggcatgaggatctctgtggtacccctaggtcttccatctttctactgttttcccacttctcagagtgatgccagcactccactttgtaagctgccatattatatataaaagtgatatgccaaagatcatagcataaaatcattgaaaagagcagggattacaaagagtgagttgctggattatgggttgtgaggaaagtgcagtggaaagtcctatgagaattaggtgttgccctaaatgtatgtgtgtgcatatgggtgtatgttgatgatgacactgatacagctttagatatatttggagaaagatatatatttttaagagagagggctcaagggtgctatcacattcttaaaggaattattactgtagtctgtgagaacattcaattttgacacgtaaaataagtttgataaaaatagttttggaagtgaatacgaatattaccataaagttctgaaataatcaaaagagttagatgcccttaggggttaggaaagatgattcagctcacaaaggggagtcattgggaaggagcaactgattgcaagcaaactgaactttcactgatggaactagactgaaaggacttggaaagactcagacagcaaaattcttacatagccagcttttctaaatgtccgtgtaccccaacagggttctgttatgaagaacctgaaggtatagtgaaaagatcacaaaacgccatggcacaggacctggaatcctgacccttgtctgccatttactcactgagaaattgattaatttaactttttttgcactgcagtttcccccacctgtaaaatgaagatgattcatattatcttccctacagcaagagattcttaggaagcagaaactctttaacatgcccaagctttttggaaactgtaaaatgctattgcacatgtattttaaagttgtacttgtcatggagaggcaattattgttcagtcgtttaaacatgtcaatatactaagtgtttccaggacacacaattaagaataccttctcccagctttggggagatgatcttcttaggcgacggctcagactcttttgaggtgggcagaaaatatcttggcatcctttcaattttgtgagagtaaagatctgctggcataattaaaacaagccaaccaacaagtggcagcaacatcaggagattacttttcaatcactaatcgaattgatctcaccagtgtggaaaatgcagttgtaaattatcaggtagaataaagaatgtctcataagtatcagtaatacatagaggaggacagcactgcaaggacatgggaaacagaaaagagctgaatgctgcctgcaacagaattgtaatccaacacagccgtgagataagggctagctctctcttcccagcagcaacatcttgttttggatgactacagtgcttcaggaattactcgtttaaatacacctttaggctccagatgataagatcactcgttttaatgtgagattaagggagcccacacagacgagtaaaatacagaaaatctagacaaacgggttttctttttacctaagttattcagcaaagagccagaggaagaaaaatcacattaacaaatgtacctattctaataatgcttcattataagagaactccttattaaactgagtcatatgtgctgggatccagtggagttgcttgaacatgatcataagtgctgtaggtcttataccacttccagtgagatcactcatacctcccatacttgcagactaaaaggaggaaggaagaacaaaacgcaacttttccttcttccatgaaatttttgcccatcataactagtacacagcatttgctaaagcttaatttgcaagcttaataatccaaaggatctgctgaataagtgtcaaatctgttttcaaagatagcaacaaacagcccgaaggaatcttaaaatagccatacatgctgcagcatcagcaggtaccgttctagcgttgtctctgtgtgctccctcagttgaaactgtgaagctggggataactgcatgtataccgccattgaaatgtatttgctaaggtcagagtatgtcacaaatgtccaaaagcgatagggcagagctctgccagtctgctttactggcagttattggaaactccattttagcataatcatttctctatattttgattcctgataccggaacttaatatgttaacctatatgttaatcagtgcactggaggcaggggacttcctttctctcctctgattcataaaaccaaattccatagcacaaatgagagataagagattattgagccttaaatgaattagatttctttacggtaactgaatgatgatgctgaaaatgagaataaagcagtaggtttagcactaattactttggcaattaggtttcttatcaataagaagtagatgtatttactctcattctaaatttggaggttcaaaagtagacttgatttaaatacaggatttggcatagatgtatcacttttattgcccctcagttgtaagttttaatacagcttaacaattggaaaatatcttctgctctattcaaaattatgaaaatagttttttagaagaaagaaaatcttgatttttagtttacttttttaatgtatacaagttagatgagctaatatacatttctgtacagaaatactagagtcacttttctcctaaccccaatgcaaaataatgagaattagaatacaagaataaaatttattttttcttagaaaagtattttatgaactaaagcatgtatgtgaaaactaaaattaatttatatcatctttatatttttcaaaaaactgtgatttttattataaaaaagtgtttatgtagactatgaaagaatctgatgactttttcattgaatgatgtttgtttgttttttgtgagacggagtctcactctgttgcccaggctggagtgcagtggcgtgatcttgactcactgcaacctctgcctcccaggttcaagcagttttcctgcctcagcctcccgaatagctgggattacagccgcacaccaccacgcccagctaatttttgtatttttagtagagacgaggtttcatcatgttggccaggctggtctcaaactcctgacctcaggtgatccacctgcctcggcctcccaaagtactgggattacaggcgtgagccactatgcccgacccactgaatgatgttttcattctaccagaattatatgtgtatgtgctatttctaaacttaacaatttctaagggaattttttaaattgccctttaaagtattaaatattttttcattttaaacttttctttttttaaatgtttgacactgtgttttcaaaaactgtgtaattaaattttgcaagtcaattattagtcctagaggaaaatacagtcctagaggaaaataacattttgcctgaatgacataaaatagagcattgtgtgagcagttattgtcttagccacactcatggttagtgagtcaattaagtcattaaagttgtcaaaataactgagtagattagcatgcatttgactctcttcataaatgaattggattgtactgtgctattctgactctttgtgaagagcagactattaatatagctagaaaaaaatgaaactcatggctgtatactacgttgtctcatgttcttaaggcgattctaggtataaaatgtttagggcttacaggctaataaatgagcatatgagatatgtttatcagcatgcatattatcatgaatgataagtggcttctatatacaggtacatcaatatactttttatatttaaatatacttaaatgattgtgtttaaatctacttaaatgtgttcatgtttcttttctcttgccacattaatcaaaactattttataaattaaaatgataaaatgagaattacagagccaatacttaggctaaattttaggaaccccaaattgttcatgtctgtaattgtctcatcataagggttagctctgattatcttacgttctttagtataatcagtagtagttttctaaccactaagaaaattgatttacatactcagaagaaaactcaaaattccataaatagccatagttaagaaaaatcactggcttagggaaattcttccatgttgcctataccacaaaggctctggagcaatataaacacattctggtaattaacactgcagtgaaatatatgtatattattacaaagtatttctgttaatgatactgtacaattgtgaaccaaagggttttttttttagcatattgcattaagaggtctctaagtatgatggaactgtcattataaacctccttacataaaaagaccagcatcagttagtgagtgttcttggagcattttttaaccattaagtgccacaatgggaatatattgcagtgcatatgttacaaacctggaactttgttatggcatcctttaaaaaaaaaaaccctctcggatgggtgtggtggctcacacctgtaatcccagcctgccgaggcaggcagaacagctgaggtcgggagttcgagaccagccttaccaacatggagaaaccccgtgtctactaaaaacacacaaaaaattagccgggtgtggtggcgcatccctgtaatcccagctactcaggaggctgaggcaggagaatcacttgaacctgggaggcagaggctgcggtgagccaagattgtgccattgaactccagcctgggtaacaagagcgaaactccttctaaaaagaaaaaaaaaaaaaaatttagacaagctaaatttagacaagctaaaatgccaaaacatcaaagagtaagactggttctaaattatcattatgtaattattattatatttcattaatgaaataatgaggttatgaatgaaacagtagatatcacaattgcataggatccaaatctgagatatgtcactataacacgcactaacagagacctgtcattatttatcctaggcctgtctaatgtgtttcattgcaactttcccaggaaccttggacttatcagggtctttttacctgcattgtaggacaatactctataagagaaatgttttcaatgtagagggaactgaaattctcttgtccagtttctggttctactgaaatgtttagattggttttcacttttagattgctcatggcagaacaattcagaaccattcaaattgtaaccttctgtcccactgattagttaaatccagttactgtgatccccaaaatgaaatatgtagactatgactagctgcggtggttcacgcctgtaatctcagcaatatgggaggccaaggcaggcagatcacgaggtcaagagattgagaccatcctggccaacatgcagaaacctcatctctactaaaaatacaaaatttagctgagtgtggtgttgcatgcctgtaataccagctactcaggaggctgagacaggagaatggcttgaacctgggaggcggagattgcagtgagctgagatcacaccactgcactccagcctggtgacatagcaagactccatgtaaaaaaaaaaagaaagaaagaaaaggaaggaaggaaggaaggaaggaaaggaagaaagggagaaagggagaaagggagaatgggagaaggggaaggaagaaagaaaaagaaagaaaggaaggaaggaagagaaaaggaaagaaagaaagaaagatgtagactagacatcctaataagtacatgggaaactcctttagaagggtaggtcactttctcaatttgtacatgttttgctaagatgtagggagggaatgggttgaatcaggctgttttttttttctccttctttgctttggtttgtgttcattttgtctgtagcttgattatggaaatgtgccctcctttggactgggtctgtctggatctttggtaatagtcctgctttattcgtggataactccagcttccttttattgaatcagtctcgtaacatcttacgtatgacaaagagaaaacattgcatggaaaggattgcattagcagtgaaattctgatgtggtatgatagttatgagatattaaatacaatgtgtaaactctagggaaacagtttgtagcactgaaatacatggttttctcacacttagtgactacatggatgtaatatttatctttttggaaatactgtattgcaaaacagaacatgagacattgagttacacagcgactgctggcatttgttaatcttttgcagatgactttcatttcctaaatcactattactttgaattgaagattagaaaaactattctctagccattaaatccagaatataagtgccaccattttaaaactgctttaacttttgatgttaaaaactaaccagctgtatcaatatgtctgatttttttaagagtagtatgggttctttattgtggaaccttaagagaaaacatttgtagagttgagatgcattggacatacaagtctcattcagtgaaaatcaactgttctatttgtttgagttttttcctaaagtcatgtttgctttgcaccttcattctggttctaacctctgaaagctttttttttttaaaccatcaggcaagctttcatttagagataaagtgactgaaaatagtaaaatatcagcaaagtcagaagtgaagacagattgtcacaatgacaaccatctacaatattatttttactgtttgctttgttaatacttagataagttgtttgaactagcatataaataagcattaagcagttcaaatcacttctcaattttataaaaaaattcagatatattagagaatatcttgttaaatatgcacctattgatccactattattcctttgttcattgttcatttttttaattcagtcatcaacatctaccttgttcagtggcaccaactgagggttagaaataaaacgtatgacttttgcctttgtaaagctcatagtctaatgagggaaacagatggtaaacctgaaaaatcattcacaaattgtgttaagtgttcagaaagaaacgaaaaagctgccatgattggaaaagaagaacttatcatatctagggttgtcaaggaaagcctctccacatagctgggatttttccaagagataaggaaccagcaaggcaaagagtgtttacagcagaaggcacatcataggcaaagatccaacaaaaggggagtgtttgttgtgtccaaggaactgaaaggctcctgcggctggagtgtagtgggtgaggatgcaagcaaggagctgagctgggataccagatgtaggcagggaggagcgagtcagggctttgcatgccatggagagaatctgaatcctagtttaagtgcagtggcaagcttattcattggtttaaattgagagttaggattccttgtattacatttcagtttttgttcttgaaaggaaaaaaaaaaacaagattaaaaataaaagtgtcttgatggaaaaccagtgccttgtatattgcttttcttcatctaaatgaagtagtaacattgcaaactgtggggcagccttccttcaccacctaatacagcctcaacatggcagtaacagggccattcacgtcattcttgtgtaaggagcattggttttcattaagtcgtatggcgccctctagtggtggttgctttatggtagtcatgttgctgccagaactgttggaactgtgaaattgagccttctaagagcttgtaaaattgtaaaggtaactgtaactttaggcagatgtgagactgcgtcatgcctatgtttctttgacataatgacaggccgtttggtactttcttcaattgcactgacataattgttttgacgtaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaattgc

SEQ ID NO: 30 - DNA, 35558 bp, Homo sapiens
  source 1..35558: mol_type = genomic DNA
atttcacatcacaacgacttgtggttttaatcctccgtttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgaacagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggtgagtcggacttgtcccgccctgttcctgggccctgagagtgcctgcctggggacagttcccccagggctccagagacgccctatgggcttttgtccagccctctgatcacaggcactccacttcctcctcgagctgcattaggttttcatccaaagataactactataggactacggttcaatcaggagattaatttatggaaaatactgtgccagcagaaatctaaggtgatccttctgaccgtgttcaagctagccagggtcctagtgagactgtgagcaagggctgagtagagaccagagaaaacactcaaaattggggagacataatacaagaactatgcaaagttacatacaagtttctggcacatagaatgtttggcgggcggatcacgaggtcaggagttcgagaccagcccggccaacatagtgaaaccccgtctctaccaaaaacacaaaaaattagccaggcgtggcggcgcgcgcctgtagtcccagctactcgggatgctgaggcaggagaatcggttgaacccatgaggtggaggttgtggtgagctgagatcgcgccactgcactccagcctgggcaacagagcaagactccctctcagaaaaacaacccccccccccaaacaaaacaaaacaaaacaaaaaaagtgtaaattgtgaaagaaatcatagaacataaggaagtgagtttccagcggccacttggaatgggatggtagatgtaattagccgggactgaaaagagggtattccaggcaggaagaagggcttgagcagaggcacaaagaattatgattgagttcaaagttcaggtctagtggatgtgatgagtgggggctggggattgaggagggatgagggtggggaaaatgtggggttgaagagtcaagagcgctttagacattggtttcacataaaatggaaggggctaacagttttcttttaggcagctatgtaatcagtactgaaaattgtatttgaggataattattccacagcacatttgtaagtcgagccaacaatgtaaaggaatacaattctgctgcatgggttcaaaatttagaagtttcttgataatctggaatctagctctttggttatattgtatagatgttatgggggtgggagccacatttacggttaagtcttgtagtaatattttatatgatgtttcaagtgtgtttaaattactttcacaaaagttatcatttgatatatagaattaaaagcatttaattatacagatgacccttagagagtgacatttgatttggggaaagaaacacaatctcagcatcagggtagtccttaactggtaaaatgcattaagctggagaggataagaggcctgctgttgagtgtggtagatcacattttcctctgaatccttcatgacaaataatagagtgccttacccaagattggcactcagaatatgttgattttggtttagaagagtttgagcctggtttatggaaaaaaaaatccgtctaactggtatatgtcaatcccagtgctgggcactctgaaggttacaagaaaagtcttaagacctaggcctaggctctatagttcaattgcgaaaatatgaaacagagggaggtacacagtgaattataagattctcaaaagctttataggttgtttcctactattgtatacatgagaataattcctttcctttttttttttttttttgagacggagtctcgctttatcactcagcctacactgaggctgagtgcagtgatacgatcttggctcactgcagcctccgcctcctgggttcaagcgattctcctgcctcagcctcccgagtaggtgggactacacgtgcttgccaccacgcccagctaatttttgtatttttagtagagatggggtttcaccatgttggccaggctggtctcaaactcctggcctcaagtgatccacccacctcagcctcccaaagtgctgagattacaggcatgagccaccgcgccatacctaattcctatacttctaaattaggccttcacctccattgctatagcaccatagtttaatcaagtagatagaaatggagagattgtaagataatggaatactataaattccctaacaaaagagatttagagccagataaattcaataagatgtttatttccatatattaccttcctgtaagttcattagctttattagttgagggttcttgtccattgagagaaaatgaaaactgggttgggtgaacattaccaaagacttaaaagtaacttctttctctattgctcttcccatggagtcttccctttggaatgtagtttcctgtggaggcttttaggtgactttgagctaaaatcctagttctgcagaaacaaggatgaagcaatagcatgggaaacaaatagaggtagagcaataccaacaaggctgaagccagaatacatttctttatgagtctgattttagtaaagaaggcaacatatgcaggttaaatcttaactaacagatttccatcctcttcctccaaacaacttatttgtaggctctgggccagtaggttttgtttgtttgtttgtttttgtttttttgagacagaatcttgcttagtcacctaggctggagttcagtggcacaatcttggctcactgcaacctctgcctcccggtctcaagcaattctcccacctcagcctcctgagtagctgggaccacaggagcatgccaccacacctggctaatttttgtattttctgtagatggggtttcgccatgttgcccaagctggtctccaattcctgagctcaagtgatccccctgctttggcctaccaaagtcctgggattacagggtggaatgagccacctgaccagcccagtgtttttcctaatgcaatacaacttctggtttttgtctgaacctgaaactaagaattcatactcccttttctgaaaaagaagtctggtattgaggttcagttctattttgaattcaccttcaagggttagtcccaccagttgctaaatggtctgtgaaggtgtttagtatttgccacctttctttgtcattgagaggtgtttctaccaattggagggtgtgtgttgcatgttgttgaacctgttaaatagacttattttaggaactagatacttgaatgaatctagttccctgtttgattattaagccacatcctgtttgcaaagcaaagatgtgattatttggaatttggaatggcacccatctaatgttgctccagacatttaataagcatggtgtggagcatggtgcttgatggagctgataaagtccaaatttttccaagtaaagtggctaagtctaattctgccattagactgcattttttttttttttttgagatggagtcttgctctgttgcccaggctggaatgcagtggtgtgattttgactcactgcaacctccacctcctgggttcaagtgattatcctgcctcagcctcccaagtagctgggaattcaggcacccaccaccatgcctggctaattttttattttttagtagagacggggtttagtagcgatggggtttcaccacgttggccagactggtctcgaactcctggcctcatgtgatctgcccacctcaagattacaggtgtgagccactgcacctggccatgactgcattcttctttgcttttcctgaaactggttgatagaagccatagtatatcatagatattataaggttcccatcctggtctgatgttcacctgcacatccctgtgagttgctgaggatgccattgtccttcaacagaataatcctgccccccttctccagcccttttattctggaatggaagtaagattattatataagagcctgtgtccttctgcagccattatcagtatttgatttgctcatcctcagatattaaagaagtgactaaattaataaatggcatagttcattataatctggatctcctaaaataccttctttggccatttcttctgtatctggaacgttgtagatatgtagtaattatttgtaaaatatattaacgttaaagagctactttgtgtaaacatttgtaagaaggctttatgggtttgggttttgttttcttttttttttttttttttttttcttttagagacagggtcttattttgtcacccagtctggagtgcagtggcacaaacacagcccactgcagcctcgacctccgaggctcaagctgtcctcccatctcagcctcttgagtagctgggactacaggtgcatagctaatttttgtagagatggagtaccaccatgttgccccagctggtctcgaacccctgggctcaaccactctgcctgcttcagccacccaaagtgttgggattacaggtctgagaagatcatcaaaaagatatgatttgcaggttttcattgaggattacctttcctttcaggttaccaatttggagtgtaagtgtgtgattccaggcaaaggataatcacactatgctgcttattgtgtgatcccaactcgtgctgctcttaactcagcatgcagtgagagatgcattgggattgcatctaggagggaaacagataaggtcaagcagctgggctggggagaaagaataaggccgattagttctctccactttaattgggctagcggctaactatactttaacctttcccacggcaaagacaaggcatattcctgccaaagatgattgccactaagtttattgttttaaaagcaaagaggaagaaaacaacacgggaagaaggttttgtagtagaattactttttctcatgaaggggtttctggagaacgagggatacataggagaaatacagtgatgaataaattgtctttagaaagaaggtgatggcagaagcacagtttttagttgaagggcaaaataagtgtcatatttcattttgaatcccagggcctagattagcttggcctgcagtcttccaccagcctctcttctcacagccctgtttttttcttttcttttctttctttttttttttaagaaacaggtctttctctgtcattcagactggagtgcagtggtgtgatcacggcttacagcaacctcgaactccaggactcaagcagtcttcccgcctcactgatgagtagctaggactacagacgcatgccaccgcacccagctaatttttttattttttgcattttgtagagatgggggtcttactgtgttgcccaggctggtcttgaacccctggcttcaagcgatcctcttgtctcggcctccccgagtgctgagattacaggtgtgagccaccatttattacctaaagcatgatacttttctagtatccctgtatagtactgagtccaagaagctaaacttgatcaaggtgtatgtgggtagcctgggcctggtttatgaaaaatttgagttttatttctgtgagctgtaggtgttcccctgctttggatattctgtttgaacacagtatacattggaggactcaggatgtggaacatgattcattcaggagtcagctgagaaagtgtttattaaccccttaactctgtgccttcagactaattgcctaatttccaagctgttgctgctacttccttttttttttttttttttttaactctgcctgccttccagacatttccgaggataacaagaaaatagttatgaatgttttttcagtctttaagggagggtataatagtgggaagaacttggtgattttaaaaataaaacaataaaaattaaaagtccaagccccagagatgcctttccttccatttccttctaccccagttccttacctccaaacaggagcgagaagcatagcattggaaggtttttgacaatggataccttgtcgttttgttgttgtttgtttttaaccgtctcatgctagggcatgttgtctgtttcttagcctgttcaaggcataagcctcaatccctttcctgttgttatatagagggaaaggagttttacagccttaccagtacttcttttaagaaataaagctgggcatggtgtctcatgcctatagtcccagctactccagaggctgaggtgggaggatggcttgagctcaggaggtggaggttgcagttagctgagatcgtgtcattgcactccagcctggacaacagagccagaccttgtctcaaacaaacaaacaaacaaacaaaaacctagaaacaaaaacaaaagaaagggatcactcttatgtttctgcagtttcctaaatttcttctactggtcctgaaaataagtgataaaatagagtcaatttgcatcatcctcaagaggttccatgacctttttggagccactgacaacaaagtcagctgaagaaaggaggttgggtctgtaggggtcagagaggtgtatgtgtgaagagttttctgtggtgtgagctgtctcaaggtttacatgtttacagtccattgtaatacagaaatggattatattttcttctgtattcctggctgtaatgaataaaacccattattgggtcaggaacttgagtcttctctcttcttgtcctttgttcctgtttcaagctgtggcatttgcttaagcttcctggccacacactcagccctgatccccagccaactgctgtatgctattgttgtgtccacatcttgaggctggttaggcttgggtgtggtgtagagctcctttctgtggaagcgtatactcaaaaatacaggacgtatgggtgtttgtcagctgtcattaagcagccttccccttcttttgtaaagctcttgggattgagggggtaagagagatgccttactaggtacactgttatgcatgaaaagtttaactacttactgtttgttcaaccttgtccttgttgtaactaggattccacattagtggctttgttgttttgcctggagctgcagtcctaggttgggggagattcagagttctaaggccatgtccctcttgtattttgaagtgtcagcctgttcatatacagaatggcatctcacagtagtgaagccttcagtctcctataagaggctcatgaaaaacccttcagggaagctgctcctagagtgtggctttgccataggagaccctgccccaggactcctctggccaaatgagagagtcgaggtttgctggggcaaaactgtcttattgggaaaagggaagtagaacacggaaggaaactagcatttattgtctggcacttgatgtatgttattgccctttaatcttcataaacagctctgtgaggtcagtgttatcccaatctttgagaatggagacatagaggctaagtaacatgcccagggttacacagcttgtagggatggagcagaaattccagtcatgcataaattttgcttttgtcactgtacagtcttgtaatatactcatacacgtctttgtcagtccagttagcaatttggaaaactactggcctctggcaggattaagctctaatcacatcttagtgttaattacttcaaataggtagtaacttctaacatctagttactcataagcactcaggttatgaatattttgatccctggcccattgttaccagattccagtagcatttcttccttcctcccatctattcttagtacaggtagtatttattaagtaactttaattgtcaatagtactaggtccaaggaatattaaattgaacttccccgtccttaaagaatttacagtttctggaagtggggatacagacagagtgtgatatttttctatgataactgaagcacaaggtactttgggagtgcagaagaggaacacctgacctaagtgtatggggggaaaaggagaaagtgcacattgaaaaggctttcctagagagctgttgaaggagatctaaaagtagaagttagtgggggtgaagatagtattccgcatagaaagaactgcgcgtggaaaaggcctacaggcgagaagccttcatgccatattcaaggaactcaaggtgtctagctgaagtacacaactctagggtggatcagcaagttctgaagctaaagaggtgatagatggaaaggtcatgaaatggcctaataagccctggtaaggaatggagctttatcctaaggtcaaagaaggccagtaaagtccagtcaacaggataagtgatgtgactaaactctagctacattggggcttgctgtagagtgggattagaggcaggaaacccagttaaaaggctgccaacagtggtctagataagagagagtagtggctgaagttgggttgatggctgtaaggacagagaaaactagaaagactgaagagagatttaggaggtggctgcttggaagtgggagttaggttggagggaaagggtgctgaggatgactcccagatttctgacttagcagtttgaatgttggctctcattcactcgtgctgccattaacaaagatagggaaaatagtaggagaggaagggaaggagtaaaaagagctaaattggtggtcgtggtggctcacacctgtaatcccagcactttgggaggctgaggcaggtggattacctgaggtcgagagttcgagaccagtctgaccaacatggagaaaccccatctctactgaaaatacaaaattagctgggcatagtggtgcattcctgtaatcccagctactctggaggctgaggcagcagaatcgcttgaatccaggaggtggaggttgcagtgagccgagagtgcgccactgcactccagcctgggcaacaggagtgaaactccatctcaaaaaacaaaacaaaaaaaaaacagtgaaattaagaggttgagaggtagagtgagaatcatgaaaagtaaatttgattttgacgtgttgactatgaggtatcaagcaaacagttagctatgtagtactagagcttgggagaatgagtttgaacacttccgaggagaagaaggtccaaaaggcaaccacaggagggtggttgaggaggaggaggaggatgttgttggatgactgctaagccagaacatgggttagttcttcctcttgggtgtgaaaatcatctaggataatagccagccttgaggtggagaggaatactgggcaacaggatccaaagtattaagtaaataaggttgggcatggtggctcacacctgtaatcccagcactttgggaggctgaggctgtgggatcacttgaggtcaggagttcgagaccagcttggctaatgtggtgaaaccccgtctaatttgtaaaaatagaaaaattagccaggtgtggtggtgcacacctgtaatcccagctacttaggaggctgaggtaggaggatcacttgagcctgggaggcggagattgcagtgagctgagatcgcgccactgcaccccagcctgggcaacagaggaggactccatctcaaaaaaaaaaaaaaattaagtgaataaagaagtgatcaggaagctacagagtgttgtaacaaggagagctgaagatttaacagctggatgacatgaaccacagaagaaaggtgttttattacttggtggtggtggaatggatgacccagaagcagccccatatctcaaccctatgatgtgggaagtggctgcctctcagagcatgttgtaggggaagtggtgtgtggtattcctggggagagccaggcttcagttagggaggaagtagaagaggctgagtaattaagtaactacacaacaagatctcagagggtttacaaggtgaatgatatgtagtacacaggtggtctggtggagaagaggaagcaacatgtataaaaatagaagtgcaggaccagaagtgagcaaagggggttatatattgggcaaagtgacaaaatatggtagagatatgacatggcggatttccctgacaataagattaccaagaaaatagattccagagacaagcaagcatgtgtatatatgtgggaatttaatatatgatcaaagaagtatttctgatcaaatgtgaaaagatgtattagtcaataaatacctaaggatgactggttatccaattgggaaaaaaataaatccttacctcatatcaaactcaaaagtaaattccagggagattaaagatctgaagataaaagaccattgaagtgttagacagaaatgaaggaaactattattataattttaggggtagaggaggcctttctaagtaagcaaataaagagaccgtaaaggaaaagagtcatagctttgactacataaaaattaaagcaaaagaaagcataaggttaaaaaataagggataaaatgaggcagatatttgcaacaagtcaataaaagaaaagtaactttaaaaagtaaaaagaatggctgggtgccgtggctcacgcctgtagtcccagcactttgggaggccaaggcgggtggatcatgaggtcaggagatctagaccatcctggctaacatggtgaaacatcgtctctactaaaaataataataataataaaaaattagccgggcacggtggcgtgcgcctgtggtcccagctactcaggaggctgaggcaggagaatggcatgaacctgggaggcggagcttgcggtgagccgagatcgcgccattgcactccagcctgggcgacagagcgagactccgtctcaaaaaaaagagtaaaaaaaatttggctagtaaatgcaaagaaatgcttgaggccaagagttcaagaccagcctgggcagcatagtgagaccctgtctctacaaaaaataaaaataaaaattagcctgacatgctggtgcacgcttgtagtcttagctgtttgggaggctgaggcaggaggatcacttgagcctaggaggttgaggctgcagtgagctatgattgtgccactgcactccagcctgggtgacagagcaagaccctgtctctaaaaaaaaaaaaaaaaaaaattaaattaaaacttaaaaagaaatacaaattgaaattgaaacaatgtatgtgtttttttaaatccagctggcaatggtgaaaaagaattgagatgttctagtgttggaaagatgtggagagatgggcccatatatgtggatttgggtgtaagtcagtacagtaacttggaagaggaatttggcagtatcaaaaccaaaacttttcttacctgtggcctagcatttccacctccaagaatttatcctacagatatctttcacaattgcttatatacatatatatgaatatttgtttactagagtgttgtttataatactaaaaacttagaaacattaccgaatgtctacaaacagaagagaagttaggtaagttaatgtatatctcatcattggaattatattcaacatttacaagaaggatgtaaatctatatatattgacattaacagatctacagctcattttggtaaggggaaaaatgttacaaactaatagtattaggatcccattttttttttctgtttttgttttttgttttggggtttttttgagacagtctcgctctgtcaccaaggctagagtgcagtggcgtggtcgcttggctcactgcagctgccacctcccaggttcaagtgattctcctgccgcagcctcccaagtagctgggtttacaggcgcctgctaccacgcccagctaatttttgtatttttagtagagacaaggtttcgccatgttgactggcgaaccttgaagtcgttcgctgggctcgaactcttgaactcaagtgatccacctgcctcagcctcccaaagtgctggggttgcaggtatgagccacctagcctgggcccatttttattttaaaaattaataaatttatgtatttacaaaaaaattggaaaattgtgcaaaatgttataactaaagttatcccttgagatctagaattttagggagatgttctctttccagtggggatagggttgggagggacagatcagttttaaaagtaggggaaaatagaaaatttttaactacagcttttcccaaaaaaagatgggtacaacttttacccaaaaaatatgggatgggaatgagaggaaggaagaacattcaggattcatctgtgggctggagagagtgatacttccaagtaggtattaatagtctgtggagggtgaagaatcttggaacttacaggaggaggtaccatgatctagactaaattcagcagcactaaggagaaggccccagctcagggcagtcggcttcacagactcccactttactgggataagaagtttgacaaggttggccttgacttctctcctagctacaccaattcacttcccaggcttggaataccttttctcctcttggtagcttggtgaacaccaattcagggttcaagatcccactcagaggtccccttcaacgtcaagccttccacctttcctggacgtggctattaaatctaccatagcccttatcacaatgtttgtaattattgtttgtgttcatctctcctgctagactgtgatctcctcaagggcagggaccagggtttgtttttctttttaactgccccagcacctagcacagttcctgatgcacattaaatgcacaatatatcttggttggaatgaagaaatgagtgggaaatgaatgatataatgggcttttattaggcagaatatgggggagatgaaacctggatatgatgtgtataaaggtgggagggggaagagaagaaagtgggcatgggaacaaactttggcaccagcctaggagggtaccaggggatatgggagcagagtagacattaaagagtgggaaggtggcaaagtctgggttgcctttcttagttttcaatccagaagcaaaatcagctaccactttataaccgaaaccaatgtgttttttttccatagtgctgggattctgtgaatcaaacacattgatacgatggaagtgttttgattcaggagggaacgggtggtagagggaaaggctattgtgcactgaggtaaagattgatagtttccaggttaccctaatagttattagtgaccctaatacagcaacgagttcttcctctcagagaagtggaaagacctaaatcttagaatttatggatccagaggtcttcagagcagtgtctgaaaaggcactttgtgtaagtctgggcgtcttcttagcatcgcccaccccagtctcaggatttcagaaatactaggtttggggatataaaagtaatctctacattaactacttgctatttatgcctgattatcacatagcacaatcataaaatatgcattttttgaattccaacatcattcattttttcagcaaacatgtactgaatgactgctgtgtgtcaggcactgggaatacaaagacactgagattggtccctcctgttgaggaactcacaacctaggtgaggagatagacaaataaacagcatatcttaagaaaagtgttttgaaaaatgtatgtatacattgctgcatgatcacataggagggtttcttaggaaagagggggggaataacagaaaagtttcctaaaaggaaaatagagctgtttcttaattaggggagatgtggcgggaaggcaaagtttgtttcaattggaggaagcaatatgtgcaaagaaaaatatggagaaaatatggcattttcagggttctgttaagagttcattgttcattgtgagagttcctgcacaggagcagaaaaagacaaggcattttcttatgattacccagtgaattctggactgtattctgaaagctatgggagccattggaagattttaagcggagactgtcatgctcttatcttcatattctaatatctctgaggatagtagattgacatgggtattcctggaggcaggggaagactgcctgggagattttttatagtcatccaggtgagaaattacaagaggctgaattaaggctttggcccagtggggctgggaaaatggcgatgtgttaagagattataaggattgtgtaattgtaagacttttaaaaagtatttttactgttgtaatctcagtgcttaacacaatgtttgagatatcagacagtctgtaaatgttattttgagttgatgaacttgtgatctactcagttagatggaaggtgtagaagaaggagatttctggtataggtgaatagatggggctgttatcaaagtgagagagaggatcagccaggaggaggaatgaagagttagattagttttatgtttaagattcaagtggcttttgagacatttgagtggaggtgtacaagtctagagctccagaagaagagttggcttggaaagatagatttgggagtcattggcctgctgtgggagtggatgacattgtctagggagagtgtaagcgaagggaaaaagagaagtttggaaccttggataccctgggtaacattagtacattgggattggtaaaggagaagttgaatgaagaagcatattcaaggagttagaaggaaaaccaagagagcaatgtcccctaagctaagggagtttagtttcaagaaggtcagagatgtctgatgctgtcaagaggtcccagaaggagtgagtggtttctattagctctctgacagctgggatttttgtctgttttgaccactgctgtatccccagcacttacaacaccctggcacatagtaagcattcagtaaattactgttgaatgaatgaatgaattgaaaagagtcccttgaatttggttacagaaccacaggactttggtgaagccattttgagagaagtggtggtgaaggaagccagattatagtggattgaggaatagataggttgtaaggaagcagctacaaaatactaagtatgaccaacatcatgagcacataggaggtaccaggcactgagctaagcactttacatgtattaactcatttaaccttcccagcagcccaattatataggtattatgatccctattttacagttgaggaaactgcagcttagagagggtaaataacttgcctagagaaggcctgcagctagaaagtgttagaaccaagatttgaatccagatctgtcttcctttggagttcaggtccttagctgcccaggctacatttcctctagggagtctttgtggcaggaaggcaaaagaaagagtaagtgaggccaggaagattgcaaacattttaatgctgatgagagttgaaagaaataatttgaaggctttgggaaaaggggaaataatttatacaagaggagactgagaagagctccagagcacaggtaaaaggaagccccttccatcaaggtggaggtccaggagagggtacaggcaggtgtgtgttgcagatatttttgtcagcgaggagaggggaagagggtagggatagttgaaagttctcttctgattgtctgctgagcataagggaggtggtgatcaagtagacttgaggaaggtgtagagaatagaatgaagcaatgatggagatagaagattttcagggtagcatcaagggcccagccaagatggagaccattattttgcagtggtccagtcctgctgttttgtgatttttctcccttccctccagtagggtacagtagccggggtcaggggcacagcaggcagatgttagattgatccagggttgaaagttttgcccattggttgtgacagaagaaaagagacagatcgttgggagtattggctagattgcgtttgaggtgatgaatcactacatgtaggccagcagggaaggaagcaagaatgagagaagactgagaacagaagggaaatggaggggtcatagtactggagtctggagaaggttcaacagtaggactttggtgatagagcgtccttgttattagaattccatgtccagaggtgacctgtctgtgatgaataaggcaaaattactctataaggtactacaggggtagaaaactaccagtgatgtttgtctctttactgaggggactaaggaagggtaccaaagatactttttttttttaatcgtaaatattttctactgtttggtagtactgtttgattttttttttaaccagtatgtactactcttttttttttttttttttttttttttgagacagtttcactctattgcccaggctggggtgcagtggtgcagtctctgctcactgtagcctccgtctcttgggttcaagtgattctcctgcctcagcctcctgagtagctgggattacagggcccaccaccatgaccagctaatttgtttgtatttttagtagagacagggtctcaccgtgttggccaggctggtcactaactcccgaccttaagtgatccgcctgcctcagcctcccaaagtgctgagatcatggacctgagccaccgcaccaggcctatacaactgttttgattttaaaaaaagatacaaagttttcagtgaacccaaagagaagagtaggtttacatgaaagcagggagatgagtgagctgcagaggtagcaggctgtggtcctggaatgggaccctggagtgtattatctgtctatggaatcacaaggtcttagatctgaagaggagtagctggaatctggtcccaccctgccattgtttacagggaaggaaatgggagccctgagacttgctcagcttggcagcagcaaaaccagaaccagaagcaacctgtcctgatttcccagccctctggtctgtttttcatgctacctcctaagccctggaggcttctcaatttcctgctgttccagccagactcatggcacatgtgctcatgacattgctggctgaccgggctgtttgccatactgtgcttcccacacgttggtgcttctcagtgttcagggtgtgggcgggtgtgtgtagaggcggctgtactactgtcccctgcctatttcctgccctcttcatagccaggcaaagtagcaacttggaggcggaaaaccacagtggtgataccctatttacatcctttacaatgacctagtgtccctcctgttttgccagctctcatgttgctgcctcccccaaacatccctctcataatttgtttaaacagcagccatgcccccgtatctacttctttcagcccaaacccagatgagtcactgagagaacttcggacagggattcttcaccatgagattgatggcagggagtggaagaattgtaattctggagaaacagcccttaaattaggggcattgttctgggaaaaaaagtgttttcctattcagcagatctgcaaaggagtctgtgactctccaaaagactacagatttagggagtacagtgcaggtgtcttttagaaaaataaattttttaaaaatcgaaagattaggtatttttctgtcttccaagtaatagttcagataaacctggtgtttgtgtggcctctcttattttgtcatgagggcagcgagccatggtagttgcatatggattagttgtgatttctccttatgtggcaggctgagccccagaggattagaactaaagctcaggacttcggctgtcttttggatggctgcctgggtagatatgcagatgaattctccacacaatgatattggggctccatgatgtgtggggttgggagtgggggcaagaagtcagaggatggggtatagtttttcctcacccttgctcctaggttaagtcctcattggtctccctgtagagtctcctgtggagatgggtttgtagcctgtctgcttggatggccctgcagattctgccttgagtgtggtctttgccttgaaggtctgcttgtccttttgtgttgtaacaatgtagttttagggttcaagtatggagctgtgaattgacctggcccagagttgcctcagattccctcctctttgcagaatgtaggcaggtattggtgtggggatccagggtatttactggtaagggaaagaatgtgttgttcatgatggtaggaaaggcccccttattggcttgcttcttggcagaccaaagagctgagatacagccatgtggtagtgctcaagaggtctgagcaggcttccgtgagatgatctgagcgcttggattccttctgcctggagatgggtaacatttgagattccagtttggttctgaattctctcattgccttctgccaggccatcctatccctgacattgtagtgccataagaagtcatggatgttgtgatgccagtgggatgaatatggctccaggaaagaatagaatagagaggggttcattaagttaaggcttggggctataacaccagagccaccctgaaaatcacagggaagaaccagcaggagggtgagaagagacagtgtattcatattttggctttggcattttttctgcatagacaagggtctgtaaagctatattagatactatgttggttcaaccctccactattagggtaaaatctaccttggatagagaacctgtttgggaagaggaaggaaggaagcaagatgggtgggtgaccctgatcttctctgaggtatcagttgcatcatctcaggcctcctctgcctgatccttctgtcatctgctccattagctcctaggcttttgcaaaactggaaacccttcatctggagccctcaagagcagtactacttaatatgccaatcttcaatgagataagaagcatatgtaccagaatgtaagactgatctcttcatcaagaaaatcttgtatgaaaaaatgttagaactagacagtgtgtttactctgacataattgatttacattcaggcttcatataagttttctatatagtgaccagccagtaacacagtttgcaaattggcagctaatctgcagaccatacttggagtagcagtgctctagagctgcctttcattcagaagcagttgttgaggtcatggagttgtttgtttggtacaggccaagggcagtcagaaatatagagccctggttaagaagagctgtcacccagagcattcagacatgggtcagggcagctactgaggagaagaggggcacaacgagagtgagacagctgaacagatgatcaggcactgcctatgccaagggtaaatgccatgtcctccctttcctttaccacaggcgtgtgagctgagggactagagctagggtcttggttttgcctgttgcttctaatggcaggttggccgcaccaagcttaccctgtcttcctagggaaacggcatacactggagaagaatgtgttggttgtctctgtagtcacacctggatgtaaccagcttcctactttggagtcagtggagaattgtaagtaccatcctgttccctgtcttagaagagcaaacacttgtctgaagctgtaactctggatggcctggcctaaactgctgatgctcggcctggagtcccccttgaccctggggaccgagggtcaccaagtgctgagagccatggaagatgagtttttcctatgcagaaacttaaccagtgctaaaggttggctgtggaacatcacactggctcttcactgagtcccacaggacttctacctggtgtactgaatacatttctattttaggaaagtgtatactttgctacttttctctaatagaccctacactggggaaagcaggggttctggtcacttatactgagatgaagttaagtcattagtccagtgactgcctcctgtcttccctgagcagcatttggggacttctcagtctccaaagtgaacagttgagtttggctccttcctcacattcttggaggaagtagctgaagcatagaggaaggggaaaggagggtgattacaaaggcattgggagcatcgcgtgctgcactcacccctgcaggcatccctgttccctttgccaggagaagacttctttcatctttctgctgtggaaactgacccatgaggtaggtggtgctttgtacagacctccactccagcctgactcttgctgtacatcatcatccagggtctacagagtcactgtggtgaccaccctcccactctggccccagaccaggccatcctacagctgtcttgctctggggacatctcctcattgaaagattttttaaaatatatggtcttactgttttttttttttagtccagtgatttatatagaatatctggtctataatctgagaatagaaaaccttaaccaactaaatgagttcatttctgtcatttcagataccctgaccataaatgatgaccagtgtttactcctctctgagactgtctggggagctctccgaggtaacaaattggggctgattaaaagagagagagaaaggatgatgtgggaaggttggtgttggtggagtgcagtggcccagtccctgctcactgcaacctctgcctcctaggctcaagcaatcttccctctttagcctcccaagtagctgggattacaggtgcctgccaccatgcccagctaattcttgtatttttagtagagatgggatttcaccatattgcccaggccagtcttgaactcctgagttcaagtgatccacccatctcggcctcccaaagttctgggattacaggtgtgtgccaccgcgcccagccaggaagctttttttatgggaacaattggcgtgttttcccgtctctgtggaattgtccctggaagttgacaggttttaccctgtgcagcatcagcaactgctgctgccctagtcaggggctctgggaagcagtaggagagtctgtgggctgatgttctaggtgccagcaggggacaggtagctgggggcagggggaatgatgctaccacagacactgtctgtccagctcttgctaaagacatgtaattggaaaggtttttttaaaaggaaaactataacaaaagaaatagatacatgcaaaaaaaaagataaatagtagtgaaatatttagaactacattatttctggagaaaatgagtttactggctaaactattggcccttgcccttcttctgggtttactgagaaggcatttggtgcctagatacagacttagccaaatatctctcccacttttggtaaaccctctgctggtgaatgatgtgggaaactctctcggaattccacaccttgctttagtttgtcttcattcccttgctccacttctatgcttggagcaacagcatgctgcctccccttcctgccctcttgtacctttcatgcaggtgctgatggtgagtcaggctagaggtaagggaggacctggaactccagaatgctgggtgtcagagtcagagtggggagaagccaaaacagtacactagcagtctgctcaaatcaggtgctgagtgactgctgaggtctcatggattctttcactttgaaactggggactctgataattttcatggggcttctgcagggtttccagaagaggggccccagctgttgagaacatacaatactctgggttcaacatacctgtgtgtgggccttgctagactctaggagacagtgtcagtggactaggggagtccttctggggcagttgctgtccaccacacctcagctccctatagctgggtctcttcttagactctgaagaggaagagtggatgattttttttatcttctaggtccagccatgaacccaggctccttggaaacccaagcttatgatcactttctcacaatttattctgggaccccttttctcagctctcttagctcctgataggggttatccatgaaaagtccaactcttgcaggctgagttgtctctgtgtctgtcctcatgagtatatgtcttggcctctcttctcaatattcttgtgaaggcacaggaaatatagataagaggtatgtgggttttgaaggttagtatgttgtaaggaagggcactaaaacccttactctgacatctcccaaaatgaaatacagaagtaaagatggatagtggcttcctaatatccccttttcatcagtgttaaaaatcgtcaagcctacactacatccattttccctgtgtacccaaatgttatgctctgctacattgagaaccttccaaatagagacatctctttttccactccctgagtctttactctgcctctctacatcttcctaggtctggagacttttagccagcttgtttggaaatctgctgagggcacagtaagtgtggaccctcaaaaagggctcctttttcatctctggggttggatcccaatattgagaatcctagaaaaatcttgttttgccttaggatcctggtggcttgagatagccccagtagaaatggaagaggagatgtgagtggaaaactggtttggtagatttggtctgtttggaatcactgtaatttggtccccctgagtcatcatttagtaatgaccttgaggccacactgctttgaagaaaataaactatgttaacaggaaaatccagaatttgtaggctgagtggtgtttgggacagttgtattaggctggcgttggacaattgctctctgggaaggtggctgcttatggtcatttatagaggtggggagcatttagggagagagcgaccctgagaacagtcacagattggctttttaagaatcctgggagagttgtcttcatctccctgtgcccccatagtaagcttcctttgaaactgacatgttcaatgtttgttctgcacagttctttatcaacaagactgagattgaggactttccccgctttcctcaccggggcttgctgttggatacatctcgccattacctgccactctctagcatcctggacactctggtaaccaggccttaaggccttcttcacacttaagagttctagggtgatggagcaacggacagaccaagttccaaattcttaaagagttagagagggaatgtatggactgggtgtggtggctcatgcctgtaatcccaacactttgggaggccgaggtgggcggatcacctgaagtcagaagttcaaggccagcctggccaacatggtgaaactctgtctctactaaaaatacaaaaattagctgggcatggtggtgcatgcttgtaatcccagctacctgggaggctgaggcaggagaatcgcatgaacccaggaggcagaggttgcagtgggtggagatcacgccactgcactccagcctgggtgaaagagtgagacgctgtctcaaaaaaaaaaaaaaaaattgtatgtaattctatgagctcctgggaaaaatgtagaagatgagctgctccaagactcaaaaaataacagagtgacttaaatctaccttacaggctactgtagatcaatgttcaggctgtttccagggatacaaatgtttaggggaattggcttcattggcagagctaactatatttgtttttgagacagcgtctcaattttttttttttttttttgtattttttgtagagctggggtttcgtcatgttacccaggctggtcttgaactcctgggctcaagcaatctgcccaccttggcctgccagagtggtagaattacaggcatgagtcactacacctggccggcagagctaactttagttagaacaaggtcataggagagagacgttcaaagccttaacttggggccaggtgcagtggctcacacctgtaatcctagcactctgggaggccaaggcgggtggattgcccgagctcaggagtttgagactaacctggccaagacggtgaaaccccatctctactgaaaatacaaaaaattagccaggcgcgatggcgcaaacctgtagtcccagctactcaggagtctgtgatgggagaatcacctgagcctggggagatcaaggatgcatgaactgtgattgcaccactgcactccagcctggacaacagagaccctgtctcaaaaataaataaataaataaataagtgaaggaaggaaggaggctgaggcatgagaagcacttgaacctgggaggtggaggttgcagtgagctgagattgtgccactgcactccagcctgggtgacacagcaagactctgtctcaaaaaaaaaaaaaaaaaaaaaaaaagcctttcctggggaagttcctaactctcttgagtttaatgtgcagtcttatctgacagttcccaatccagttcctgtgtctgccttttcctttgctcctgtgacggaaccaaaggaggccacacatctgccagcctttgcttctgagattatgagttaagaggctactaagttcccaggaggtctcacagttgggcttaacatcagtcagacaaccgaacacaaatggcaagaggaagtattgatcttcaggcttttggaagattccaggctaccacagtagctgcagccctcctcttaatgtggccagaatttatttcaagaagaggaaagaccacttctatcatccatctttggatgtgttctgggaaaagtagaagtgtgctgggccttccctccatgccatccctccctgatgggaaggtttgatagaccccataaatacttaattgagagctgaggcaggtcaagcctgtaggggtgtgtggagcggcctgagagctcgcccaacatcgcaagtttgaggctgaaaccggagagactgtgatgggttcacagtgtgcactttaacctacaggatgtcatggcgtacaataaattgaacgtgttccactggcatctggtagatgatccttccttcccatatgagagcttcacttttccagagctcatgagaaaggtatgttcccgtttcactcagaccaagtttatgggtcaatgtctgaatctggctgtggccctgctggcaagaacagggtctctcatcctaaccagccagttttagaccaatataggggaaggacactggatttggagtcaggagacttgagttcaagtccaaaactttgccgataatttgccttgtgaccttcaggagagaatctcttctggccttattccctttttatgtatttatattctgttaaatggacatagtattaatacctaccatgattatctcactggcattatgatactcagataaaacagatgtgataacttctgggaaattatgatcaagttttttgaagatagtccctgacaccaaagggctatgggcaggttttctgatatctggggagtcttgtgggcattttgagtatcttctactctgctagctttcaggaagtgtgaacctgaagggtgtcttgtgcctttcaggggtcctacaaccctgtcacccacatctacacagcacaggatgtgaaggaggtcattgaatacgcacggctccggggtatccgtgtgcttgcagagtttgacactcctggccacactttgtcctggggaccaggtaagaatgatgtctgggaccagagggactctgcttgttatgctcagagtgaagcttcagggcactggctcatggaagtggcatatcccagccttggtccttagaagaatgttttccatcgacttcttccacctgggaatttagataggaagaactcactttggacaatggaggctgcttcttactattaaaatatgtactgttagactatgtaagggcacatttttctcagatgccgttgcaggtagttgtgcctagagtggatgctgaggaatctgaccaccagggtagaatctgaaagaaagaagcccaagggcagcctgcagaggtcagagtcagtcagtacccctgctccctttcttctgtataccctcagccctccagtgtgagcccccaacacaggttaaatgacagttgaaaagggctactggcctgatagaaaactgaagatattggccgggcgtggtggctcatgtctgtaatcccaccacttttggaggccaaggcgggtggatcacctgaggtcaggagttcaagaccagcctggccaacatggtgaaactccatctctactaaaaatacaaaaattagccaggcgtggtggcaggcgcctgtaatcccagctactcgggaggctgaggcaggagaatcgcttgaacccaggaggcagaggttgcagtgagccaagatcatgccactgtactccagcctgggcgacagagcaagactctgtctcaaaaacaaacaaacaacaacaaccaaaaaaaaaccctgaagatatcttgtgacctcagcgtcaggaagtagtctctgggccaagggagatatcccttagcaaatgtaaaaagattctgggtgatggttgaccccacctacaggaggagatagagaagaaagattttgccagtttggctggattaggctctctctctgcctcaaggcctgtgaggagagcagccttgggagcaagggtagcacctgctagaagcagtgtgtccaggcaagagtgtgcgcactgacagttgtctggctggaacttagcctctgcctatgattgtggatatatttgtatctttttactgtgactaaatggtggtgactaccagtgtctgtgagtgcctaagtgtgcctacctaaatgtgtgtgatgtttatgaatacacttgtcttgctttgtgtgactcgtgtccttacgtgtaggactgtgcgtgggggtttatgtatttgtgacactcatatggggttttctcttggcttaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggtatgagccctttgatcttcccactgtggcctgatcagttgcttactcagaatagaagttagcacccgaggggctgcttagctcagctgctgctctcaggggtctgtatgggctcacattgctcaggtcttaggccttcctctgcccatctacgtagagatcctacctgattttggcaaggctttcactgtgaacctcttccttcctactctcatatccttgaggtattgatagaaaaaacagccctgggcacagaattgtcttggaaaagttcgggatagagaaaaataatccctgtttatgaaggcttaaaattgtctagttgaagagtcaagacacagaattcaagactaataggtgacaatgtctaattagtattcagttgtaaagtccaaacccttggttctagtaagctcaaaagaggctgaggggcttctttgagaagagggcgctagagctgaatctggggaaatcaatttggctttttggagatgtgagcaggggaaaatattccagaaggagaacaatgtgagcaaaatgtggacgtcataacgcaagggatctgcagcaggtgttagacagcaaggcttgtcatccaactggaagagcagataggaaagccgaaatccagtgtgctggagcttcaagttaagaccttggattctcatgttgcagtccagagaggattaatatgttttctctttgggagtttgaacttaaaactcttcaggtccagactcagcctttctcagcctgtgtcaacagcccacctgcttcacataactttgcttggccacactttccacatgtagggcttctgagatccttgcttatttgatttttcaggtgaaaagaggaagttatagggggccaggtgactaatccccaggcattaggctttcaggatgttgaaagattaatcttcattttctcttgggattcaggaagtccaacccagagatccaggactttatgaggaagaaaggcttcggtgaggacttcaagcagctggagtccttctacatccagacgtgaggaaggaaggagggtgggtggggtcccttgggggtcctcctgtggggtcctccctttccataccgagtcaggccctgcttggccactgtctggtccctgcagggttcccttgtcctttgtcccatcctttcagatttggagtggttggttttcagcccaggggaaagacactgcttaatgaggaataggcccctggccaggctcaacccctagagcactggcacaaacagtctagaacccatctgagctaagcagacacttactagacactcctctcctctccaggctgctggacatcgtctcttcttatggcaagggctatgtggtgtggcaggaggtgtttgataataaagtaaaggtgagccggggcagagaagagaagaagccaccagcagtgcctccctctggtctccccagctcctccctgcctctacagagactgatcctcctggtttggattgggctttaatggtcggagcactctccttttctctctagaaaggccacagagtgctgggtgcagtggctcacgcctgtaatccaagcactttggtaggccaaggcagggggattgcttgagcctaggagttcaagaccagcctggccaacatagcaaaaccctcatctctacaaaaaatacaaaaatcaggaggctgaggttggggtactgcttgagcccaggaggcagaggttgctgtgagccaagatgtgcctctgcactcaaccctgggcaacagagtgagaccctgcctcaaaaaaaccaaaggccgctgtggtatgagccctgggtttatgtgtcagagtttctatcttccctcactacaaacttaattaagaactatttctgctgttaggttacttggataggctggatttttcttcctaaatcatagatgagggtcttctgggtctgtgggaccaaggttaccttctcctttattgttgatcagtaagatcccagtctcctgtcacatgcaaggactcttcaggaaccttgtcccgtccccagaaacatctggagacttttggacatggcagctcctgggtcccactgcttgcctccctcagctcacagctggtattactagctctgtgtggacagggaggctgcagagggacggggaggagagctgcagggaggcctcttagggccctggattccttggcctctgtcctgaggtgtgagctcaatggtcaggagtcacagagacatactttgctgctggggaacagagggagcacatacctgttgtcccatgttgcctgtgtatgaataaggcccaggaatctcctcagctttgtgtccttactgccatttgaccttttataacagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtgaaagcagagagctctccttgctaaccaaaggaggctgggttggggcacaggatgggaggcaggaaggtctgggccagacatttccagttagtaaatgaaacaacttagctggggtgagggccacattgggaaggtggttgagagggaccctggagttaccccaccatcaccagactgttgttgcttgttttccctcaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccatatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccaggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaactatttacatagcatttatattgtattaggtataagtaatctaagatcatttcaagtatatgggaagttgtacattggttatatgcaaatactatgtcatttttatataagggacttgagcatccttggattttggtatccacgggggtcctgaaacaaatcccctgtggatactgagggacaactgtattttgtggcaaacactgtgctaagtttgttacaaatattgtctcatttagtcttcaccacagccccatgagacaggtgcattttagagatagacactgaagcacagagttcaggaccttgcccaaagtcactaagaagcaggatttgaaccaggctgacttacaggatgtcatgacacctttgcctctgtcagggatgtgcctgtgtaagatagtcatttccctgattccttcgttggctaggtcttgagtacttgggggacatagcctagtgcagagcagagtcctgggctgagagtcaagcatgatggtgtctaagcctcaattatgtcattcactgggtaacttccagctggttctctaagcatgttgcttacttggatgataagggaagcatgcctagaggtcccctaaggagattggtcaggttatagactgagacccaaggacaggatttcgcatccatgttcatggacaggacagcacctaagtcccccagtgccaccatatttacagcattttagagtcaggaacagagggctaagtagaccaagagcattggctgcctttcagacatccatctatattctaaagggattgagttatttggggttagggtacagagatgggcaggatataaatagatgtcgccaacgtttctggatctccaagacctgtatcagaatcacctgaggcacctgttcagcttgcagattcttgccaatactttgccccaccccaggtgagaatctctggaattgagattcccaggtgcatttggtgtacagtgacagtttgagagtcaccgaaatggggaaggagagactgttgactggtgtgaaaagtgttgctggggccccttctgaggggcttatcttgccatttcttcatgtcctcttgcaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacagaagagcctctcccccatgcatactcatccacctccctcccctagagctattctcctttgggtttcttgctgcttcaattttatacaaccattatttaaatattattaaacacatattgttctctaggcactgtggtagtgggtttttttgttgtttttgtttttgagactgtctcaaaaactctgtcgcccaggctgacagtgcagtggcacaatcttggctcactgcagcctctgcctcctgggttcaagcgattctcgtgcatcagcctcctgagtaactggaattaataggcacgtgccaccatgtccatctaattcatatatatatattttttttttctgagacggagtctcactgtcacacaggctggagtgcagtggcacgatctcgactcactgcaagctccacctcctgggttcacgccattctcctgcctcagcctccccagtagctgggactacaggcgcccgccaccacgcccggctaattttttgtatttttagtagagatggggtttctccgtgttagccaggatggtctcgatctcctgacctcgtgatccgcccgccttggcctcccaaagtgctgggattacaggcgtgagccaccgcgcccggccgaattcatctatttttagtagagatggggtttcactatattggccaggctggtcttgaactcatgacctcagatgttcacttgtcttggcctcccaaagtgctgggattagaggcgtgagccaccgcacgcgggcctgtggtaaattgttgaatttgaaggactcagaggccctggtcaattccaaaataacgtaggcgacttccatccccctcctcccaaccattttcagcccaaagcatcttcgcagggaatggatggctgcgcggaggtgggcggtggctctggagagggtctttgcaggtgtgattttctctagaaggaaatgtctcgtcgtggacccagactgccccctcctggtttcagatgcagaagtgatactgtaagccagaggcgggggcagtaatgcatcgcagccattttaggtgaggatttccttggcggttatttgttaagttctttggctgggccctgggctggggtaacaatggacaggttccaggcatttttttcagaaagcttccagtgtagtggatacagaaacttcaggaaggcagggctgagaaggatctgagtaaaactcggtccttcaacaccatccttcagcccctgggtcatgttccttcgaggtcctggtgggaggtagacaagcctagccttgtgctgttcctgtaaggacagggtgggcattttctaccaacagaattcttggaattttcacacagcccagcctagccaagtccagggctatagcccagatacacaagttaaggtcccagcactggcacccaccacaggagcccccttacctctattacccagaagcttgtaggaggggtggtccgcagacaaggaccctgcacaggtgcgaccctgcttccctcctggtcataactttcatgttactattgcttgggataatgttaagtaaaaatagcagacactgagttttaagtctcaagtggatgaaggcagagatcgtgatacacttgagttaaagcagtagggttctgtcattttctattcctgttgtaaacattttctttaatgttattatttttaccactaaactaacgtggcctggtcacgactttcattggtaaagtgtgctgttcctcaccctccaccgttgctcctttggtccactgatcataagagcatttacctgaaggtcgtcagacctcgaatgccaacaggtcaactgcagtggcctgcagttaccacccagtctgttccaatgaacagaatcgctgttgccccaactcatctcccttcacctaggctgtaaattgaaagtcccacccctgagcggaacacaggccatcttgtgtgctgtgcaccaccagggggtggggaagtttccagactgacttcctggctccagtcatcctaggaaaagagttctccagtcgctccccacccccaccccttcccattccaggagtctattaaggaggcaaagcaggcctaacgggtatcaaagcaaaggagtgaatggagactgggagagtcttcaacctctcctctccttggtaggagctgaggctgcatgccaggtaccttcccttcgaggaatctaataaagctaggtcactggtgttttcaggtgcttctcaaaggattgccgtaggggtaggatatcaggatgtgggagcacaggtgccaccacagcactagtgatggagagtcattgcccctagacttctgggacagtgagactgtgaggaaagctgaaatgatactgggaaagggtgaaagaaaggatgtaggtggaatttatttagtattaatgtaggtacacataccttatggcaacattcctagcactctaaattctagatttgtatagtttctgtcaatatcttttgtaagcttaatcaatacagggcatgacaagtatgtgtcacatacttttttttccacgaagaaaaaaaataagtaggaattgggtgctttgtttatcaaaatttgtatttcctttataaataaactttgaaataaaggttgaaaattagtatcttt

SEQ ID NO: 31 - DNA, 891110 bp, Homo sapiens
  source 1..891110: mol_type = genomic DNA
aggacggaatttatcagaagcaggcctattgcgtacttggaaaagataactaaggtgagtcagctcctggctttttcttttgatataactcagatgactgtgattttgccaaagttataaatggccagcaggccctttgctgaaacatattttctttatcctgaactgtaagttttatatcttctaccctggtaaattttatgcatgtcaattagaagaggcattttagagaaaaggcatagatgcatgttgaacagtgatacctgtctcactactcaacatcctcattagtaccttgtttaaattacatttttggaaattctccatatggataattatgaattgataaaggattctttcaaatgatgtctacattcagcactagaaagattattaaataatctctcccacattgttgccattaatgatttcactctgagccaggtttgatacttatagaaacaactgagtgttagcatatcatttcactttcaataatttgaaacatagggtgataccaatttctgagatttatactcagacctcaagtaaaaaagacagaagcagagtaaaagaatggcagagagagagagagagagagagagagagagagagagaaggaatgaatttcctatctagattccagagatagaaaagggcttaattctttaacaatattagaaggacataacttttcttcccactcactggagtgacccttgaaatgtggaaagaatctattatcattattttgaaggcctaaagcagaaccgtatatttaaaagcatatgcctaacacttttagaaagcatgagacattacaaaagaatgcaagccataaaacataattatttttcagcatttaaggaattgattttactcacttaaggagttgggaatgggtatacatcacttcctaataattagtaatatacttggcaaaaagtgattatataatacctgaagtcagccaaacatggacaacctaatatggtcaggaaaagcaataacctttaggatgctaaacaggaggtctggtctacatttttagaagggatgtggacacaaggtttagtatttcatgttggtgtctctaaacttaatatgggtatttctcaggatgtaaagaaagctaatcatttactctgtaaacatttgttttatatgtttattctagtaaataacaggaatattgggcattgagtcattacacaggatgaatttttgtcattgtttggaaggacacttgtttattataaaacgtttttgaaaatagatattcaattgaaaggaccgcattcctgtctatttctgaaaatggtcaattttctagttaattactggacaagatgtgttctgctggaggacactggtcatgaactccctttggctctcagaaaagtcaagtggctgccttcctgtgtctgcctctccccaggaaatcaccgactaaagtcagaatcctgaactctcttatcaacaaccttaaatgctgggagcaaaatctgacgtcatgagtgtccatatctttcctgctttctggaaatgcctgttggatcacccatggaaatgtgtaggaggaaaacgagcaatagggatttttcaatttgttaggtagaactagtgcttccagttaattattcatttatattccccctatggcttttagataagttttatattatttatttttattacatgaattcatatgtagattctattggcaaattttgttcctaaaatagcaaataaaactaaagagtttttgagtgatcaccaaacccatacccttcatactatatctttttattccttttgccgtgcatatacattgtatgtgactgtgtatggatgtgtgtgtatgcattcatatacttataaactatatgtaaaacatatggttaaacattttttccatatagtttggctatttgcatttcctccccattaatgtcctgtctataacattcaagtgaagagcttatcaaaatataaatatacagggatttttgatatatgaattatttcataggttttatcactgtacaggtcacttagaaagattttagacatctttccttgtcagagcatagagaactaccaatttctttaaaattgctgaataggttttccatagagtatatttaacagattttattcaaatattccctttttgtgcctctttgcacatgtttcaggtttttctagcataaccagaagtagaattgttcaaaggaactacatattttaattctaattttaaaggaattctgtgaaattctccttcaaaatagctgcactaaattattcccagcagtcatgcatgaaagttaatgtatctctcatccttgccaacacttgagactgacaaagttttaattttttgccaagttgatgcaaattattgcatcaaattttgttcaaattttcagttccctgggtaacaagtgcagttgagcatattttccgtatagttattggtcagttgcatttcttaccttaaatttccaatttatgaaattcaaataaatgcaattattattgttatagtattatttttgtctatcttttacctatatttggtgaaagtattttcttgtcaaattgaagaaattacttatatatcttgaatatctatttaatttgtgttataaatgatttccctgttttatggtttgtcttttaatttcaataatcacatattttataatataaaaccttaaaattatgatttaaatttgtcagactttttctttatagcattgtcagaccttttcaaagccacaaacatactctcatttttgttaaagttttttttatatatgttgattttaatccatctggaattattttttgtaagtggtgggtggaaggtagggtttgaattttattgtttccagatggaaaatctgttgcccaatatcatttagtgactagtttattctcttgctgataggaaatgccacctcatttacatatgaaattctcatagatgcacatgtactcttgaccaatttctcccatttaaatttataaaattataccacttacaaatattagaaattcaactattattggcaataattatgctcttcattcatttaataatgtttactgtttactgcatgtctattatgtgccaatcccactattctaagccttgggagagagcaattagcaaaatagactaaggccctgcactcatcgctgttatgtctgtaaggggtggtgggccagagagcaccacacaaccgacaggtatgatgtagctgaactgcagggtgtcaaacttaaaaaaatgttgacattctcttatataaagatctcatccattttatcttcaccaagataaggtatctggtgttttttttttctttgagacagagtctcgctgtgttgcccagactggagagcagtggtgtgacttcggctcactgaaacttccgcctcccgggttcaagtaattctcctacctcagcctcctgaatagctgggattacaggcatgtgtcaccacacctggctaatttttgtagttttagtagagatgggatttcaccatggtggtcaggcttgtctcgaactcctgacctcgtgatctgcctgcctcggcctcccaaagtgctgggattataggcgtgaaccaccgcgcctggcctaacttacttatttctaaacttcacatcagaggtgatcactatgcaaaactctgaaactatagaaaaagtacatggcaagtcctttttcctcaaaaaatttgaaatcaatctgaggaaatgagacagcaacaatcaaaaggatatgatataaatagtcaaagggcctaataaatgaaaggcttcaagatagtacagcgttaattttaatattaataaaataaacaacaaaaaccatgccaacctgagggaccaggtctttgtgctgtggacagattggtctaaactctactctagttataagtatacaaatgattggatacaaaagcatggcattcttgatcaggggaatttcattagttttactgaaaaaaagaaaaggatgtgtcattagagaatagacggaaaaaagtagtatagagagagcttttagaggtccttaaatagctaaatagtttgtatcttatctacatcaagggaaatcaaaagaaaacttttcagcagaagaacatggtcaatgtgtaacttcaatgaaccagtggtcctggaaaccttgaagataagacttctctagacaaaaatctgtcttctttaccttaacttttctttacatttttctcttctcccaaagatgctcagtatccttgggctgaccttttctctatattagtgccttttggtattttggacactccagaaatacaaaatattcttctctatttctcaactcccaaggaaaaattaaatagcctctgccacatatataatgaatctaaagataaccctcaagcacagatcatcatggctgctcttgaacctacctctcctgtaaaatacatttgcatgtaacatgagttgctgaagagtcaagagacaaaaatctctttgctcaaaagtgtatgagaatttctgtttctggggtagcctgggaggagagatgcttttgtctctgggtaagctttaggtcttgcggtagcctctaaaatgatttccaatgatccccacctctgggctttcctctgttcatgtcatccccttttctgaaatgtagcctggacttctgacaaacaggatacggcgaaagtgatgagatgtcacttctacgattaggttataaaagactgttttccatcttgcctgttctctctggctctctctttaggtgataatgaatgcaagccaactgctatgttgtaaactgagtgatagaaggcccctatggaaagggactcaaggaggactcagtctaccagctaatgagggcatgaatactgttaacaaacatgagagtgaatttgcccctagtggaggtttgagctggctgcagcattagtttgattgcagccttgtgagaaacttccagacagaagacccagcaaagccacacccaaattcctgacccaaagaatctgtgagatcataaataatttattgctttgacaagctgctaagttttgggtaatttgttgttcatcaaatataactaatacaggccacctcccagcagaacattttgtagctgttgtaggactcacagaatgttggcataggaagagattgaaatcaactgaatttatgccctgttagatgtttgagacccctgtaatttcctgcttagagacggtcaagtaagacttgcacatctcccatgctgtaaacatcttaacacaattttcggttgactctggaaatttcccctgtaatagtctgttaataatgatgaacttttatgtctccatgatcaactgtcattcatgttggcttctcatttgtgataagaaaaattatattatctattaaaattgatgggaaaggaaaagtatgtcgtttagaagatcatcattcttggtctaactcgtctttctatagctgagtttcccgtgtaacaacatgtaatctcagaaaattgaaatgtaaaatgtcaacataaatgtgctctgaagccatgataaaaagtgaaaaatggattgtctctgtagttgtaataaatacccacaaatatttcttttttaaaaaaagataaaatacatctaacaaattgtatagtcatgtcagtgatttggcttttttaggaagaaaatctgcacaatgataatccataaactcataacattaataacaagctctccattaataacaagcatgagacagctgcactgcatcttgaaatcccacagcatttcccaactgcactgctaacaaattgaagtcatacacccaaatgtggtgaagcaatccatttactagcagctgtgaaacactggtcagctgaaatagactctgaagataatttaactggcaaaggcaattgaaaaaatactgcactcatggatgatttgtgaatctgaggctattgatagcctgcccttatcccttgggactcatccctgcactatgaaggctgcttatttcaaacacctgctgctctctgcctgtgagctttaattctgacctatgttcagggcaaaccagaaatgctggaggagggataatgttctttatccaagcttcaaccaatgttggagtagaagttggaagatagatacaccatctcccttcatctctgttggtgtaacttcaatgtatattctacattgtctcccagagtctcccctcccacctacacacatttaagcagcagttgcccacagtaggaactgctttataatgtagcctttattgcctgactttccttccttatcttatttttctaccccactactagtgtttcctgagatcacttctaataactagcaatgttccgaatatcactcaaagtatttggactcaaatccatgtctccacttcggttgctagggaaacccaacctaagacaacttatttggcagttgcgcatttaaaccaggtattatacccaaagaatttgggaagttttatacccactgaaatgcttaacaacagaggacacaaaatgcagcaagttttctcgagtaaggaaccaaaaccagacttgggacattaccttttgaatttttgttacattttcttttacatatcttcaattttgaagtggttccagaagtccattagcttttgttacaacagagatttccaacatagtcttcaaaccttcatgaaacagagggttaaatatagtattccacaacccaaagagactgtggatatatgtatccacagaaaggttcacaatattagcaataactataccttaataaatgcttattatgggacaggaaatgtgttattatacatatttaccttttctgtgttcaaaataaccttaagctttaggtactgttcttgttgtcttattttgtcattttctaacagattcattgttgacataaatgacataaaatatttacataaagtacaatttgacaactctagacatatgtatatacacatgaaataattatcatcattaggatagtgaatataccccaagctcccagaaactttctcatgatcctttgtaattcctctctattccttacctcttctcccctgccttcctcaggcaacagccagaatagattaatttacattttctagaatcttatgtaaatgaaataatacagaatgtactcttgctatctgacttctttcattcataattattttgagatgcatccgtattatatatatatctataattcactcttttattgttgagtttattctgctgtatggacctactacaatttgcttatccattcaccagttgaaaaactacattttttttaaatccatttacctgttgacttattctttccagcttttgattattataaatgtaaacatttttgtataagattttgtatgtatataggctttcattttggagatataaatagcagtgcaattactagattgaatggtaaatatatgtataacattttaagaaattgccattgtatcattttatattcccaccaacaatgtatgacaattccagttttccacatcctcaccaacacttgatattattaggcctttaatttttagcagttcttacagtgtgtagtggtatctcattgtaggtttaatttgcatttactattgattgatgttgaacatcttttcatctgcttatttgtcctctgcatatcttctttggtgttcaagtaatttgccaatttttattgatttggagttttttgtattattatttggatttgagggttatttacttattcttcacacaaatcctttatccaatatatgtttgtcaaatatttctcacattctgaggttcatttttttcattctgtaaataccgttttttgaaaataatttttaattttgatgaagtccaatttgtcaatgttttcttgtatgaactatgctttaggcatcttatctaagaactctgcctaaccaaaggtcataaaggctttttcctttgttttcttcaagatgttttaaagttttaagtttaatattgaaatctacgatttattttgaattaatctgtatatatactaagagatatggatcaaaatttattttttgtttattcaatatatccagtactacttgtttaaaagactattcattctccattgattttcctttgcgcctgttcctaaaatcaatggtcaatgaatatgtaggtctatttatggaatttctattctgatctattattatcgttgtctaccgtcacacaaacacgacactgtcttaattattatagctttataagtattgaaatccagtagagttactcctccaaatttgcttttctttttagttattttggctatttcaggtcctttgcactttcctttgaattttagaatcttgtcaatttcacaataaaatgcctactctggttttgattgagattgcgttgaatctattcatcaaattggagaaaattgccatattaacaatatgaatctttagattcatgagcatgagatgtctttctatttatttagatcttctttaatttctctcagtaatatgttgcagttaaaattgtagttttcaatgattagcactgccacatctttattcaggcttatccttaagtactttgcatttttgatgctattgtaagtggtgttattttaatttctgaatattcactgctaatatatagaacaataattgatttttgtgtattgcttgtactctgaaatcctgttcaagtcaattattagttctaggagctttttttgtagatttatttggattttcaagatataatctagctgtctttgaatgaagacagttttccttcttcctgtccagttggaacaattttaatttctttttcttgctgtattcagtagatgaaatctccagtacaaacttaaatagaaatagtgagagtgaacatcattgtcttgctcctgatcttaggaagaaagcatttagtctttcaccattaactatgatgttagttgtgggtttattgtagatgttgtttatcatgttaagtaacttcccttatgttgctagtttgctaagaattaatctaggaatggatactagattttatcaaatcctctttctgcatttatcgacaaggtcgtggggttccttttaggtctactaatattgtgcattacactgactaattttttttaatgttacataaaccctgcaatcaatggataaaacctaattatccatgatatattaccttttttatttatcaaatgatttcatttgctaaaattttgtttagaatgtttgcacatgcatttctgagggatactggtctacatataatataacgtatcttgtccgtcttctgtattattaatagtgctacttcatacaatgggttgggaaatattccctgctcaccaattttctggatgtatttgtatgaaaattgatatcatttcttccttaaatgtttgctagacttcagcagtgaagccagttaagcctgaagtttcctttgtgggaaagattttaattacaaattcaatttctttaaaagatatagggctattccacttacatatttttcttacatgagctttagtcatttgtttcttttaaattatttgtgcatttaattttttgttgaatttattagcgtgcagttgttcataatatttccttgttatccttttaagatctgtaaaatttgcagtaatatcacctctctaattcttaattcttataatttgtatcttctcactttttttttcctggtctgtctgccaagaggtttatcagctctattaatcttctcaaaaaatcagcctttggtatttatttttctctgttatttttctgtcttgtattccattgatttccagtatgatttttgttatttcctttcttctgcttatgttaatctgttctttgttttctagtttcttagatggaggttaaggtaattgacttaggatctttcttgttttataaaataggatttgagtactgtaaaattaccagtaaatgctgattttagagcatctcacaaattttgaaatgttttgttttaattttaattcagtctaaaatatttcctaatttatcttttgatttcttttttaactcatggattattagaagttattaccaaataattgtggattttttagagttttttaatgttaatgatgtttatttttctcccaagttgacagagaatgtattttgcatgatatgaatccattttcatttattgagatttattttaatgcccagaatattatctatcttagcaaatgttttctgtgtacttgatagtaatgggtattctcctattgttgggatgggtttctagaaatgtaaattaaatcaagtagggtgattatgttgttcaaacttctgtattcttactattctctgttttgttctaccatttgttgagagagacatattgacatatttgactataattgtggatttactcattttttcctatggttctatcggttttcacttatgtattttcaaattctgttattaaatgcataaacaatgaggattgttacatcctcttgatgtgttgactgctttatcattgtgaaatgatcttctttatatctgtaatattttttactctaaaaatgcctttttctgatattcacataatctcttcagctttcttttgcttagaatgagcacagtatatttatattttttcactcttttagttttaacttgtttattattacattaaattatattttgttttacacaatataaaattggggccttatgattttccaatatagtacatttgctttttagtaggagtgcttgaaacatttgcattcaatgtaattactgttatgcttagatttaagtctgtcaccttgctatttattttgcatttgtctcatctccctttttcctttttccattgtttggattaagtattttgtgattttatctcctttgttggcttactaggtataatttcttgttgcatttgcttagtggtcttttttgggtttgtaacatgcatctctaacttaacacattctaccatcaactgataatatagtcagtatagagtttaacaatcttaacaatcatatataccatttcatatctcctctcccaaatcttgattgttacatttttacttatgttataaatcccacactacattattatttttgtttaaacaataaattttcttttaatacaatttaaataataagaaaaataattcgcttatatttacccacatagttaacattgccagtgtttttcatttctttgtgggtctatatttctacctgctgtcatttttcttttgttaagaaaacttccattaagatttcttgtaacatagatctgttggagatgaattctttcgactattgtgtgtttgaaaaaaattcattatttcatatttgtgtttaaaatatggtttcttttctgggcatttggaactctgagttaacaggcttggggggagaatgggcaaggtttcagaattttcaagctgttgctcccttgtcttctctcttgcattgttttctgagaataatatttttgttcatctatatagatatctttttttcttgctatttaaaaatttttctcattattaccgagtttgagcaatttgatcaagctgtacccaggtatactttcttcttcttctccttcttcttcttcttcttccttttcttcctcttcttcttcttcttcttcttctttttggtgttcattgaacttcttggatctttggtttttcattattcatcaaattgggaaaaaatatcagttttgtttctttaaaaaccctgccttttggcatctctatttacttgtgtaggtaagcaacgtgaagttgttccttagctcttggcatttcatttcggatagtttgtattgctatgtcttcacattttctaacaatttactctgtaatgctcaatcagctattaatctcatccagtgtattttttatctcagacattataggtttcattcttagatgtgtaatctgatctttcatttctctatttatctttttgaatctatggaagctgccttaatgtccttgcctgctaattctaatatctgtgtcagttctggattattttcaagtaattgatttttcttctcattgtgaatcttattttcctgtttccttttaagcctagcaattttctattggatagctggcattgattgcaaattttatcctttcgtgtgttaatatttatatattactataaatgtgtcctgtagctttattatagaagagagttaagttacttacaaacagtttaatcctttcaggtcttgcttttataacttgttaagtgaatccataggatacttagtcgaaggttaattattctttactactgaggcactgtatccaatgttatatgaattttgaggttctccagtctggctagttggtacagccactgttctcagccctgtgtgagtgttagacgatgttcattctaatccttttgactcattctttccttggtctcgggtaatctctatagaagcaagtgccgatcactgctctgctgagtagccacaggacaccccttgcatatttctggaatgctgtctctattcagctctcccgtttccaacactttgtcaagagaactgtagacaacttgttctctccacacacagctccttctcctcaacttaaggccagaatattctgggctttccctgggattctccctctctttgccaaggcataaaaattcatagaatggggccacttaacgactcacctccttggtttcatgtctctctgggatcgccattcttgcttgtctaatgtccagtgtcttgaaaaccatagttaatatatttcatccagttggttttattgtttctgatggaaagataaatctgatccctattattctattgttgctggaaccagaagtcccctgcaattccttattgcaatttaataaatgaataaactaaaacacagggagtatcttgcttaaggtcacacagtattaagtggtaagggcagaattcaaacatagaatttcaaattccagagcatttactcttcactactactctctacagtttatgtaaatcatatttcagtccttgccacctagttaatactcaacaactattacttttaatattattgataataacaagaaagctattaaattgaggcaaaaaatgtacacagaacaaaaaaattaaaagatcagattacttacatacaggcaagggactctaaatcacataaagtaataacataaagaacaacagtaattcaggtacagacattaaagaatttttttcaaatagttaaagttgagcaagaaaatatggatctaaatcttaacacaataaattcagattaggcttcaggaagaaattctaattgtggaacattttagaaacctttacttgggttgcaaaaaaccaacaaaacattttagaacatttagaaacaaactgagctcctctgcatttcacactaaggccattgcacggcatccgggtccttttgctcctcttgggagtccctttttcacagtttctgccttagggaaaggtcatcatcccagtttttctcttgcattattttcacctttatctgtttcttccagagattctagtgaaaagctgagaagactgcactgtgaatcagatatacatacatatatccctgaaggtgttctccagtgaggactcccccgaaagccactgacttaaaccttctcaagactgattcctggaaaatgtaaatagctcactttttggaaatcatgcgaatgagaggcccagatgataatgtaaaagcattactagagttaaggggaaaaaataagttaggtcagtcactagtttatcatcacatgtgttttattttttttaatgggggcatctttatcattttgtttctgatgaatatataaaagtgtatactggactacgctctctatatatgcacatattatatatgtacatacataacatacacacgcacacacacacatgcatgcacacacagacgtgcgcacacacacgcacacatacatatccacaaaaggctgagaaacttgaagtgacagctttcaatctctcctccagtcctttgattctgtctaattaaatctagccatttctcatacattgcagtagctggcaggtaatattcatcatttggcagccaagaaggtgatgtttattgcaaaccttgagagtgagaaaatactataatagttccttttcttcccaatctgcctccatacagctagagattaaaattaatactgtaaaacatctggcttagggcctggtacagaataggagcctaataactgacaccacacatttctatgaatgaaaaattttgggaaataaaaatattactgatggagggaatgaagtcaattagaaagaaaaagaaagaatggggaggacagggtagcatggcactcagagcaattttttgctcaatcagaaattggaaaatgagtagaatgtatagataagacaatgatgaacataagcaatcaattttttggtttaattaaggtcaagttaacaacatatcccaggggactaaaagttacaaggcactcagtaagtgtagttaaacaccatctcaatggacccttgggacaatctccattttcaagaggatttggaagctcctgaatcaagaagtgaagtgcaaaactaaaggtttcaataagactagtggaagggaggagagagcaagtatgttttacagaagatacttcaggatagatgataaatcaggcttggaggacaaacgcctctctcactatcatcttttctcatctttggtaattccatactggcccgagtggctttattctaacttgcttactaatgcttcaattttaaaaaatgtttttgctgatttaacctcattgaaacaggaatcaagtatataaaatacaacgaatatttaatggaatactcatatattttatcaaacaattttacatggtaaatataaacttcctgttactttttcctttaaaaaaactattctcaaatatatcatagtgtatctcatatccccaccaccatgaaattttttgactgagatttgctcttttctcttgcacccgattagtagttttgtttccgaatccactgtactgagtcactcacgtctgtagagccctcatggtttttcctcaccttttcagacaatagaaatatgatcattgcaggcaatgggttattatctgcaactcccaggagacacagttccttagatattccaaatatttcatcacaggccacagcattgtacatttaggaaagaatgggaaagaattgcatatccacctgtgcatgatatttctgtagttgcaaaagttattctagagaaattgcattttcctcctccttcttatcatttaatagcatgctttgaggtgcatacaccctctgggaagatgtgctctctgcccaatggggttgctgctaagaaactctgggaagatgtgctctctgcccaatggggttgctgctaagaaactctgggaagatgtgctctctgcccaatggggttgctgctaagaaactctgggaagatgtgctctctgcccaatgcggttgctgctaagaaaaggccctgactgaccctttccatcaaacccacatcaaccctttttgaagaccgagcttttaatcatgtacgtatttagctctgaattgaaaaataaatggtatccagggctaagtgacttagcaaacaaatgatgcgtggaaattacatagccatgtactctcttgaattgtcccacagaattggtttaatgagatggagatgacaattaactttttccaattaacatgtctctaattcaacattcagttgctgaatgtcaaagaaagctccacaaatcattcaggggtcaacaactaaatgctatgagcagagtttttaatgatcttactttctaattttaatatgaatttcaatattacattaacatcctcttcccatttcaaaacattagaccggtgggcactgcccctcctttgctccaaaaatgcagagaaaacaatagcatttagaaatctgagaacttcaaagaacttctttatttttgtctagataggaataattgcaacagtccaaggccatgacatttggggtcaaaagaattggatttgaatcttgattcttcccttcctagccgagaggcattctgcaaagtgcatagtctctggttcattttctgtaaagtgggagaaatattaaccattttttacagagctgtcatgaggatcaaataggttaacatacataaaatgtctgacaatgtcaattcctcctattttaatgtaaacacaatattgtgagttcaaatcttattaactgccatagttagagggatcggggtggtgtccatatttccctgccagaatttataggttgcagtgacacatgtgtcaacttattattataaggagtcttatcctctgtgagtagattttcataatttttcttagtatttctcaactcattacagttctgtaggcaattgtcatgctatatacagaaaagctagagaagtacttgataatttgtctaaagcttagcagattctttgactcttctagcctaccctgtggcatgttctgattcaactgtacttttagcttctgggttcccccaaatcacaccttatcatctaaatctacgatattgaacattttaaactccaagtgctcataagtaaaaaataacttatacataccgtctataaaatagatttatttataaatgatatgtatgcacttctgtactaatgcaatccatacattttaaaacatggattacaaaataaacataaataaaagtgctcatattttccttacatattacagtagatcatcttgcacatcccttggtgtgcatttcttttgagatataatgcttctcctgttgaaagttgtatgatggtggggaatgaatgaggcagagcagttgatgctagaaactatcattgctttgttttaaattgttaaaacttctttataaggttatacattggccatatttttgctgtagcagattcttttactctcattttacaggcagccaaatcaggcttctttactttgccaacaagaactggagggaactgggctcttggctgaatgccagccaacacttttactagcttcatgtttttgttaccaaacattacatcgtgtcctttgagatttacaaagttggcttcaatccccagactgaattctgtgcaaattttcttgccctctctaagatttccacaagttccacagaaggtttatatccccatggttacctctcccttcactttctcattgtgaaattctctatcttgtttacttcttgctaccctgcaggggttctgtcctctcaccttgaacctacccaggagagaaacatgggtcaccagcataggaaatgactataatagctggaagagctatatcacactgcagaggagcagatatttacaaataaatattacttatcttctcatatttattcttaaatattctcccagtcttgagcaaactttgtttcaaagaggtgaattgcaggacaagggaggccaacattagagttgtgcaatagcacttcacataacaattgttgatccttgtgtcactataccaatatgccataatcgtgacgtgtgatacaagtaatttattcataacagactatgactaatacatattgttactaaatcagaatggaatcagggctactctcataaaaatgtcattttcacttccttgaattgttatacaaattacagagtaggagagaaagtggtagcattgcaacaagtgtgctgggaatggtgcataaaactggtgtatctctgagagttgccccatatgtgaactttaaccatgcttaaagcttcagcaagaaaatgttaactctcactcatttagaccaatgaatctccagtatggtatccataatcaatgagcaagtaagttgattcagtgggtcaaaaattaaatattataacttatactaatacttacttttatctcatactttaaaatttatctttcgtttgcatgtaaatgtaaaaatacatgcaaaagttttaaaacacagccatagttatttgacatttttctcatcaagatttgggtctatgttccctccccttgaatttaaatttttgtataaatagagggtggccaaagagatgctatgtgactttcaaggctaggtcataaaaggtgatgcaggcttcaccttgtttactggaacacttgctcttgcaaccctgaaccactatgtaatgagtccaaacatcctgagatccccatgctgtgagggagcccaacctacaaggagagttctcatgtaggcactctggtccatcacaaatcccaggtgaacccagcctaagcaccagacatgtaagcagagaagctttcagatgatcccatacttcagcattttgagtcactttcagctatttgagatttcctgttgaaactccagccattatggaaccaatgcaaaacaacctctgtccacatttctgactcagagtacatgagcataaaaaaaaagtttgttgttttatgctattaagttttgtgggttttttaatgcagcattagataatttaaaatccaaacaatatatcaatatattagtacatttaaacaatttacagatagatttacgttgttacagtgtatacaaaacaaattttactgatggaatgagagcaggataaagaggcttgaagaccactgagctcaatagcagagagtgagccagggcgtatagaaactaaaggtagacaggaagaatgtgtaaacagatgggctaatgtgatccaaaaatagagctgaacatcagataggaaatagtatattggctaatcagtaatcataaatcgaattggcaaatgcaagaatcaaagatgtgacagagattaggtaaaacaaatccaattgcataggtagagaattaggtaacagatctcagagactttcaggtgacctagagacaaaggcaaaaattcagtgctgccaagagcttacacgcactttctcttagagtagaaacaaacttcaggcttgtgaagcagtggaagcaagtgaataaaagcaccacattgaaacaaagattgtagaggcagcactgagaaggctggcaggtaaggattttctcgaccaggggtaacctgttactttgtcttagggctctgcacatttccttgaaagtaatgagatataattcattgatcctacactcactccatcagtaaaatttattttgtatacactgtaacaatgtagatctatctgcaaattatttaaatgtactaatatattgatagattatgttgtttgaattttagattaatgttgcattgaaaaataccataaaatacatatcataaaattttacctattaagaaagtatgttttaataggtaaaaaaagttatgatgtttgcataactttgtgaatatactaagaagcactgtttttgttgtagtatattcacaaagttatgcaaatatcaccactctctaattccagaatattttcatcatccctaaaagaaactctatccattagcagtgaccacagtctctcctcccagctcctaccaaactcaaatctactttctgtctcttacaatttgcctattctggacatttcattataaatagaatcatacaacatgtggccttttgtgtctggcttccttctcttagcatacggttttcaaggtttatccatgctacagcaggtatcagtacttcactgatttttgtagttgaataatattctattgtactacattttgtttatctgctcatcagttgatggaaatttgggttatttccactctttggatattataaatcatacttttatgaatatttttgtacacatttttgcatgaatatatgttttcaattattttggccatacacctaggagtgcaatcgctagattgtatggtaactttaactatttgagaaacattctgtttttcagaggttgaaaattttacattcccaccagcaatgtgtacagctttcaatttctatacatcttcaccatttgtcacttattattatctattttttaaaattatagtcactctagaagttgtggtatctcgttgtggttttgatttgcatttctctgattagctaataatattgagagtctgttcatgtgctcattggacatgactaagttaagtttaatttagcttttgagatgtatgttttgtacagcaggtgataaaattaatgtatgaaagaaccatgtctgttttgctcacctttcttccctaatgcctggtgcacaggagagctgtgtctattcactgactgagaaattgataagacaaatgagtgaatggacaggcatcctcctttataatggtaaaggaactcaaagttgctcatcattaatggtgtgtgaaaagaataaaagattttgtcattttgtctagattcactttttcttgaaattctagctcagggtttctttccagtacaaaggatacaacctttaggaattacacaatgttctgtgtgtccttaaactggtcagtctttctcaacatatttcaataaagggagagaaatttatctcaaacattgtcaaatacgacagggttgtttgctgtggcaaatgatccccagctacaacattatcattgtgtgttcactctgggatctgccacacttggccatagagcccagagggggttatagtcaaagactcacctatttggtgcttgttcacccaccatctcccattcagttaaacctggcgaatatcccacagaagatgcttaatatcattgagagacagctgatttaggtctacagctggcctgtctctattacagatttcttgcttttataccacagcgtggataacccacatgatctgtattttcagcatgacacaatattcaagaatattgaaaatgattcagtcaaagagatgaccagttcttactggaggaccactttccttttatcatggctattgtaataaatggcattcttatacattctttgaaacaaaggattaaaaatgatcttttcttcatgcccaccagcagcaagagttacctgcttgccctacattaaaacaataatggatagtaccaggttgttcactcttttacttttaaaacttactgcagccttcaaaagctttttgctctttgatagaatatttcaacgtgatcagaaagaccaccttgctttgagatgaagtttaggctttgtcttttgagaagtatacccagcaagatggtaaagccagaaaactgcagttgttgagatttaatgcattgagtttgtttttctgttgagcagttgttatataaagccactctattaagccaggaacactggaggaactggtttatctttgacttttgaattttggggaagttccaatttcctacaacttttaatctttctatgttgctgatttgtaggaagtcatgttgtttcattatcacttgagatattagtatctatatattatgaacatgagcctgaatcctccaaacatttttaaaaagatgccagcatatctaatatgaagttgaacttgctacctcttatattgttttccctataaacacacagaatagtggatacccatgcattttccaatactgcctagtgaattgcagggtgttctttatataatctatcagcagtaaaacatcctgaaacatgtagtaattgcttaggtcaaataatgtaatatatctttgatgcgctgaaatagacaatgaagagtactagcttttcagtgatgcctaggtggaaatatacttccacaaatttctgttgaggccatgtctgaatgggttcactgaggggagacagagttacataccatgtatgttgagaaaaactcgacagtgttagctttctgctactagcgcttcatgaactattactattattttttttccagtggacccttattggaaaaatctcatgttcacattttcctgtaggaggatttagcactggattggatcaatgtctttagggctcattgatcaagagtttttcaatgattaaaagaatagttttctgtcatgcttatggtggctaagaaattacatttgactataagagttgctttattttttcacattctataaagtcagctggcactcaatagtactttggaacagtgactggatatttgccagtgatctgatgatgacatagtggaatcagaacattttgatactcctttgtttgtttgggatttcatcttcaaactccatcaatcaacatgtaaagaaaaagatggaaattcacattcacaatagcttactttcaactggcttgtactagtatctattagaatttttaaaatggtgtcctataaccttctctcaagagatgcttaagctaatggtatgcttggaccagctcacactgtcttgcaaagccagttggatgcatctcttcatgactaagaattcacttacttcaggttggcaacttgcagtcaccaatggatagagcattaacataatagaaattggcaaatgctacaaatcagggtgctactttcctccagagtgttagttgttaaacatttagtggtccatcgctgattataccacttgtttctaagaaaaactattaggagaggacctaatgcatgacattgtgatttgtgtcatatgaccttggtaatctgcagtcctaattttgatccctctagacactaaggcaagtattcaagtacgagtaattttttgggagtttagacaacagcagctggggacttgggagctgaggctgggaacagaaagcaaccaacacaagattcattcttaagtcagctaccaaggtgggcaactcctaaaactaataattgaagtcaacatggttacaggattcaagacaaacatattagaatcaattgtattgatatgctagcaataaacacatgaacactgaaattaaaaatgtaacatcacttaaaattgctcaaaaatacaattcttaagagtacctctaaaaaccatgtacagtgcttataaggtgaaagttcacaatgatgattaaggaaatcaaagaaaatctgaataaagatgcatactacattcatagattgaatgaatcaacacaggaaagatgtcaattatccccaaaattacatacagttttaatgcaattcctgtcaaaagcccccccagcaatttctttagtagatatggaagaaactattctaaaatttgtatggggagggagacaaactgagagggatcagtcttcttgattctaggaatttttaaagagctatagtaatcagacccgtgtagcactgacaagaggaatagacacaccaatcaatggaacagaatagagaatccagaaatagattcatacaagtatgcccaattggtattttgacaaatttaccaaagcaattcaatggaggaaaaatagcctttccaataagtggcaagtggtgttgaagcaattggaaatccagaaagaaagagagaaagaggaagagagagagagagacagagacagagagatagagagagagagaaagagaaaggaagaaagacaaagggaagaaaaagaaaaagaacctcaacctaaacctcacaatttattcagaaattactcaaaattgatcacagatttaaatacagtatacaaatctataaaattttagaaacctaagagaaaatctttggcatataagactaggcaaagcattcttagacttgacaccaaaaacatgatccaaaaaaggaaaaaattataaatgaaacttcaaatttaaaagttttactctgcaaaaaccctgttgaaaggatgaaaagagaagatacagagtgagagaaaatatttgcaaaccacatatgcaaagaaggactagtttctagaatatacaaaaagaactgccaaaactcaacaaaacaagcaatcaaattagaacatggtcaaaagacatgaagagacatttcacgaaagaagatacacagatggcaaataaatacataaaaagttgttcaacatcattaactattttggaaatacaaactaaaaccccaatgagacatcatagtgtgcctgtcataagagttaaaataaaaaaaaaattgataataccaaatgatggcaatattgtagagaaatgagatcacttgtacattgatgaatagaatgcaaaatggtacagttactctaaaaaacagtttgacagtttctttaaaaactaatcatgcaactcccatatacaaccctgcaattgtactcctgggcatttgtcccagagaaatcaagatttacgtgtactaaaaaacctgtatatagatatttataacagctttatttataatagcacaaagctggaaacaatcgggtgttctttataacgggttaaaggttaaacattcagttatatattcaaaccatggactaataatcagcaataaaaacaagctattgatacatgcaaacacataggtggatctccacagtattatgctgagtgaaaaaaggccaatttgaaaagttcatatactatatgattccatttagataacattttgaaatgacaaagttaaagaaatggagaacagattggtagttgccagagttagggagggcttggagtccaaagctaagtgagtgaagctacaaaaggacaacaggtaaaagtattcccttttctctgcagccctggcatctgttttttgttttttttttgactttgtaataatagccattttgactggtgtgagatagtatctcattttggttttgatttgcatttttctgatgattagtgatttggagcattttttcatatgtttgttggatacttgtatgttttcttttaaaaagtgtatgttttgctgggtgcggtggctcacacctgtaatcccagcactttgggaggctgaggcgggcagatcacctgaggtcaggagtttgagaccaacctgaccaacatggagaaaccccatctctactaaaaacacaaaattaggtgggtgtggtggcccatgcttatagtcccagctactggagaggctgaggcaggagaatcgcttgaacccaggaggtggaggttgcagtgagctgagatcacgccattgtactccagcctgggcaacaagagcaaaactctgtctcaaaaaaacaaaaaacaaaaactaaacaaaaaagaagtgtttgttaatgtactttgcctattaactttttggtgtgctgttggattcagtttgctagtattttgttgaggatgattccatctatgttcatcagggatatcaccctgtagttttcttttttgttgttgtgtctttgcaaggttttggtatcagggtgatgctggctttgtagaatgagtcagggaggagtccctcttccttgatttttttggaatagtttcagaagaattggtactggctcttctttgtatgtctgctacaatttggctgtgaatccatctggtccagggctttttttggttggtagggtttttttaattactgatttaatttcagaacttgatattggtctgcccagggtttcaatgtcttcctgattcaatcttggaaggttggatgtttccaggaatttatttatttcctctagattttctggtttgtgtgtgtagaggtattcattatagtctctgaggatcttttgtattttggtgggatcaattgtaacatcacctttgctgtttctgattgtgcttatttggatcttctgtttttcttgttaatctagctagtggtctattgctcttgtttatcctttgaaaaagccaatttttggttttgttgattctttgtatgattttttgggtctcaatttcatttggttctgctctgattccagttatttgttttcttctgctaactttggattagtttgttcttgttttgctggttcctctagatgtgatgtcagatcattaatgtgagatctttctaactttttgaggcaggcatttattgctataaactttcctcttaacactgctctgctgcatcatagagattttgctatgttgtgtctctattttcattttatttaaaaaatttttttatttctgccttaatttcattggttactcataagccattcaggagaaaatttgtttaatttccatgtaattgtgtgggtttcaaagactatcttggtattgatttatatttttatttcactgtggtgtgagagtttgcttggtatactttttatattttttaacttattgagacttgctttatggccaagcatgtctttaccaagcatggtaaatcttggaatatattccatgtgcagataaaaaaatgtatgttctatggttgatgggtggagtgttctgtagatgtatgttagagccaattggtcaaatgttgagtttaagtccagaatttctttgttagttttctgcctcgatgatctacgtaacactgacagtggggtgttgaagtcccccactattaatgtgtggccgtcaaagcctttcataagtctagaagtacttattttatgaatctgggtactccaatgttggttgtgtatatacttaaaataatgaagtcttcttattgaattcaactgtttatcattatgtaattcccttctttatcctgttttttactgttgctggtttaatatctgttttatgtagtataaaaatagcgacccctgctcttttttgttttccatttgtatgctagatctttctccaaccctttactttgagcctatggatattgttacatgtgagctgggtctcttgaagacagcagaaggatgggtatttttttttttaaaatcccatttgccattctgtgccttttaactgcagtgtttggacaatttacattcaatgtcaatattgatgtgaagttttgatcctatcgtgagattgttagctggttgctttgtagttcctactgtgtggtggctttataagttctgtatgctaggcacttaagtgtgtttttatggtagcaaatattgttcttttatttccatgttcagaactcgtttcatgatttttttggaaagctggtctagtggtaattaattcccttagtgcttgcttgtctgtaaaagattttatttctcttttgcttattaggcttagtttggtgagatatgaaatcctggttgaaatttctttttttaaagaatgctgaaaataggcccccaatgtctcctggcttgtaagatttctgctgagaagcctgctgttagtctgatggagttccctttgcacatgatctgacattttctctagctgcctttaagatttttttctttattgttgaccttggatagtctggtgactatatgccttagtgatgtttattttgtattgtatcttgcaagtattctctggatttcttgtatctggacatctacctctgtagcaagataagggaaaactttattgaattattaccttaaatatgttttccaggttgtttacattttctctttctccttcaggagtgccaatattttgtaagtgtggttgctttacacaatcccatatttcttgaagattttgtttattttaaaagcttcttttttctttacttttgtctgactgggttagtttgaaaggccagtcttcaagttctgaaattcttttttctgcttggtccagtctattgacaatggtttcagttgtattgtgaaattccttaagtaagaaaattcaattctagaagctcgaattgatttctttttaagatgtttatctctttcttcatttcctgaattatgttacaaattcctttgtgttgattttcaaccttgtcttctatcttactgagcttctttgaaatacatgctttgaattatttatctgtcagttctgagttttcattttggttagggacttttgctggagatttagggtgatccttttgtggtgtcactacattcagatttttcatggtgccaaaattcttgtgctggttccttctcatctggatatgctggcactgctaatttttgtaattattttcatgtgggtaggatttttttcctttgtacttctttacctgtaatattgtttttttttttttttccctttccctcctgtacctcccacaggggatgcagctatagagaatgggtagggtcttttggctttgcttctatagccctatgcacttcttttggcaggttttattttgggctgtgcaatttgactacaggtgcaatttaatccagatgcatacaaagtcagccattccttggtgatctggcagtgtggctgtgcaaggattttagtcttgggccagagattggagcacttgctctagaacagggtagaggcctgaacagccggaactgtggaacatgttccagtaggcaatggaattgtgttctcccccatcacaagcttggggtgggaggagaactgctacagctgtagtttctcctgggtggtgagacttgcagccaggacccccttggtgacctggaactagtctgcgtgtgccatttctgggtgccctaggctgttgccctgagactttggtacagcagaacactcttcactccacccacaggcagaaatccaggcatttggacacccacttggctggaccagcagcctgagttgccccacccttcttggacatagatcatggtgcggcagggccattgctgatccatgcccaggaagatctctaggcattcggagcacctgcttgcctggatcaacagcctaagctgtctcacccttcatggacatagattgtggtgcagcaggaccctctctgctccatgcccaggaagatctccaggcatctggagcacccactctctgagattaggagtttatgccactccccatccttatgcagagaatttggagccaaggaggttttccagctctatccctagacacttctctgtgcacttggtggttgctgactggattctccctcagtactggtgcattccgctcttgatattgggtttgggaaaatgtctgcagcttttcccactgtctttccctcacagcaactctgagcctctccccaagttagctccagggcttgggagaaacaaagtgttctcccttggcctcggttgcatagtccccagtggaaaggtgagttacagtggaaagttctctgcctttctcacacactgaagcttttctcacttttttcagccagatgccatcatgggggctgtttgctagcgttttcctccctggatctgtggtgcccttcacaattccagtggattcccattttccttctcgaattaaagctcacagagttgattcacacacacgattttgctttttgcaagtggctaaggcacgctagaagcctcaagtccaccatcttgggggaataacacaacacactcatttttttattgatttcaaatatgaatctctttcaatttatccagattttggtgagcagtgaggcttttgggaagacaacatatattttaatttggcaatggaaattgccccatttgtcaatggaaaattgttgttataatttctgtggttatttctactagttctcaatttcccacccccaatttctgtgttatctttctgagtcttctattatgtaaatattgtccctcctcaactgacccttgatgattttaactttcttttaaaataatttttctcttttttttccctttatatttgtgctattagtttgggcatttcatggtgtcttcctaaaacaatagccacagagtgagccaggtttaacataagtcagattagaacattcttcgtgcaaatcttcctatttttctgagaaccaaaaccaaagtccttgaattcacctatgaaacccttcatgatttgcctctggaacctctctggctccactttgcactactctcaccctcactcattccactctagctatacagcctctttgctctttctccagtgccccagcacaccactgccttatggataaattctgcacaaggtgttccctctccctggaactctatttcccctatataccctcttgatcccactcccttgtttctctcaaatctttatttgtatcttaatttcacaatgatgccgacatgatagtgccatttaattccaaaatctgcctccttccccagtatttcccatgtccatttccctgcatgtttatttgttgcctgccatactctgattttcatttgttcattatgtgtgtgtttattgcctgtcccctgcagctagtaggtcagttctgcaaggatgtgattctgtgtctgtgttgttcatttgtataactcacgccccttgtacatggtactagaacaaggcacatagtaggtatttgattaatatttgttgaatgaatgaataactttttgtcctaggaaatgaaattatttgttttacttctgactctttagttaaacgtattcagtaattctatttcaaatgtacataaactatttttcttgaatcgtttcttaattatagcttcctattttgttacagttgcaaaattatttcatattactctgaaaattgtaattagaatatttcaaagttcatttttccttaaattttcttaagagaaaaggttaatttaaatgtaaatttctaatttatttagtccttttcattttaaattagatatcaatatgcaataatcaagacttgtcagtgctagatacttaaataaaatttgcttaagcaaagaaagaattctttcattccccgctgatgtactaggaaagtccatgggtatatatgtcttcatgtatgtctgaatcatgtatttcactgtctgtcttttggataagctctcttctcatggttggcaggttggctaccaatagcataagattttcatctgtcaatgtgctaacttcagggttatgtgggagtttttttctgttagttgcagcagaataatttcaatgcagatcctgaatggcctagcttgagtcacatgactaatcttaagccaaaccttgtgaccaagtgtttgggattctctgctttttcaggcctgggtctcatgttcacaaggtagaaagaggtaagtgatgaacaacccctgctaaactacatggattaagttctccaaaaggaagagatatttttattactttaagaaagggtaggcaaaaactgtgcatcagacataatctttgtgcattttaagagttgaaaacaattcttatttttggatcagatatctttagttgtaatgctagataaggatacagaagagcttatcttcggggatagctactcaaatacaaccaattaactattttattaattactatttcaactaataaaagcaatatacaggatcttcaaactcctatctgggaagttatttattattcaatagaatcatcaggattccactaacttcatgacttaatatttgtggtctatcacaaatactgattgctgaatatgagattaaatttatataattagatgttcaaggtatttgttcttatttcttttttttattatactttaagttttagggtacatgtgcacaatgtgcaggttagttacatatgtatacatgtgccatgctggtgcgctgcacacactaactcatcatctagcattaggtatatctcccaatgctatccctccccactccccccaccccacaacagaccccagagtgtgatgttccccttcctgtgtccatgtgttctcattgttcaattcccacctatgagtgagaatatgcattgtttggttttttgttcttgcgatagtttactgagaatgatgatttccagcttcatccatgtccctacaaaggacatgaactcatcattttttatggctgcatagcattccatggtgtatatgtgccacattttcttaatccagtctatcattgttggacatttgggctggttccaagtctttgcaattgtgaataatgtggcaataaacatatgtgtgcatgtgtctttatagcagcatgatttatagtcctttgggtatatacccagtaatgggatggctgtgtcacatggtatttctagttctagatccctgaggaattgccacactgacttccacaatggttgaactagtttacagtcccaccaacggtgtaaaagtgttcctatttctccacatcctctccagcacctgttgtttcctgactgtttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattccggatattagccctttgtcagatgagtaggttgcgaaaattttctcccattttgtaggtcgcctgttcactctgatggtaggttgcctgttcactctgatggcagtttcttttgctgtgcagaagctctttagtttaattagatcccatttgtcaattttggctcttgttgccattgcttttggtgttttagacatgaagtccttgcccatgcctatgtcctgaatggtaaagcccaggttttcttccagggtttttatagttttaggtctaatgtttaagtctttaatccatcttgaattgatttttgtataaggtgtaaggaagggatccagtttcagctttctacatatgcctagccagttttcccagcaccatttattaaatagggaatcctttccccattgcttttctcaggtttgtcaaagatcagatagttgtagatatgcaacgttattcctgagggctctattctgttccattgatctatatctctgttttggtaccagtaccatgctgttttggttactgtagccttgtagtatagtttgaagtcaggtagtgtgatgtctccagctttgttcttttgacttagcattgacttggcaatgcgggctcttttttggttccatatgaactttaaagtagttttttccaattctgtgaagaaagtcattggtagcttgatggggatagcattgaatctataaattaccttgggcagtatggccattttcaccatattgattcttcctacccatgagcatggaatgttccatttgtttgtatcctcttttatttccttgagcagtggtttgtagttctccttgaagaggtccttcacatcccttgtaagttggattcctaggtattttattctctttgaagcatttgtgaatgggagttcactcatgatttggctctctgtttgtctgttgttggtgtataagcattcttgtgatttttgtacattgattttgtatcctgagactttgctgaagttgcttatcagcttagggagattttgggctgagacaatggggttttctagatataaaatcatgtcatctgcaaacagggacaatttgacttcctcttttcctaattgaataccctttatttctttctcctgcctaattgccctggccagaacttccaacgctatgttgaataggagtggtgagagagggcatccctgtcttgtgccagttttcaaagggaatgcttccagtttttgcccattcagtatgatattggctgtgggtttttcatagatagctcttatcattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagctcacttgatcatggtggctaagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggttgtgaatccatctggtcctggactctttttggttggtaagatattgattattgccacaatttcagagcctgttattggtctattcagagattcaacttcttcctggtttagtcttcggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtttatcaattttcttgatcctttccaaaaaaccagctcctggattcattaattttttgaaagtttttttgtgtctctatttccttcagttctgctctgattttagttatttcttgccttctgctagcttttgaatgtgtttactcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtttaattgatccctttaccattatgtaatggccttctttgtctcttttgatctttgttggttttaagtctgttttatcagagactaggattgcaacccctgcctttttttgttttccatttgcttggtagatcttcctccatccttttattttcagcctatgtgtgtctctgcacatgagatgggtttcctgaatacagcacactgatgggtcttgactctttatccattttgccagtctgtgtcttttaattggggcatttagtccatttacatttaaagttaatattgttatgttgaatttgatcctgtcattatgatgttagctcgttattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatgtctcagcatttgcttgtctgtaaagtattttatttctcctttgcttatgaagcttagtttggctggatatgaaattctagggtgaaaattcttttctttaagaatgttgaatattggcccccactctcttctggcttgtagagtttctgccaagagatccgctgttagtctgatgggcttccctttgagggtaacccgacctttctctctggctgcccttaacattttttccttcatttcaactttggtgaatctgacaattatgtgtcttggagttgctctccttgaggagtatctttgtggcattctctgtatttcctgaatctgaatgttagcctgccttgctagattggggaagttctcctggataatatcctgcagagtgttttccaacttggttccattctccctgtcactctcagttacaccaatcagacgtagatttggtcttttcacatagtcccatatttcttggaggctttgctcgtttctttttattcttttttctctaaacttcccttctcgcttcatttcattcatttcatcttccattgctgataccctttcttccaattaatcgcatcggctcctgaggcttctgcattcttcatgtagttctcgagccttggttttcagctccatcagctcccttaagcacttctctgtattggttattctagttatacattcttctaaacttttttcaaagttttcaacttctttgcctttggtttgaatgtcctcccgtagctcagagtaatttgatcatctgaagccttcttctctcagctcgtcaaagtcattctccgtccagctttgttctgttgctggtgaggaactgcgttcctttggaggaggagaggcgctctgcgttttagagtttccagtttttctgctctgtgttttccccatctttgtggttttatctacttttggtctttgatgatggtgatgtacagatgggtttttggtgtggatgtcttttctgtttgttagttttccttctaacagacaggaccctcagctgcaggtctgttggagtaccaggccggccgtgtgatgtgtcagtgtgcccctgctggggggtgcctcccagttaggctgctcgggggtcaggggtcagggacccacttgaggaggcagtctgcccattctcagatctccagctgcgtgctgggagaaccactgctgtcttcaaagctgccagacagggacatttaagtctgcagaggttactgctgtctttttgtttgtctgtgccctgcccccagaggtggagcctacagaggcagtcaggcctccttgagctgtggtgggctctgcccagttcgagcttccgggctgctttgtttacctaatcaagcctgggcaatggcgggcgcccctcccccagcctcgctgccgccttgcagtttgatctcagactgctgtgctagcaaccagcgagactccgtgggcgtaggaccctccgagccaggtaagggatgtaatctcctggtgcgccgttttttaagcccgttggaaaagcgcagtattcgggtgggagtgacccgattttccaggtgccgtctgtcacccctttctctgactcagaaagggaactccctgaccccttgcgcttcccgagtgaggcaatgcctcaccctgcttcggctcgtgcacggtgcgcgcacccactgacctgcgcccactgtctggtgctccctagtgagatgaacccggtacctcagatggaaatgcagaaatcacccgtcttctgcgccgctcacgctgggagctgtagaccggagctgttcctattcggccatcttggctcctctcttcattcttatttctataaacccatgctaaacaaaatttttcctcgaggacaataatgtctaagttgctgataactgtcagaaacaaacactataactaattcattttaaatcagtaaagagtaaagcaagtaacataataacataacatgatagtaatacttctagtagtaataactttactgttaaatattcttaaatatttcaaaatattttcacttgtatcatctaatcactgcgtatctcatttcatgaaaattgacaggaaaactgaaggtcactgtgagtaaatataacatttatacataccaccacatagcttttatcatattgtacaagatatctttgtttttatctctatctcacctgttaagattaggagctagatgaagatgaatatcttgtattacatttttttttatttgcaggtcctagccagtgcctggcatagatcagatgatttttcccaaaaaaagttttcaaaatagaatttagttgtctgtggtctcaaagctaagtcacatatggcagggatgaaaaccaagttcttgtgcttttcaatacagtatgtagattgctctttgaaatgcaatcaacacatcacatctgcttttaaataagtgaacacaaaagcctggagtgggtctagtgagatgccatccaacagagtgtgcatcaggggtcttggcaggaagcagatgacacattcaagctgggtgattgatgaaggttgataaaagaactattacaaagtttagagtgaaaaaacaagggatgcaggaccctgcctgagccacataataacatcagggagctactaccactcctaaacctgaagaagtgaaaagaagtggctcccagaacctgtggagagagctgtgagggcaacttgactggagcttgacagtagataggaccagcagatttactgagatccagccggcagggagccaaaggaataaatactctgacatcacactccttccttcctcccatctcatcctgatgtaccctttggctgaagccaccagaagaaagagagcaaggtacccctggtaccttgagatattcattcagcttagcatcccaaaggctagggcagacagcagggtagagaaggacggggtcaacagaagaccttcaacgtggagagtttgctacctcaagccttagtgatagaagtcaaaattcacttgactacttggcctatgcttgattggagactgaggaagctgatgtccttggaaggacctggtgtgctaactgggctgctgccaatctttggaagagtaacttgttctcgttaagaagcataaccagatggggtccaaggtttaacttcccactttcatggtgtgcaactgtcagttgtggctacaatcctgtatcgcagagggttgcaggctgtaattttgtgtccaagaccttccagagaacaactagcatatgctgtgcacaataagtacaggctcgatctagccacactgctagcatcaaagcgtattcttcattaattgaatgtgacagtgcacttacccctcctttttgagagaacaaaatactgattcaaagattgttctgactatgaactccaacaacacacacagtagaagccaatgaatcagtttggtctatttgttcatgaatagattcttctgtgtagtgtatcacagtgagttctaacttgcaaagtcttaacactgctcactcgagttaagccagcagtagacttccctttaacttatttggcatggcttttcctcttgggccatgatgatctcagctacattagtgtgcaacttgtacacagagaatgttaaggaaatgacctgaataaatctctttcaagtaaagggccagactcaggcttctggtatttgtgtctaaaaactgggatgaaccatatctggttccatcattgtatgatcctggtgacctcattagcccctctaaactttggtatttccttctatggagagagacatttaacttcccttcctacatcctcagggtttggaaatctcacaagtgccaccaaattatgagatagtataaccatatagcatacagttatcaaatataaatattaatactaagtatctgaaaacatgtacatttgtcttttgttttctgctgaatagtgcctgggactcacaaggtatgtctttacactagactaaaggaaaggtctttaattttatgaaaagttgcatgaaaatggaaaagtcacttacttcttttaagattcaaatttcctatgtaagaaataggtatgatgagaatatttacctccagaattttctcagaaactaaaagaaaagaataagtacttaaaaaaatcaagtcataaaaatgaaagttgctcctgaagttactgtaggtgatacgtcaatttattttcatgttacttaaatagtgtttgttacccctgactaatattagagtcaggatcccagtctataaaaatggaaggtttcagaatttcaacaaagaacatatgaaagtcatgacctgaataactttggtaaagtagaagcaaactctggatttgcaaagagaaagaacaccaaagaactaatggaaaacaaacaaaaaagtcttttaaggcttagtgagattttggtttaataattagtgatatccatatgcatatcttttatctattgctatgacaatgctgtgttataaccaccccaaaactcagtggtttaagacaacagacatttattaccgctaatgagtacatgggtcagatggaccagtcttttggtattggctgagcacactcacacatctgcagtcagatgtggggtggaaaggcagctcccttgaacttggctgggctctctcacatatttgggagtgggctggccttaagcaggtctagattaggatcagctgaaatgactaagcttttcttctttggtttctcacatccctccagcaggctcgctagggcttatatccttatggtccctgggcatggttgaggcatagtctcagaattgacctatttcactttggcaccatccttctgaacaaatcagttacaagaccagcccagattaaagaagcagccaaaaagactcgactgctgaatgggagtaggtgcaaaattacattgcaaaaggtgtagatacagggaaaggaggagaattagggccacttttgcattcagtctaccatactattctacttgaatttccttatgagcagaagtcaaaggcttataaacatctggaaggcttcagaaatctggacactgctgcagcagcatgccaccataaccggcaggctgtgtagagcaagccaaatttgtacttagagggatctataagacttgccaactatttttatgaatgtacaagtttggctgacatacattttctaatatctgaaacatcccatttgtgccacttgagcaaacaaatcagacacaataactggtggtgtgatccccttctcagccatccttatcacaggagaattaagttgctatttattttacatatttgatttaatttacagaatacatttatgtcttttttaatttttgtcttacttgcttatatttttaaaggaaggaaagttatctttacctactcatatttggaaacatggtccctaatacaaagggtagttgtatagcacatttactcgtatttgtaaacaccaaaatagtatgtggggggggaggagtacttacaattcttcgcttctgcagctgtagacaatttcttcatttaaacatggagttctaaagaggaatttagatcaattacaataatattttcttgtctggccttgttaataacaaaatttttgcttgcataaattgcatgcagagaaaataggattaaagaatattatggtgaaaatgaaatgaataatgacaatggaatcacttaaatcactgcagaaaaatgtaaaattatataattaagaaagctataaccccactgattctttcagatatttcagaatacagccaaggcagcttctcagccacggtcactcccaagataagatttgaagttatgaaatgtagcagtcatgcatttagaggagttgaacattttctaaccagtcatgaagtgagaaaataatcttacatgttatgcttcaatttgcaatgtttttactagttctagtcatgatttaaagcatcagaatattgtatgcattatgtatgtagcaagagttacatgggcaaactactgctacttcagcagttcattttccagagtttgaattaaaatccttgtttctctcaatttttctttctgtttgcctgctgaattgcttttgagtccaaaggcccgtgccaatctacatgctctgtgtagagattaaaatcttgtacaagccttggatttaagagttctgttttggcttttatctctccaatgttactaattgtctattttaacctcctattcactgaattcatgtatttatttaagtagaatatttatagcattttaaaataataacaataatgtttaaatcttatgttggagaaagctaaaatttggggttaaatcctggctcctaccttactaattatatgacattgataagggtttacctcccaaaaccttattttcctcacctttaaattggagataataatgttgcttaccttaaaagattgttgtaaataatacaatcaggtagcattcgtaaagtaaacatgtagtaaaaattctataaataatgatagccagaagtcacactttaaaacacaccagtatcttaatccatggaagaatctttgctagggaatatgaccgacataagagaaaaaaaactaaaaatatggatatggaagttactcatccaaaagcccagtctgattatcctacagtataagccacatgtaatgagccctgtctatgcaccttaagctttcaatcagcatttttctgttgtttcactttttgaaaaataaaccggcagccaaaaaatcatcagatatttatgggaagtgtctaattgacacttgacatcgtgatgacatgatgaaaatcagaggcaaagcaagcagcagggagcaaccaggtggagcaaagaccaggtgagacaaagaccagccttcagaagactttaaaaatatacaaagtagatcaacattatggagacaactcgaaatgagactagggtgctataaaaatgatcattcagagaacaaaaacagttcttcaaaattaaatacatgatagcagagaggaaaactgaagcagaagagttgaaagataaagttagaagatgccgtagagggtatagcaaaaagataaaaacatggaagacaggaaagaatatataataaaattagaggaccaatctaggaggtctgatatccaaaacatgagaaagaaaatgaaggagaagaagtaagcaatgaaataattctagaacatttcccagaattgtaagtcatgattttctaaattaaaagagcctaattaatgttcagcatagtgaatgaaaataacccaaaccacagtccaaaactcacataaaatcagaactctggggacaaagaggaatagcaataaatttccaggtataaaatcccacaaaaaccaaacaagttttcatatggaggatcaaggaatacaactagacttttcaaaagcaatattgctaaaagacaatgggagaaagaaagccttccaaattttgagagaatatgatttctaaactagaatgtttctgtttggccagtgtatcaattaatcatgaagggcagaataaaggcattttggtacccgtcagctttcaaatattttacttcccttgcacaatttctcaggaagccatataaagataaaacccatgaaatcttgttgggttgagcaaaaatgaaggcaagaattaggagttccaatagagccacgagacgaagggaattctcagcctgatgatgaaggggacctccagaagatagtggtgcagagacccagaggacaaagggaatccacactggagcagggcagaagtctccagaaaagacctcgtccagaaggagagattgaaagaatattcaacctgtttgcatttatcacaaggaggctaactctgccttgaattagtggtaaggacaaaaggagatgatcaaatgataaaacaaagcgtgcagaacaaaatatacaggaaacgaaaggtaattatggcaactgcataattcagactcacctgtaaatatatatatatatttataaataagtatatataatatatatataatatatatacccttatataatactaaggaactatatatagtattataattatatatcatatctaataattacaatgtgaacatgaaatattgagctagccaaaatgaagataaatccatctttatgatggtattataagggcaggagaaagagggagaggatggtgaaaaaagacatttgtcgtcttctataccgagaaggcaacagataatgaacagagtgcatcagtaatcagcagtatattattttgcaatatatagctaaatgccaaagaatcagctagaataattaaaagtatttgcacctaaagagagggaagttgtgtaggtgtaggataaaaagctgcttctatttataagtatctttgtagatttatttgattcttaaaagttgttggtataatttgatggaaataaaacctaaacgttggaaacaatgaatctatgacattactcttattagttcagtgttttaaaaaataaagacaaatatttttccaaataagcaatttgttggcatttttaaacatgaacatattgacatatagacacacacatgtgtgtttgcgtacaaatttacatcatcatcatacaaagcaactattttctaaatgtaaaacatatttttttctgtgagtactgcagtgcttgtctaacctttatctgtagattttattgtacattcttgagaacccaaacctgttaaacaactttacagctaagtcttggcagcaggaaagcagtgaccaacattatcctctgcatccttcccctggatctattttattactaaacatatatacatatatatatgtatatatttggaagcatgcatatgtatgcttccaaaactagaccaaaataataactggtctcattaaaatatataaaagccttcaactaaatgaaagatcaaaaattaaatatgtgtaaatgagacaaataattacgtaaacagtctcatgtttaaaattcaaatatcaagtgttatcaacttacaatcctgtagtgccatttttctaagtagcactggtcattgtactgtgaggccaaaaagtcaattctctcaacattcaggcataaaaaagggaaggcattaagataaattaactctctgagtatagaaattaggcagtgtgttagctttgtcatgttgttcaatcttaatttccaccacagcacctcaaacgatattctaacatgaataactaagtgattagtatgtttcccatgcaatgtggtatcaacgtagatatttttgcctgacctcaatagcccatcaaagctcagcatgttactccagtaaacagagttggtctcagctattctgtaaagcataaacatctttggaaacgaggcttgatatacatgcctagaaggcactgtgattattttatgtataataaaatagtcaaattttctgcaatgccaagatattctttgataagaaattagttcctaaggaagctggaaccaggatgccgggacactagagaatcacctacctgactgtggcgctaatagatcccacataactccaatgtgcacaaaaccccctgggcttctggtacctaaggtaccctctgatacagtaggattggagtggggtccaagattctgtatttctaagaagctccaagcaatgttgatgctgctggtctatggaccacacgctgagtaaccaggcactaaatgataccataagctgctgatttactacattgccaaatttcatatgttggcacagaaggcagaaatctaataatagattccattagattttctatcacgtagtaggaactcagcatattttgggtaactatactacccttggaaatgtatagggaaatcctagagaacaggtcttagctatatgtaatgagagctaggctgttatctgtatatgcttggtgcagttttgcatttacaaataatgctaatgagaagtgctattcacagaatttctcaagtattttcagagattaatttgcatagttataaattagatgtcccaaatattattttatgggtaacgtgtattttgcaagatgatttccttagagagagagagagagagagagagagagagtgtgtgtgtgtgtgtgtgtgtgtgtgaattagctgttgccaggctatttttgttgctacatggttgttatgggccaaaatcttatattcacttatctttaactagtttagtctgttgcctatcttcatatataaaacatattctgcttcagatctgttgtagtatgtgggtttacttgtttatagtatagtagtggaatttactaaagctgcatattatatatcacagagaaataaataaatgagacttttataaaacagtaaatgctcaattattttagggtagactgtgaaagtttcaagaaatcttgagattacttcttcttgtaagggttggcaaactataacccatgggccaaatccagcctgctacctgtttttgtaaataaacttttattggaatacagacacactctttcatttacacattgtctatggctgtttttcatctacaatgggagagttgggagagttgggtagtaatgacggagatcatacggcccacaaagcctaaaatatttcctctctgacttttgctgaaaatgtttgtccatcctgccatacaactaaagattatattctaataccttaatttgaaaaggtaacaggagatagctttataaccttcacttggtaagattagaattagactgtaggatgattacaaatcctatcttttctctctctttggaagatgcagtggcaatatatctcaaatcacagaatagaatctgttagggaagggggagattctcttcattgcctttatttgcaacttaatttttctttaccactccaaaaaaaggggactatttgctttttttttttttttttttttttttttgagatggagtctccctttgtggcccaggctggagtgcagtggggctatctagctcactgcaagctccgcctcccaggttcatgccattgtcctgcctcagcctcccaagtagctgggaccacaggcacccaccaccacacccggttaattttttgtatttttagtagagacggggtttcaccgtgttagccaggatggtctcgatctcctgatcttgtgatctgcccgccttggcctcccaaagtgctgggattacaggcgtgagccactgcgctctgctgtggggactatttgtttttcaagtgttttcagttatttttgtctatagtcaagaaaaaaagcgggtgttttatgcatcttcatcttgatgatttgaattttttactacaattttaatttaatcattttccaagttatttatcttttctctatttgtaacataaccaatgccatctattgcttgacttagctgttctttcctgttctttgtacatgtttgcatatgtgcatttgatatttaataggtaccaatgggcataagatatagtaagggaatgtatatacatttaaaacttatctggatttacccaacatacatagatacaatttgaatttaattcagttgattcaaaactttagtgtcttaaaccactaacctagaacctctttttgtgaatgcaaaaaaatcccagctcaacattattccttatctgtatgattcagtttggcattacaaaactaggtcaacaatgatgtaggattatttacttatttcagttttcacagtctgagagaacctggaataaatttgagtcatgctatttagttaaatgaagaatgaaattgtccaaagccttgttcatcaattccctagcatattataatatcaacattaacaaaaaagatgtgtattcaagtgagaaaaacctaaacttcataatagagtatctgtaaatcaccatagattgacattcatggtgacacctactttaattatgtagctgctacaatagcattgggactaatttttaaataaaatgcatcactatgtaagttccttcgttacctacttttgcaaatactttgagtacaattattctccataaaaaccaatatttctatactggtcctggggaggccaagtggggcaaaattatttcaaattttggaggaatgaatgagaagcagcaatttattcaggaacagaaccttgggggaaatacttgaaaaaaacaaaagacatttttcccaacctgctggtgcagagcttagaaaggcaattgaagaactgatgtagaacaaagcaatagtgccagtgttcggtatttgccgctatgtcagtgagagttgattgtggttgcataggatggaaatcgctaaattataggggtttaaacaagctaggaactttttttctgtcatttaaaatctagatgatccaggatggtgtggtggtttggagacccaaggatttctttcttctctactagtctagctcctggctttcacgctcaaggtcacctcctagctggaacttcagcccttgagtggccattccaggccacaggaaggaggaagggggaaggtgaacaaaacacattgtgacttcaaattgggagtcctgctactgatggacactaggaaaatagatattggatggcaactagaaatctctaacacagctcctttgaaaagtgactttaccccctcctttgtatgctataaagaataataggaatagttataaccaataaaaaagtcaaagagtttgcttttagtttcctaagatggtgccactacagtgaaatgagggaatactagaaagagaaatcttgatgaagcaaaatcatgttgttctttgttaaaatttctacaaaaatgtgaaaaggtgattattcatattttatagttgtcactgtatcggtaatggtggttgaagtctttgtatacaaaagggaggcactgaagtgtggaatttaactccagcaaaatttggaagaggatttttaccccaaacaaattgaaaggcaaaaagatgttttttaaaatgcaaatctgtttacagtgccctgaggtgaaaataaaatgaaacttcctttaaatcctgttgcttacaacaatagatatcattagagacctaaagctcagtgattttatctgaagtgagagagaattgggggtatgctggtgtttatttttatagaacagggaagatacatatctggaagataaactgactcatgaagattatatatttacactggtgtgtctcagtcactatatctgagggcccagagatgacggagaaggaaatagggtgaggtgggtgcttcttgccatcctgaggcatcatttccgcagtcttctctgcaaacacctgcattttccatgaaatctggattgtgctgagagtgtctctccttaaacattttttggatctgagcttccaaattctttttctgaaattgcgtttaaggcgatcagccagatttcaatgaaagcctttgctttatatgaagcataaagtagagcttaaatgaacagaaggtcatttgtcttgtttttcaaaaagaaaaaaaaaacctcaccatttttgtagcataactaaagcaatctgaaggcttttttcttttgtgtgatagaatttagagaaacgtactgtgctatcaagaaagggttcaaataagagcttctaaggaagatgttcttctcaatgtgtgggtgataattttaagttgtcttcctttgagactctgcctctgtcagtgttttacttgataacagaactcactgagtcagaagctggcaatttcatcatgatgcattttcttatttaccattcaagaggtgtaagccttatctcttatattaatgtgaaaagtaatgaaaataatgatgccaaaggcatttaattcttggctctaatactttataagtgtgcctcttgttcacataatttactgggcaggggaacaagtcatcagggtgacctttttccatggagttaatcagggactcaaactaacagaagctctgccttcttcagtgcgtggcttccaaggtcaccaccaggatcactttcattctggccagccaggcagggaagagcatggatcagcacatatgggagggtttgacctgccaaaggctactgactgtaacccagatgtggttattataaagctggttctgggtagtttttctccatatctctcttatatcaaaaaaggtgagttaaaggagccctgattcttagatgcaattagaactcatttattcatgatggaaaagagcttttcagttctagaaggttagagacaaaaatgaatatgattaaagtttatagaatcaatgcagccaaaaagaagtttactaaatcacagaccacagaattagaatgctgtcttttaagactaaaagagttatttagggcatagaaagggaatatagtagaatttcagaataaccatatgtgtgttaactactattgattaccgctgtgacagggacttagatatatgatttcatttaatctttgcaatacctctttaagacagcttactgtggtggttaaatatgtaggctctggggtcaaactgcctagtttaaattctggttcactcacttactagctggaaaatgttgaacaactacttaacacttctctgactcagattacccagctataaagtggagataatagtaacccggctcctaggggttaatatgacagtgaatgcattaaaaatgtaaaaccctgagaagagtatgtgacataaaaagctttgacattattattatttctccatttacatattaggaccttgtatttcagaagagataagagactttcccacggttacgtacgtagtaattggtagaactggctgttaaaagatatgtctattcaaatcaaaacactgtccttcccactgtggcaggcctcaagtgagttatgagctgacaagagactggagtacataccacaatctagtttctagggaaattaggactatttatattacactgtggttaaaaggagagagaaactactcatatctgccttataagttgtagaagtatctaccatggtagttaagagtctaggttctaaagtcagacttcctaggtctccatctcaattccgaattttgtaactggaggaggttaatccatcctccaaactttagtatataaatcagtaaaatagcatacaataatattatctaccagatcagctgagagtaacaataaagcttaaataataaagagatttattatctcactcattaaaaagtctaaagaaaatttaaagggtttaaaaagctcatgaaggaccaggtttctttgcatctttcttgtcagtgtcctctttacataacaatatgagacagagaaagagaatttccctgaagacattagtcagaactgagcccctcatatagctcttaaaccagttacagacaaaggggaatggaattattgacattagtttaggccaatcatagtttgttccttggaaagagagaggggccatgtttcctaagcatgacgaccacccaaattaagtcagggtttgcttacaagaaaaagagggtggagagtggtgttgaataggaagggttatgttttttagtgtctgggaagtgcttagcttagtgctctgacccacagtgagtgctcaataaaggttagctttgccagctccctgaggctgacattcccagagggcaattctgtgctctcacaaaaaacagaccttcctattgtttcaaaaaacagtacacagcaccgaacttgacggatcacaggcctggctcacacaattttggatttcttacagatccctttgcatagcaaaaatctccacacttggacacaggaaggggaacatcacacaccgggaactgttgtggggtggggggacgggggagggatagcattaggagatatacctaatgctaaatgatgagttaatgggtgcagcacaacaacatggcacgtgtatacatatgtaactaacctgaacgttgtgcacacgtaccctaaaacttaaagtataataataataatttaaaaaaaagaatgggaaaaaaacaaaaaaactccacactttagaaacatttctatcttgtatactgaacaaaaggtgtggaaaatgagggagttaaaccatgctgcttcaagcatcatgctacatgttgaaggtatttatcctgtagttctcctttaacaaactgcgtcattttgctggctgaagaaactcttgcagcccatgtttgtcttgaagacaaatcctgttcagatttctacagcgttctctcctttttacgtccacgttcacagcaacagctgggaggaatcagggatgctagatgaaatactcaactatccattgccaataatggtggttaccaaatgactcccaactcagtgccattcaacaatgaacgtttattgtcatgttcatgagtctgcaggttggctgagtctgggagatctaggatggtttctactggacttgcttccaagctgtaaatggggcttaggtctgtcctgattgtctccttagatcagaggctccctgaggcatgtttatctcatggaaatgataagaaacccaagagggaaagcccaacctcaaagcatattttgagcctttgctaatatcacatcttcaaacatgccattggccaaagcaagtcacattgtccaacatcaatgggatggataaataaacagggtgtctagtaaaaactgtaaggtcacaaagaaaaatgtgtggacgcagaaaggagcagggagcagagagctatgatgcaataaactaccacaggaggctcaatctacttcttattttgcttagagctcattgtaactctccaatctcctcttctagtgagcgcagccctgtcttgccttcctaagccactgtgacaggtaaaaactatttggccaataatctttccagtaaataacaaagagatagaaggagaaaaggaaaagaaaggaaaggaaaggaggaaaggaaaggaaaggaaaggaaaggaaaacaatttggtatgatcagttgtaaggacaattgagaagttctggagccctggaagcagagtttcattgcagtactctgaagtagagaaaatcgacttgagacggtgactgataccttctgtgaggtaattagcaagccaaggctgctggctagagggactgtggaccattcaggttttagtttagggacatgtgatcaaaatgaaaccagtcagtttttcatgaaattctttgtagcaattggcttccaagcacaaggcaagaccctcaaatgacagcaagagtcatgggtcttgttcaccaggttatccatggtgattacaatagtggctagtatacagctggctaccaataagtatattttaaatgcattgaaatatttaatagcaaatttctgtattggattttggtaatcttttgactgagttcataagcattgggccttggagtcctgagggcagagaacagggagaatgaaggattaagagaatgtagtgtttctctccatttttctctcttcgtattctttcttctttttaaaaatcaacctttttgagatataatttatttaaaacaaactgcactcaatttaggcgtacttacagaacttacaagttttgataaacacacacacgatatagaacatttccgacatgctcatcaggtgctcgtagcccttccctgtccatctctacctatccctggccacaggcaagctttctgtcaacatagaatatcttgcctattctgcaattcctacacatggaatcaggcagcatacagtctatcgtgtccggcttcttttacaaagcttaaagtcgcgattcatccctgatcttgcatgcccactcatttttattgtggaatagtattccaatatttgggcataccacagtttgtttatccattcacctgttgattgacatttgcaggctactaagaagaaagttcttcacatcactttacaagtccctgcagacttgaacgttttcatttcttttggacaaatacttaggagtggaatttctaggttgtatgataagtaaatatcttactttataagaaactattctccaaagtggttttactattttatattccctccagcaatgaacaagagttccaagctatttctctctccgcccccccacctcccgcgtgtgtctctctctctctctctttctctctctcacactcactcactctctctctccctctcctctctctccttaataaaaaaaaaaaaagagttccagttgctccacatcctttcaagcatttggtattaccagtctttaaaattttatccattctggtcctcctctttcccttcttccctccctccctccctttctttcttgaattgagaaatgtttgtggaaggagtgaagacaaacattcctggacctatgttcctaaatgagcaagtttctattaataagactctcccccacccgccacacatcctacacactcaaggagaggagcgggagagggcaccctctttcttcctcggaaaataaaacctttgctttctttaggatgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagccaggaggtgccgctgcgtccccgcttcctggcgcctgacccagcgtgcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagttgccatcctttctgggtctggcaggcgccccctgagggtcttacatcttttgggccagtggagagggaggggcaagctttgcctggtgacaggtcctgagagttcggaaagtagggagtgtgaagttgggaccaactggaaagcgcctggtgtgaacaaatcgcgtccctctccgcctgcggacgcaccccctattacctcttttgcccgatttcaagaaggaaggacctgaagttcaaaacactttagtgattgcgaaccctcttggcgcttttgtgggagccaaggcggcggaggacacaacggtccagccaacaggtggtcgttgatgccaaacttcagcgcctggctccggagtgagggtccctgaaaagggctgcggggacacatctggggagggcgtgaacagaatgggggcccttgaggggtcctggagggctcatgggcctgcaggcaagtggggagggctgacttttgagaactgagctgattggagtcttctgcctgaaatagacaggttgagagtttgccccacgatttacctgcaccgtttgccaggtagggcagagcctagcccagcgccggggtctctaatgctttacgagcggcccagaccccaggacttcaaatgacttccccttcccctctaccccagttgtcttcaaaacacgtaaattagttatccagctgaaaacatgcgaatcttcggatggagaacattatggtatcagttttatgtcctgggtgtcattctaaaggttcgataagaaaaacctactgaaataaacccgagttgccaggctctaagcaaatttaagtccaaatgactaatacatctcttaatcagaaggaattataggagaatgaggcgttcttcttgccgaaaagattttccacctagtaaattatagcctgttatcctctagggtatttttctttaatcttcttaagccattttccagtgtctgaaaacaatttaaatattccaggtagtgaatccaattacttagctgagtgcgtctgtgtctatattttgtccagctggaagcgcaaacggaacttggagtatgaaccacagcttccttgaaagctcgtgccaattattaaatgctgtaggcaaggatgtaaacatacatctttttaccatgggcttcacacttttcttctttctgttccagtctaattgtactgaatgtttctgtaaatggaatagaatctaaacaataaattcagacgcagattaaatgctttgtgtcagggaaaaaaaagacaaagaaaatgcagttcagcaataaacaagacggtcttgcccattttgagatccttgaatagagaggtgatgtgatgatggatttactgagaaagagagtgaagggcagaggaaagagaaagagactttgcagaatttagaaaagggagtttcagcgtaagctctggatttgtatacagtgatgattctaaactgtattttaaataattctctataatttcttgtttgggagagaatagccaacatcacattgagaatgaaagtattctatgaaaacacattttggtatatccaggtagatgactttcattatgtgcatttctgtaacacatatttcttgctcacctattactgccaatcctagactggattctggggtggtgaaaaaagtagacaaaatccctgctgttacggaccttacatgctaggtggaggagacaaaaatcatcaaaaacaccaatgagagagagattgggtgatgcattgagggtaatagagaggacgttagtgaaataccaaccaaagaagaagttgaaaagagctccttctgagcattgcagcagtgagtttccaaggaagccctcctgaaagaaaggacatagtcactaaggagaagaccagaagaatttcaggtcttttttaaaaaaaaaaaaaaaacctagactgcactcaggagtcaagttatctggaatataatgagctatcttgcaggctctttggttctctgggtcttcatgctgatcagtggactacaagggacccagcctttcttaaggttgcctttctcttccccaggcatcccttttctactcttctcagctcgtatttgcccttccagaatcaagccagttcaagttatctggctatttatattgtaccttagtgagacagtgtgttgaagacaaaaaagaaccagatcttgaatcaaaggcctgagtttacctcctagttctttcaccagtaagctgcatgactttaggcaaatcacttagcttctctgtatttttgctgcttcttgtgtaaaagcgtggtaatgttacaggacattcaaaaatgatgaatttggggctgtttaggatgtgaagaaattatctcttgttcctgaagtgattaaagcagtataatcactggtcttgttgtcttgaccaccatatggaatggaagatgtcacccagaggttgcagtgccatgcataatttgctggccacctaccaagtcacagtgaggctgtggatgctctaagggtggtagtcgaaagctttaacataggcactaaacaatcacaacagacagcaggggggtaatagatcctggagataccctgttgtaccagggccaggcgttaatatttttgctgcttggtcatggggaggtctgggagtccccagggtctgtggatgggtgggtaggtagctggagtttttttgactatttcagtattttaaaactcatggtgtatattgtctgaacatcaaggctatacctgtccttctgaacttggcatgaagataaaggactgacctaatgatatttaaaaaattcaacctcatgtctttgcttttgttttgcatttgtctgttagcaggctctggtggtaggaggtgggtgtaaaggactatgggtatttgtgggagaattctggtgaggtagacagtggaaggagagttactttcttgatctaagctagggagcttgggagattgtgagagaagctcctctctcttctggatcttggccttggtctatattgggcaggacatggagagaaagagcaaggactgtaaactgtacaataggacccccagccactgatttggccctgttttccatgcctaagcactctgtctcactgtcgcacaacctctgagggatggaagggttttcatttatttattccttctgtttcttcattcttacctttcaaattcagatcttactgtgggcaggttgcttaacgcatcccaacttcagtttcctcaacggtaacatgcaaattgtaatatttcctaactcagaacagctgttgaggttaaataaatgaatgcatatgcattgctttgtataaagcctgacatacaggcaaccttcaataaaacatgtttttaaaagttattgtcggccgggcgcggtggctcaagcctgtaatcctagcactttgggaagccgaggcgggcagatcacaagaccaggagatcgagaccatcctggctaacacggtgaaaccccctctctactaaaaatacaaaaaattagccgggcgtggtggcgggcgcctgtagtcccagctgctcgggaggctgaggcaggagaatggcgtgaacctgggaggcggagcttgcagtgagccgagatcgcgccactgcactccagcctgggcgacagagcaagactctgtctcaaaaaaaaaaaaaaagttattgtccctcaaaaataagatggacgtgaattttatcaaggtgattagcaggtgttctatggctcttttattctactagtggaaaaattcagaccttacttccattccctttaatgtgtgttttgattttatactttataatttggagaaaaatcaggtttctcaccttcttttaaaaatccaggtgtttcacggaaaataagtacgtaatttagagcaggatccattctctacagcaagtcagtttacaaataatccaaaagtttatttttacttaaattccatataaaatatatttatgtatatatgtgtatataatttaacattgcacgttctgtcttacaagcatattctaacatggaaaaataattgctagactaagttgtctgagaagtctgatgaaactcagaagtttggatttgcgttaatgccatctggatttgaatcaagtaactccctcctttaccacacctccaacccccacagctaaaacaggtaatttaagaaatactagtatattgcacacttcccagcatcctacacaaaagcttagaacttttgcattatgtggaatctgctgttccagtttccaaaatgatgacaagtaaatgatgacaagatgacactcacaagattaatgagagagcagaggggaaaagggtttgcgaggtgggaatttagtagcgttcactttggaaaggttatgggaaacagggaggaaacttctctgagttggtagctggctgatgtggatggagcaactacaaagtgcaaggtggattttagaatggaaggctagcagatgccctctaaggagccacttaaatttgcccagttatgtccatttttcttgtccaaagagctttgagaatttctcattggcagtcaataattactgtaatctaagtgtaagagcataactcttttgcaagcaaatcaataaaactacttgaaactttttaaaaaatcagtgtaacatgcgtacaacaaaacacacaaatcctgtgtccagctggatccattttcacaaagtgaacattgccatgtcatcagtaccagatcaagaaacagcatcacttgccccagaattcctgagtgctctcttccagtccctacgtccccttctaagggtaacccttatcttgacttctaactttatagtttggttttgcttgtttttaatctaataagctatttttactttgaatgaaaactttaaaaaaaacctcttcagcctaaaacatttttattattgctgaactgatcctcttgaacaacagcaacaaaagtgacttacagtcagtttagatggccattgattgggttcttgtctgtcccaagtctgggaagtatagcaggtatagtaaatgccctgaaggagcaaacagttcaacaaaaccctagtaatttacagaggaaatgtaatgccttcaggctgttattggcatggcaaagctgactagtacagtactgttgctggaatataattttctctcataggttttctctcttatcttgcttaacactaatatttccccacctatggtgaatgaggataatttgcagtggctattagtttcatttgaaagtttagcctatcagtaaatagcttcaagttatatttatctgcaatggtatataaatggaatgggaacattttacttttttatgtgggatttggtaaactgtaaatgtttccttatcagaattgtttcatgttatcatgaacaagaatcgccagcagaaaatggaaggggattgctggtgaattgttgactaacgctatgggtctccacttaaataacaaacccctggtaactgaaatcattggtcttcttgttactggagctaataattaggttcatgcaacctttcagatcatatcataaattccaaatgctcaggcatatttcacagtcttttccatctaatcttttccctttctgttctatgtctgatccccctaagcagagccttgtgcccctatgtgtaagtaggcaaaggaaatatagacatatttctgaggtcatttacatatatgaccataaaaaagccattgatttttgtaactaactaactgaaataggatataaaggaactaactaattggaatagattataaaggatgcttatgttctttaagagtctctctggttttcctctgatctctttaagagctaatgttcgattttattatcattaccatgtgttaattctcaaaatttttatttcaatttgtattccaaaaatggtttgcatgtacctattaattgaggttgactaaatctatgcatttatcaagaaactaaattattataaattgagtaacaaactattatataaaattggaaaaaagttatttttatttatactaaaattattttatttatattaaaacagaaataaaagcatcctacatctgtcttttatttcaagggtttttttttttttttttttttttgagacagagtcttgctctgtcacccaggctagagtgcagtggcaccatctcggctcactgccaacctctgcagccgggttcaagctattctcgtgcctcagcctccggagtatctgggattacaggcacatgccaccatgcccagctaatttatttttatttttatttttagtagagacgggggttttgccatgttggccaggctggtctggaactcctgacctcgggtaatctgcccacctcggcctcccaaagtgctaggattacaggtgtgagccaccgcacccggccttcaagggctttttttgtttacaatatttggttaatgttctgtttctttttactgaattgacgtttaatgtacaagatcacagaaagtggattagttagtaaagaaaacatttacctgaagtagtcacatggatatcaatatatagcattgatatctagaagattaagatattattttgccattaaaaaaaacattttttttggaagttgtctatgaaatagttaagagtaagggaaatttaatttaattttaatccattttatagaagaagccatacaagctcatgaagctggaaaaccatagagcgaatcagcaattgatctggtcaaaaaatgttaaagatgccaatcatgatcctccccaggtgtgctgtgttggatatggttgaatctcacatagcatcgattcctacatcctcttagtaggacttcttataatacaaaatctggacttctaaagctacatttaccagactcctttttgacgaacattcttcttgaaaattaatatttccaccaaataaattcatgcatatgagatatggagggcagaaacattaaaggggccaatttcctgcatcctttgggttgtttctacagatacgtgagaagctaaaagaggtgggactttctgtaatagttcttcagtgtctctgagaggcagtggtgacagtggccactccctgttggcagcttacacttctttggcttcaacaaagctggtgttttgtttggaccccgggagttccttcttgatttctcacctttctgaatgtggtagatacaatagctctccccaagggtctgtgctgctatgttctgagatcattcatggagagccaacctaaagcctgctcctccaacccttccagtttttctgtcaagtgcttactttatattaagtccctttatcttcaaaattcaagagaaatttctgtttctcgcaccaaatcctggctgatatggccttttgcggttctaggatttcacagctttcagtcctaaatataataatcatctaagtatcctacatagttttctccttcagtactactgttgagtaaaatgaagttttgctgtaatatttcctctggaattcaaaatccagactaagtcctaatagcaggcattcatgcttatatagcagccctgcttacccctgttcagtcattaagaccacctcgggtggtaggaaaaagagcaagcgtttgtcttttgcatttcacgtagaagcaaatcgaggctagtgattgtgatttgtcgaagggcacataactaagtagatctggaataggaatttaaaactacgtcttctggccaaattcagtgtcctttccagtctaccatgatgtccccgaacagggtccttttagtaacaacaacaacaacaaaaaactttttatttttttatttttttttttagacggagttttgctctttttgcccaggctggagtgcaatggcgcaatctcggctcaccgcaacctctgcctccccggttcaagcgattttcctgcctcagcctcctgagtagctgagattacaggcttgtgccaccacgcacagctaattttgtagttttagtagagatagggtttctccatgttggtcaggctggtctcaaactcctgatgtcatgatccacccgcctcagcctcccaaagtgctgggattatagatgtgagccaccgaacgtggccaacaaaaagcttttaatagagtctaaatgaatacaagtttgaagagattgatagacttttccaaagaatctctgttatttttaggattcatacatatgaagcttagatccctgcaaactcagtttttgagctattgtcttcaaaatagctctttttcatggtgtatgtacagtccgtttttgtctacactgtgcaagatgtgtgagcattggaaaacctcattgctgctttgagacaaaaagggcaggccagccgcagtggctcacgcctgtaatcccagcatattgggaagccaaggcaggtggatcacttgaggtcaggagttcaagaccagcctggccaatatgatgaaaccccgtctctactagaatacaaaaattagctgggtgtggtggtgcacacctgtaatcccgaccactcgagaggctgaggcagaagaatcacttaaacccaggaggcaggcagaggtttcagtgagccaagatcgcgccactgcattccagcctgggcgacagagcgatactccgaaaaaaaaaaaaaaaaaaaggagggggcaatgtatgctctatagtctttaaagatattctacatcagtcagtcagcgtggaaacatgcatgtggaaagacaggtattcaggtatggtgttaaaggtctttttttcattgtcgagtaagtgacatttctgcattcagcaagactctttatatctgttactccaccttttcttcttctcgacatacgtgtaaatgttgtcttttgctgattcctatttaggcttgtcccatggcctctcatagaaatcatggaccatggaagaacaagaatatggtagacatgaaggaaatgtagagggtgagttgcctgctctcaagcacgatgcagaatgcaagacagtgtcaactgagaggccagatctatattacttgtgcagggaggtagataggccttgtttatattacaactagagcaggacttctggagggctatagctttataattatcattattatttttttccctaggggagagcataggcctggcactgggaggtgctgatgctcaggggatatttgtggaatgaaggaactgtctggtgtttgtctggctcacagtgggttcacacaggggagtgtgcagccttgaggcagacctggagggcagtcatgctcctatgagaccttcgtgacctttgaggtgttgtgttacattggttggaacaccttgctccttgtccttccattccatctgaaatctcctagggtcctaagggactctgtgaccttcttaaatgggatttctccatgtgtgtttgagaaggaaactatttattggcaatgcagagctcactgctgttacagtgctgatttcatttaaggtccaaatatgtcttaagattgagtgtatactacactgcaattcaatattggttgaaggtgatgatgcttaatgtatttatttctcatattctaaattttaccattagttcctattttctgaaaaatatgctcacccatacacccaaatattgcaatgaaaagcccttaaagaaattcagaagcgttgggagtgacagaacaaaagatgcatggttgtgaaaacatcctatcacgataatgattcacaaagagaaaaaagaatacttgtgctttattgctaaagtgagaaaagtaacaagacatagttctaaatctgatttataatgaacttccacctacactattctttgtgtacagaggcaatggaagtccctggaacaatgcttttaatttcctcctttctccactcctcgtttaatgtacttgggccacctccattattccagctgccctcctgcccctgagaaatacctcaccttctgcatttatattttggagctcgaccttcctggcatctctgaatcctgacttcattattatctgacaccactcccctttcttttaacagtgtctatatgagtttcccctcagttgaagctttcctaagaacatagcaatatgcctttactagtaaaaatcccaacctcaaaaccaacacaatgttccccagtcccttttcctcctttagttaccgtcttcttcttcatctccttccctctactatgcaagtgtaacttatagtcactgtctccctgtccttacctcctacctacttcttctcagccttccaaagtctttttctgccctcaccactactttgaaatttctttatcatggctgtgggcaacatggctcccagcaaccccaactgatgtttttcagaatcttccttgtttttatttgctgcagtaccttccaccccttcatccattcattcaccagtcatactttaaaaatgtactgatgtctcttttaagcattgtgctagtgttgtggattgatgatgattaatgatttcatgcctgcccttattgcggagacagatgctaagcaaatagaggtacaattattttcattataactgctatgaaggaaaaaaagtacaagtgagtataggaagcatggaaggtttccctggaaaattctatttatgacaagtgggatttaggccagcatgagtagaagaatgtgtcaggtggagggaacagcaggtgtgggtattccaaagagccaaggaacacaagattttgaaggagagaagcagaattagcacaggagagtgtggctcagataatgtggttggatggcaagggcctgcatatatactgcgtaggtccttgcaggattttagacgtataaagtcaaccagaaaccattaaaaccatgttttcaaccctggcaccattgacatttggtcccagtagttttttgttgtggagtctggcctgtgtattatacgatatttagcagtatccctcgctctagatactgggtgtcagttgcaaagcctcccagtagtgacaaccaaaattgtctccagacatagccaaaagtcccctggggtgcaaaattgctcccagttgagaaccactgatgaaaatgataaatgatatactatgcttttaaaagtatccggccagttcactgccctccccgccaccccaaaggccaataagtacatgaaaagatgtttaacatcattagtcattggagaaatgcaaattaaaaaacacattgaggtgccactgcatacccaccagagctatatgttactgaaattattggtttttctcatctgatgcccccactaagccaggagcacctcggttgatttgggatctgggctttaatttggttctctcgtggattatctgaaggatcttgcacgacacttgaagaacaattcttccaacatttccctacattgtgttaaaagggatttttctgcttgttctgtaggaagccagtatcttcacattgcttctctccactgttttgcaccctctactctggaccttcttcatctcttctgcttttctttattttgggaaatttcagagtagagacactcctggaggaaaagtctcatcaatgctgatacacgtggatgttttactccaatgatcttaattcctcacctggcatccaagactacgtttataatgttttcatttcatagtcagggctgtattgctcatgtttagtttgacaagcatcacatctgattttctgtgacccttagaactctttgcccgttgcatagctgttttccccccagtgtctctatttgctgtatttggccctgctgcttcctgatgcaagtcttgggcaatccctgtggaacatcgcttgttacttttcctgttgactctgtggtatcgattagtttagacgtgcatgcctctattcatgtgtgttctcttgtaataccataaaaacatgagaatcgctgtggagtgagaattgtggtcaaccttggccaggagactttctgacagtggtgctgaggaatgtgccatgggtctgtggactggcccttgacatgagccttgaggtttagggttatgctttgtagtagtttactaagacttccatagcaaaggaccatagcctgggtggattacacaacggaaatttattttctcacagtttgggaggaagtgggagataaaggtgtcagcagggttgcttcctgctgagggccgtgagggaaggatgtgtgccaggcctctcgtcttggctggtagatggcctgcttctccctgcatcttcacatcattttccttctgtacatgcctgtgtccagatgttctcttcttataaggacaccagtcatactggattagggcccactctaaggcctccttttaacttaatcatatctgtaaagaccctatctctaaataagatcacactttgaggtactggggattaggacttcaacatgtgagttgttggggaggaggccacgataaacctggtgacatacctccgcctggtaaagcgtagctcagagggtagcaacatgacagctctagttagatattgaagaactgacacttagagaagaagttagatttattttgtactatttaaatgttaaaaattaaatggtagctgcatatgtggataaaaccataaactgccttgctggaattgtgtgacaagagcactgagattgctttgtgagaaatctccctgttaaagagtgtccctgtgaaggtttggagttgccctgcctaacagaaatatagcgtgagccacacaggacacttgtaaatgttctagtagcctcattaaaacaagtaaaaaagaaacagatggaattaatacgaatactatatttaatttaatccactgtaggcattttgacatgtaatcaatgtcagaaatcattagtgagctattttctattcctgtttccattcttagtctttgaaatcttgcagcacatcttagtctcagcagtcgcatttcaagtgctcagtagtcacaagggagccacagcagctcctgtactggacagcaccagtatagggcatccattctcaacaggggccatgtcgcttccaaggaaacgaaaagtggttttggggaacaaaagaaatcttcttactgtttttgttttttttgttttttttttttttggtataaggcacagttatacatacagcatataaacagatattcagcctatctgcaatattgaagtgtcatgggggatgattagaaaaataaaaacctaaaaagcctcccttgcagggcaataatggaaaaagttgagaagcactgttatagagtgcgtacttgaaggtttaatttccagtgcttcccataccagcttaactggctttccttgaggaagtcacttagcccaagccttggtctaggtatctgtaaaatgggaataataatagtgtctacctcttaagttattgtaagtattaaaggagaaaagccacgtgaagttcaccacagtgattggctcagagcaaatgttgagaatgtatcagttactattcagtcagggatttttataaaaaggtatactggtattagaagtgagtttggattagtggtgcctttgtcatttcgtctcagtttctttagtatttattattgacttatatcagtgcattgatgagcaaatcattgtaatgttaatgttgattccagtgactcttttttttcttgctgaattgtttctcattcttcaggatttcgaggttttgttaaggtcttttgctttgccccttgattgtttttgatttggcttaaagactctttagagattcatgtaaattactaaataacatcttcttaattactatattaatcttcactatttatgatataggaatgacagtaaaacgtattatatcaaataaagagcagcaagtagaaatttactgaacattatctgctattactaacttaagacaagtatgtttattggttttcttttttacagacaaacatttatcagaaaaaatacaactttaagtaaattagagttgaattcttagaagcaatatactcacaagatatggtttgcctgcattctaaggtcacaggtgttcttggaggtaaacatcatcctattcctgacccaaagcctcacctattgtaggcctacatccgtggttttgtaagtgtggcccctggaccaacagcatcagcatcaccatgagcttcttagaagtccagattttcagactccgtcccagagctactaaatgagggactctggagaaagagcccagcaatctgtgtttttacaagatctctcagtgaacttgatgcataggcaagtttaaaaaccacaatcttatgaaatacacacatgttatagatgttgatggagaggtaaaggattaaaatatagaccatctgagagctgtcttcatcattctacagtcaaaggtcccaagagtcgcaacccatctgcagctcctttgtcaatgaaggatggtcatatatttcaagtttcaaacctgggtatatgttctgacaattaagaatatttgggatctgggttgagtggctactttggtatggggagaatatagatactagcagctatgtgggaggtgggaaaacaagcaggtggaattgaaaatagacattcatatatttctgggtcagatcctactttgcatggcaagaatgccaagttccagctgatcttggaatgttagaggtgattatgaaggaagcgggcagggagccgagataaatgatcacttaacagaggaactgtggccggaagagtggggtcaagaaaacattgaacaaagaagggttaattttgaaggaggggaaggaataagctagaaatggaagtatctgaaacaaactaggcagcatagaacagtgttcctaaatataaattttgaaaagttttttttttttttttttgagacggcgtctcgctctgtcacccaggctggagtgcagtggtgcgatctcagctcactgcaagctctgcctcccgggttcatgccattctcctgcctcagcctcctttagaagttttattctgctcacttaaatatttgattgtatgggatccttgcagggaatcgccaccaagattttgattagaattttgtcagatgctctgataagaaaagaaactgacctgaaaaagataagttacacctacagtttattctaaagtcctctagaagtgggaatgtgtgctgtgtgcagcctgtcaaaacttttattttggcaacttctagaagtaacaaaacaggactgaaaatattgctatgatttattggaaacattggtgtgagctgttatgcatgcaatctcatgaaagaagcctaaactattttaaaaattagtctttcattataatatcgtttatttccaaatgtctttttttgacatttagaagtaattgggaaattttaaaattctagctgaagttccttgcaacagcacggtccttgtaaaagatatttttcaaactgcatgttaaggatgtatatatggaatatcagcataaaacagaatggcagttcctcaaaaaatgaaacatagtactatcatatgatccagtaattccacttctgggtatatactgaaaccaaggactcagatagatatttgtgcccctatgttcataacagcattattcacaatagccaaaaggtggaaacaacctagatattcatcagtggatgaatggataaacaagacatggcatatacataaatggaacattattcagctttaaacaggaaggagatatgacacatgctccatgaatgaagttttaggactttatgccaaataaaataagccaaacacaaaaggacaaatattatacaattttacttatataactacttagaatactccaattatttaattacctggagtagtcaaattcatggatacagagagtaagactggtggttgccaggttataggggcaagagggaatgaggagttagtgtttaatgcatgtggcatttcaatttgggaagatttaaagttctaaagatggatggtgctgatggcagcacagcaaggtgaatgcatgtaataccactgaaaggcatattagaaaagagtaaatgttatgttctgtatattttactgcagtaacacagaatatcctgataaacttacatttagtattttgatacatctgtttttaattataatccactataataataatgaacatttttatgtggcaaacatgcccagatgctttaccccaaattatcctagctatttctcacagcaaccttctgagttaggtattatgattattcccttcttttttcagttgtgtaaagctatgcactgagatgggacaggcaggaatttgaacccagagaacattttccagaaccaggctcttacaataaaacttaatatgtagattaaaatcattcatactgctctgcccattaggaagaaaaaagtcccaaatgccaaaattatctctgcaagttctaattttcattacaagttcttttaataagctagatgatatgacacactatggttatgtgtatgaaaaaattgaaaaaactggcaatttatgtctctctaaaaaatgcaattcctgcaaaggcctgagtgtttcagtataaaaatccatatccagtggcatgtattttcttgtgcagatggtatgtctttctgaaaattgctaagagaaaagaacacatattttagaaatgtttaatattataattacaatgtatccaagttttgctttatactatgcatgctttaaactcagaagactatttacctatgatgttttattttagcatgtaaaattgaaatttgcaacaagtttgtatatatctttctgaatatgtagaagatggccttatttactgttaccttggaaacagtgatgctcaaatactatgttttactctattacaattaaaaatcattttatggaacaaatgtaatttaaaatactattcttaagcatggattttagttaatattaatcataaaaataagtaatgatgtttagtgttaaaattatttgaaaagctaaatatagatttttaatagaaaacataccttaatcaataaatcataatgctttttcctttacaagttatgtataagtcttctgattattaggaaagaacctcagttacataatggataattccatgaagttaaaaatgccatgtctaatttcttttgaaatttttcttaataattgactactttggagaatctgtacaattattacttcttaaataactcctggatagatttttctacagtgatatatgttgatattcatgtttcttcttacatttctaggactcaactattgttactccaattattttgaggactgaccctcagggatttttcttttactggacagatcaaaacaaggtaagaaatgaggtatgcctttcttacatttttcagtcgtttactactttgaaaagtatttatgtatcttatctatagaagaacatccatttcacagatcttttgcagtttatttaaaggttctacttttaaagaatatctaaggtattcttaggacttaggacgtttcaaagtcactagtttgaaatattagatttgctaaattctagagcaattggtatttttggttctgtttatattatgtgttaggataagaacagggaaatttgaattacatttggtgtagcacataattagtcagcgttactgatttaagtccccacccataaaggatgaagaaaaatgatgagaaaataacttttgacccaatagccttaccccttggcttttctttctctctcttttcccctgtgctgttcattaaggactctctcagaatcagcaggaatttggccctgataatttgttgatgtcagaaaaccaagaataaaattcctttagcctattccttcagttgtcaggaatttcttactaaattagctttctgcccacaatagcatgaatttattatctcatttgttatgaagccaattgatgattctgtactgaattattaaaaagtagaatatctgctgatcataagatttatttggagtttaatgggcagttagatgagaacactcatggaaagtggttattatttcaagcatcgttgccacagtcctacacttgaacctcagaggccacagaatatagaatgtttttgttctctaagttttgatatatggagaaatgggatagggtttactgagaatgctaaatacatactgaaaacaatagaatagtaatagtataccattaaaacagctggaacctccacagttacggatgaaggaggaacaaattgttagctctttcaaaactctacattagtttcttatatccaaagttcctggagttgcctgtcagctttgccttctgtctctgaggcaagctcaattatacctgtgtctggtcccagggccactcctgaatgagcctgtttacacatcattcaaaaggtgaatttcagtcttgttgtcctggaattagactctaaatcagtgtgccctggaaccatgtgtggctgtagaagtggaggtaaaccacagaccctacgctaatgtcaaaaattgtatgagtaagatttcctacttaacgctcacatttattattgggtgtgttaatcgctttggcttagacattctgtttggtttcctgctgttatgtgtaaaacaatggcttgcaagaggttttgttttttgggtgtttttttcttctcctaaaggatatttttagaactgttgaaactatattcatgaacgatgtacttataatgcctagagcatttctaaacgttgggtatttgtacgagagaccaaactgtcagtttgatttttcaacttgtagatcaagcttctataaaagcaacagaagatattctgggatttttaaataattcatggcaactcagttaagctcccctctagaccaatcatcaatatttatttccttaataaagaaaaagggtttaggaccaaaggctctttgttgcatttctgttgtgaacccagtattttgacccatgcttattttcaaaggtaggaaaatttgttttcattttttacacaaacttttaaatcttggttgcaatgctgtttatgaccaagcgaaacagataatgtggtagcaattccttttatcatgttattgcttttcttttcatggatattactcttacagttctagccaagagatagaaatagtaaattttacttttcactttctaaatgccaaagtcatctctcagtcatttatcagaatttggaggctcatttcttagtgatcatatatcttagaatccaaaagatgagaggatttaagaaaaaaaaattaaacttaccatgctttcaagtttgtcattttctttctggcttgaagcccagccctggaaccagtaagagtgattcatccacttttaggagatggacgactccaagtgatgaattagagtaaatgtgtgctagaagaaatggtgcatgcaaataaaagatggcatgccaagcttttagtggggatttttttgcataagatcatttgaaggtacatgaatgaatggtacattcatgatgctacttagagggccactttttaaaaaatattttttatctggcaattagttttaggaatctgccacatgtaccatagagataatctctcagaaaacaaaaaaaaaatgtgatacctttaagtttatcccttgattttatacactgtgttttccattggttgggaagcttgcattggtatttattgtaatatgcctctcttcttcctttgggcttcttccaatatattccctctttggtccacgaagcttataccaaagcacttggattagcaatcatctgaggcctagtctgctcagaggtgagcagaaatccctagcagaggggattttacaagtgttttttatttttcttttttatagcattggaggtaaatggccacattttatgatgttctatgcatgtccgtctcttgtcatggctacatcagatcttgtatcagagccacttatttcaagccactggctttcccctctgtagacaatgacatgctaccttccaaaacccctcctttgatttgtcaccacagaaatgataggtgacaaagaagacagcacagatgatgaatttaggaattaaaaactaaagctagcgagtcatttttaggtagcagaaatgtgctttagtgaaacactgacaggatgtttggagttggtggaagcagataaatatgaatatcatttttagggataaatgttcatgctttgtaccagctctggacttattttaataattcttttcactgtattgttggctctgtaaatcttattgaataaaatgagcaaaaatgagtttctgaatatgactattttaagcagagtggtttttcttgtgtaagtgtaggtgatgtgaagaggatgaatttatctgtaagtcatgggtgagaagggagtcctgcacagcctgagtacttgagaggtggcctacattaggctataacttttctttggatccgtgccatgtgaacactagaaaccaacacaggaagtgttagctgtgaaaaccatgtgaactataagaatctgctccaccggttttgaaagaaaggctaaagaagaaaaaagtgtcaatgttaaagagctaaccaaaacctatcctgctagaatatgaaaaaaattagacctttgccttgcaacctgatgccctgcttctgtgccaaggttggtgtaaaaataaaactagtcaccactagttcagatccaagaagttcaatatagttcagtaaacccttccttgtcttcataaaactggagcttgggggaagggaaaaggaacacatcattaaatttgaaaaggaatgggaggaagaacacacggtttgcatgaagaactcccattactttcttttttgttacaaattttatttgtttttaatattgtggataatatacaaatatctttttatctgtaaaatagtaaagcaatgtaactatctttaaactgcactctcccattgactccaatcctagttctctattcagagtcaactaatagtaatagcttcatggtttcttcctaggtctcttttaaataaatttgtgcatgtgtaactatggaaatatttcattttgttttgcttatgtccatttttatactaagtcacatcatattaaccattctacaatttcctttttaccatatagtgtgtctcagagaacttttcaagttagtacatgtgtgtctatatcattccgttaaattggcctatcttagggaatttttcatgttagtacatgtgtatgtatcacattctttcatattgctctatcgtatgttaaacaattgattaccacattttatttaagaatacagaagttctcactggtggattcttggtgtttgtctctaatttggggttacaaagaatcctataatatggagtaatagtcagctgtgtgtagccctctctgggaatatgggtcagggattccctaaggtaaatgctcagaagtgcgattgctgatttaaggctatacctatcctaaattataatgaatggctgtaccattttataaccctacctgtcttatatgagtggaactgttttcttaagcccaaccaacagtaataggaaatattttaatttttgcctaactgatgcaactgttatatcaccttgttttaatctgtcgttgcctgatttgctagtaaactgtgtatattatcatacatttattgatcatttcagtttttccttacatggattgcctatttatatctcttgcccttgtgtggacagttctctgtgtattctagatgtactcctttagctgttataaatgttgcaattacactcttcctgtctgtggtttgtctttgactttcttaacatctaatttatgggtaacaaaagatgacttgaagctttaagttttcatgtagttacattccaactacctccccactttttgcttcctttaagatatttctgattccttctcatcaccgttattaatctaggtttttaatccatatgtaatgtattatgaggactggtgtaaggtggagctctaacttcaatttcttcatatcactcgtagagctgacatttcactacctggtttggatggcccaaagatctgttatgttttaatgcctgtggactgctgggttctgatttcctacttcattcttatctcatttattttctgcctttcttactttgtggttcaaaattgtaattctttttgtttacccgtgatcctatattagagatttaaatttatacctgcatatttagtcatttctggagacttagggcaagaaagattggttctaccattcatgccatctgccatcttgttctgccctgtgaatttgcatgagacaccattctggatgtttgtacagagtgatgattcagtttccattaatggcaaccatagatagtcttctcttatgataaccttaaatttctacagagttcaaaagcaaagtttaaaagttaaatatttacataagtcacagtaacatttttcagcatgagtccagagttcaaaaatattttgaatgatgcatcataaatgtcaacaagaaaatctagtgatttcctattaaaaatagtctggcttccataaagaactactgggtaccacacatttcattaatgatttttagcagtggggctttctctttgggatatgcttctctagggtatcccaaaattgtcaactttgacccttcttgtgtatagtaaatgggataggtcattcaagagtccactgagtgattaaatgcaatgatgtagttataaatttagaagataagtgctatttattttatttggtagctttctctaaaagttgaaacaataacttacattatctgggaaaaaaaccagcaaaattcacgtgaggattgctttgtgagggctgggattgttccttggcctggagcagtgtgtcagtcattgttgactaagcagcagcatctggggactaagtcctttccttcaccttccttgaatttccttcaccagtattgatgatattaatagctaaaacagacacagtgccatacccacaccctcttcctcaccactcctgagaacataagccgggctccagtggctggccagtgcctgcattcttttgctttgtctggctactagaactcatgttgctacccatgcagctgcccagaagttcctggcaattcacactcaccctcaccaatgggattcagtggataaataccacagctccctcacctcttgggtgggataacttaaaggtgcattctttatattatatcccagaactctctagtgggattaagcccagttacccacagtggcaactggcttgaaaatgttccccttatgggcttccttcccttcctgtctcacttctccactcctgattgtgttctaaaaccacctctaaaataaactacttttactagaatccttatctaggaactgcttaatgcagatgcatagtgcttaacaacttaatatagatgcccccaaatgaagggttttaaaatgattccttggttaagagagattggaacatattaagtgaacacttttatttgaagccaagtctgattttcctaaaacagtcctaatttgggaagcccaaagctggttgaggaaaccagctttgaagctgtgacagatgtggtttgtcacagtctggctctgctgtgtatttaatgagtcaccctcagtgaatctctttaaaaatcaaagccttggtttcattatctataaggtgggtattactctcttagtgttgttgtgaacattcaatgtgtaaaatgaatgacttagcataacacctgctactttgtaaactctccatcctttgtggtggcttttattattgctacataataaacaatgactctctgaccaaacaattgtccataagtattagagaccacaaaaatgtgctgttttgaaaaccaagtgaccatttatttatgtatatctttttattccttttttcttcttcaaggcaacactgacttgttttctatttagactctgctgtggtcttttgatctgaaacattgaagcttaggtctgtttgggcaaataagatgtttatttatgtatttcataatgttgtgggaacagagccatggaaggcaaaagaaggatttattgtttaaaagactttccctctggggataatttgctaataaatagtccatcataggtgaaagtttcttggacccttggaaatttgaagcatcgtatggaacaacttttaagatgatttagaggactttgataggagaaaattgtattattcacaagaaaaattggacacaatcatggttgcctatgcctttttcctaagatagtcactttaggattgtgacaactacatgggcatcaggccactcctcttcctccctactgaccaagaccttagagattaaacttttagtgtttttgaggatagtttagccactaagccaaggttcagattgctgaggaacaaatctatcctcaccatatcaacttccaggttaagtttttccatttttattaacattaccttcttttcacttctgtgactcctcagagattttgcaccagtgaactctggctagcatagaatagacatgtcatgatgccttagcttatgtagacacaacatacaaataaatgttattagaatggaatcatttacaagttcttcttagaggatgtgatgtatgatttttttggtagaatttctaattgaagtgtagccttttaaagtatattttaaaattaggctagtcattttgagatggtttcattgcagcttctttggaatcatttttagagtagaaatgcattagtataatttttatgtcacaatcaccacacttcattatgggcataacaacagcaatgcttgttttaatatattgtaaccagagtttagaaacatgtaataccacgaaaattcattactcctaatataatttaattacaaaattgttccttggtttcataagttgcatatatttagctcttcccactactttaggagaaattaaattggatactttccatgctatgaagctattataatggaatatttgtactttttgatgccaaaaaatggttcgagccattggattggcagaatatgtgaaggaaatgcattctgcatattgttcataattttacttcctgttacggagaaaattcctttgactttgttacaaatagaatccccgggtacttggtattgatataatgccatgctcttttgtttgaattacaaatgttgtaggtagagtaggcatttttggttgttctgtagttcattttcttgccaactcaagattgttgatggtactgatggagacattattgtattagtccattttcatgctgctgataagacatacctgagactgggcagtttacaaaagaaagaggtctcacccacaacatacgggaaatcaagctgagatttgggtagggacacagccaaaccatatcattctgcccctggagcttcccaaatctcatgtcctaatatttcaaaacaaatcatgcctttccaacagtcccccaaagtcttaactcatttcagcattaactcaaaagtccacagtcccaagtctaatccgagataaagcaattcccttctgcctatgagcctgtaaaatcgaaagctagttactttctagatacaatggaggtataggcattgggtaaatagagccattccaaatgggagaaattggccaaaacaaaggggctacaggcctcatgcaagtccaaaatctagcagggtagtcaaatcttaaagctccaaaatgatctcctttgactccgtgtctcacatccaggtcacactgatgcaagagatgggctcccatggccttgggcaactccgcccctgtggctttgcagggtacagcccccttcctggctgctttcatgggctggcattgagtgtctgtggcttttccaggggcatggtgcaagttgtaggtggatctaccattctagagtctggaggatggtggccttcttctcacagctccactaggcagtgccccagttgggactgggggctccaaccccacatttcccttctgcactgccctagccgagactctccatgagagcaccaccccagcagcaagcttctgcctggacatccaggtgtttccatacatcctctgaaatctaggcagaggttcccaaacctcaattcttgacttctgtgcacccacagactcaacaccatgtggaagctgtcaaggcttggtgcttgcactttctgaagccatggcccatgttctatattggcccctttcagacacagctagagtggcagggatgtagggcaccaagtccctaggctacacacagcacagggacccttgttccaacccacaaaaccattttttcctcctaggcctctgggcctatgatgggaggggctgccatgaagacatctgacatgccctggagccattttccccattgtcttgaggattaacatttggcttcttgttacttatgcaaatttctgcagccggcttgaacttctcctcagaaaatgggatttccttttctattgcattgtcaggctgcaaattttctgaacttttatgccctgtttcccttataaaactgaatatctttaacggtacccaagccacctcttgaatgctttgctggttagaaatttcttccaccaggccgggcgtggtggctcatgcctgcaatcccagcactttgggaggctgagttgggtggatcacctgaggttgggagttcggaaccagcctgaccaacatggagaaaccccatctctactaaaaacacaaaattagccaggcagggtggcacatgcctgtaatcccagctacctgggaaggctgaggcaggtgaatcacttgaacctgggaagtggaggttgcagtgagccaagatcgtgccattgtactccagcctgggcaacaagagtgaaactccatctcaaaaaaaaaaaaaaaaaaaagaaaaaaagaaatttcttccaccagataccctaaatcatctctctctagttcaaagttctctaaatctccagggcaggggaaaaatgctgccagtctctttgctaaaacataacaagagtgtcctttgctccagttcccaatgagttcctcatctccatctgagaccacctcagcctggaccttattgttcatatcattatcagcatttttgtcaaagccattcaacaagtctctaggaagttccaaacttttccacattttcctgtctccttctgagccttccaaactgttctaacctctgctttttacccagttccaaagttgcttccccatttttgggtatcttttcagcaacaccacactactggtacaatttactgtattaggccgttttcatgccactgataaagacatacccaagactggacaatttataaaagaaagaggtataataggattacagttccacgtggctggggaggcctcacaatcatagtggaaggtgagaggcacgtctcacatggtgtcagccaagagaaaagggcttctacgggaaactcccatttttaaaaccattagatcttgtgagacttattcactatcatgagaacagcagaggaaagacctgcccccatgattccattacctcccaccaggtccctcctacaacacgggggaattcaagatgagatttgggtggggacacagccaaacctatcacttgtcaagctctttctatatttaatcagcaagacaagtctctttttgtcttttgggaaaataaatttagattgatagttggattatttaaacatttatcacacacacacaaaatattaaaataaataatataattactttcttccactttaaaatattttaaatttactttaagtaatttaaaaggcaaaaatgcaaactttgaacaactgacttattaggacgttggtacctattataaataagtttctcaaatctagcaaagtatgtaatattcactaatttactttgcacatacctttttatcgttgttatcattatccttgttatccttagcatcaccaacagcaaacacatatatgctgttttatccttgccagacacaattctaataatatatagtctgtatatttatagcatatacatatttttatacatatatttatatagtatatgtagcataggtatacttatagtctataatagtatgtatatagtgcatatatgctacatatatacatacatagtgtgtctatatgccgtgctacatatatacatacatagtgtgtgtatacttacacatatatatagtgtgtgttaacagacctatgcaatttcgtcatttccataatcctatgaatgacagtgctactattatctacatttaaaagtgagtaaactgaagtgtgaacagaggttatgtcatgatccctggttgtacagttggttaatggcagagtcaggaatagaaacaacagtggcagtgcagtctggctctatgttctggctcttaactttttgctgtttaaagaacctgtttaatatgtaaagttaagtttgcctgcaggatttttttccttggatttgtttgaaaaagaaacctcagtaggcctagtacatttgctaggaacagacaaactgtatgaagaaggtattctcaagttgggctgcacaatgaaatcacagggggagcctcaaaggacgctgctgcctgggcttcctgtctccagagaatctgacttaattggtctggggtgtggtcagaacattggactttttttttttttttgaaagctcctcatttgattctaatgtacagccaaggtgaacacagatagaaagcaagctgaccttacaaattaattcagtaaacttcctgaaaggatgtgctcactttgcctttcctgcctgtgacgtggcctactttctactcagaagtaacactccacatgagcaactacaggccctaccagattctgaattatttgactatgactggataatattccttacactgtgcttagtaaggcaataaattactaggatttttttagaattagtctcaatatctaaggttgaatcaaaatagtttttttattatattctgtcgatgaaaatttttttaactttccattccctgaatgttacaggtattagctgtttgttttatcgttaccaaacatgtcctcagaattcaagtcctgtttattaaccttatatttgtgttttttgagacccttgtttagatcacagtactgtgtaaattccatacttaattaaattagctgcacccttgaatgagtgaatgtggttttaagaatgaccttatataactattttattttatagctaatttttcatttctgggatacaaaggcagatgttatcttattaaattgtagcattatgtcatttcttatcaatttgtaggaatccttccttaactgagacatacactcaactgggcaaaccagagagagctagataatttcaggtgtgataggaagtttgcctttcatcacctctacatgatacatttcagaatagtaaaattcacatttctcctgttagaatgtttggttttttattctgcttctatagggaatggggattgtggtaatgatttttcatgagatttctccctggcattgtgcaaaactccacttaggaacagtggtctgaaaattatattgcatcacggcaaacaatgcacctgtgtgaaatgaatgcttaagtgaaaagttttatgggacagagctagttgctatgctaagaaactaatgactgtgctggtatacataatggattctatttttagatgaacacttggtcctatagcatggcttcattatgcaagaggacagaagtttcagcgttatattgtgaatattgagacattaacatatcagagtatatgccttcttagatactaaagtgactttttcatatattttaaccctgacatagttcataactagaggaaaaaagtaaagaacaaaaacagaatttcaaaataatttcaggtttctggtgtttgtaggttgagtttttccaacagttgactgcaaggaaaggattcaagttcaagtggtttatttgggaggtgaccccagaaagtgtgggcagggccatggggaagtgagataggcaagggaagacagccattaaagggtgcactatcaaataagttaccatggtgtacaagtgaagctccgtcccattggagagccctgggagacagtgcagagaggagagggagcagtggtatacccaccagttcctaataatcagtgactgggggcagctctctcaggggttattttctcagctcttctgccagcctctcctggagactgaggggcttccaggccagtgggccctaggctttgagaaatccctcagacatagatgcagctggaagctgtccgttggcatacatgaaaacacatgggcaccaccagcagcaaccactctggtggctttaatttctggtaagtcagacttttaaaatctatatcgcagtgtgcaaactggagcctgcacccattcacgaacagttcttgcttggcctgtgcaaataattaaatacataaacatgagttgccagcatttaaaaatctgcaggttcatatacagatctggatttctcaaaaaatcagaaggcatggaaatgccggccgacatacccccatggccacatttggctggggcagtgcagcagctgcctgctttagacagggtgtgtggtatgcaatctgccacatttcccaccaggctagcctacctaatttacatgaacttttaagctcatttagatgtttgagtataaatatcgggcctctatggtaacatcctatactggaagcttcaataagctaatgattgcaaagcttcatatggaatgaggttaattctgtcacagtgggcctattggagtgctgtggcataaagactagatttttacagtggaaaaatggctgaagatcagcatatccaggtcttgctcgtaatggccataagcaaagcaattatgctccaatcccaattcttctctgtgatgtatggatctaaagtgtaggagccctgaggtccctctctgacttaaaaggctattattccaaagtgactttcaggtgtcattttgctaggtaagatttataaatatgagtccttggcaaaggattttcgtgtcgaattgggccattaatctagggaaaataagaatggtggactccaggacaccaggcagaatgacttcccttggttcccttggttgaatgaatgggattaacttcacccccagatcaaggcagtgagcattgactggtttagccaaccaatgtagtccacccttttctcaccgtagagctgtgctgtctcatacagtagcctctagactcatgtcactgtttacagttaagttttaattaattaaaattaaattaaaaattcagtttctcaatcccactacctacctttcaggtgctcactagccacctgtgtccaggtgccatttccatcattgcagaatatgttattggacatcactgcacagagcttggatcaggaatggctcttcagagccaatgcaaagtttcttgcaataagaagcttccttgaacttgtggggaaagaaactttccttctttttctggattatgtgctgcaaggatgtaatatctggactcacttttgttatcttgttcccatgaaagaagatattggagtagctcagatgccactttgggagctcaaaggggaagctagccctgcagaagacaagccagtgaagaaccaagtccttaatgatgtcatttgagataccagatcagtccatttcagttccatgaatgaatcaatccccttcataggctatgccagtttaagatagagtgtttgtccctttgcagttagaattactgactgacacattggacaatcatttatttgaaggaaggcagagactcaggtgttaaggatccagctaacatctggcccataaacttgaaagagaaataaaagcgggaatagaatgtgttaactctgtcagtggctatcattccctgtacaagacattattgttagttttgtatagttttctaatctgggctttaacatttcaaggataattttagtggcttctagccatcatgaggaaagaacatgtcttgagaaacatggggaaaattgaaaactgtacagagaatataagtttttggcaatgttgtatgttaacctaatagccttaatggtaccatgataatttctgggtaaggaaagtagaacttattaataaactgttgtgctgcagacattgtgccaaggtaccttatgtggacaaactatcacatgaattcatgaattgattgatttttttccattttgcattgaggaaactgaggctatggagagggtgatttttaccctggaagactctctctaaccctgccaatttagaatgaaaccctctcttctgttcttctggaataccttgtgccttcctttaccttagcactattaatgctatgttgattctgtctgactctttttcctttcccagtggatgatgaaggccttgaattcggggactttacctcatttgtttggcattttgaatacactgctaacatacagtcactgctcaatcgatgtgtgtcaaatgaatgagacttacaaaggctgtgcatcttgtctaaggttacaggttactaaatggtggaaagccagatctgtcaggtccaaagccaatgacctttcagtagttcattcattaaaaccctctccttcttgtttaaatctccagctgtcttactcttagcagtttatgtgacctctgcctcctggagaagagagaaaacacagtattccctgccaccagacctaatagcacactttcatttacagctgctttcctctgtctccctcttcctttcccagcccatcctttccactttgaccctggaccctagcttctcaatgatttcatactaaaattgatcccttccctttcttatgttgtcaatatttcccctgtaaccagatctgtacatcaatattaaacatgacatgcttacccatcttaaaagaaaaccctatatcccctcttgaccctcactggctacttcctttctttctcgctttcactcatagcaagcttcttcaaagacctgcctatgctctccccattattctcacctttcaccaacttttcaatacatatcaacctggattctgtacccactactcctccaaattagtctttcttaacccatcaatgaccttcacattttaaaacatgctggccatcttgagctctgtggtgcttgattatttttatataattttacattgttgataaccccattttcctcgaaacactttcttttcttgactttctttttctcctacctcttcctacctctccagccacatgttcgcaatctactttactggctgtaagttgcagtccttctctactcacatgttagggaatctcacctgcacttaaaacttattttaccatctggatacattggctcccaatttcatatcaccttccaataccctgttcctgagataccggaaagcaaacatttccaagattggtatcatgttcttcctcccttaaatcctgacctggtcctggtgccttattaaaggtaccacccttcacagagtggcacagtcctgaaccctgaaagtcttccttaacaccttcttttccaccttccctccaagttcttggcccctttccttttgtgctccgtccacaatagccgccttctgtttccctagacacggcatatttctttctgctgaaatttttcacaatacttttcctctgcttggaacacatgttttctccccatggattagcccctcccctgcttcaccacacttctcacagttgtaatcaaatgttttttacatagttatgtaatatctagctcccgtattaggtttttgactcaatgagagcagagtccagaggtgtccttgtccgtgtttaagacctggctctcttaatggggaaagtaacttgtagcattcgccaatttccatggtgtaaatactgtagtgtctgatttcgagatatggatacttcatcactgaacacagatttggaaagtgaagggtacagttggctctcataagcttacaagctttccccagctcacccccagggcagatgcttgtctgtcttattgactgctgtattttcatgagttagggcagtgcttggcacattgtaggaactccaagactattagttggaggagtgactgcagtgtttttattaccattggaaatatagtaaaaagtgctgatgtttcagagaaaaatgaaataattttttaaattttagaattggacccagcctgaaagtttatcatatgccatccctttgtttttcttcattagaattgagggtcaggaagtgagatctgccacaatcacatagctacctggtaaatgagcccaggttaaaatgcacatcttttaattaccgaccaacactccttctactgtagtgcattatcacttctaaaaggaaagtaatttctttccactagtgatttagttcagattgcattattagatagtgacgtagttgaatgtataattaaatctgctttacaaaagaaaaagcagtattttatcatttctttttaaattatgagttgtctcttaagagggatttctcttttatctttttcttctttaatattctgatgtacttatttatagaacaaagacattagtcagcttttgtggtgtagcaaaccaccccaaaacttatgccttaaaacaacaaccatttttttgaggtcacccttctttgggttaacaatctggtgcaggctctgggggatcatttttctggtctcaggtgggctccttctggcttctgcagctactcatgggttggatgtgtggctctgctgatatggctggcctctcctgtctgaggcttcagctaggatggctaggctgacttgtatctgtcccatgtggtctctcatcttccaacaggctagtccagcttgctctggtagttcactggcagagttctgaaacagggtggaagctgcaaagccctagaagcagaattgccatactggcacttctgccacattttctatgccaaagcaaatcattcataggttggggaaatagatgccacctattgatgacaagatctgaaaagtcacactgcaaagaggcatggttacagtgagaagaataatttgtgactgtttttgaattacatacaaaaaagtaatttcttcttcaaattagtagaagattgtctctctgatgggatagaactgactgatagcttcctcatccttctgaaatattaaggcaatatgaagtaccccacctggacaattgtgttaattatatatgcccaatattagagcacttacgctgcagtgaggtgggtgtctctcaccataccctagacttggaggtccctgataggtgttctgaaagaagatccctgtaaggttatagggaagtaaagccgcatcccaacatggtgcacagacagcagcctcctagcaacatctcttaaagcagatggtgttttcagacatattgaggaatgaggtgggttgggagcagttgcaacaagatagggaaaccttaagtcatctttgaggatactagtttgttgtgctattttttttcttcctaaatgatttggaagtgatttttctgtgcctgatgtagtcttttttttttttccctttctttgtatcctgtgttgggaaatggaaataattcaaaatctgtaaaaacactgggaaaatggaaattaaactttgggattctttactgcagaaaaatgatgatgggaaatgttcttcagtagagaggtagaaatcatttcagaccgcttctcctagccggggcccacaacatgcatttttctgggatgaaaacacatgagtttgaccaaggaaaagtttggtagattttgtcaatgaagcatgaaaagggatcagtctttactctgagctcatcttttttttttagctgagtgtgctcttggaagatgcaggcatcagtgtatttatatctgggtcaacagggcatgcggtgaaggggaaggaaggccattacctagtgaatgtatattgggtggggagccactgaggttaaaaaattcagcctactgccatctctttactttgggctgtatggaagttgttcatgacctccataattgttcttttgtaggataccctgtatcagattatagactctgaaatccaactcccagggttcaaaacctgccttgaacactatgtatctctgaggaagacatttaactcattctgagcttccattttctcttctacaaactagaaataataaataggaatcccatgaggattaaatgagataacacatctgaaacacttggcacaacacacatgctgataggtgcttcacaactgctactgatttttaggataaattttagtaaattttaatatatattgtgtgaatctgaactaggacaggtattcggatacttctgattcatattctgagtctttttgcacccaattggttgaaacatcagggcccccaaggaatgccagtgtctcaggttgcagataatactgccaagttgcagataaatccctgattggacaactatctaagagttagtagatccactcagactcccaggaacttggagtgcagttttcgatgcctgaattcagagaggacagggtgcgtggtgcatgtggcctagtctacaattgcttctggcctattgaatcttaggaatggaaggctgaaggggagaagatagtttgtcatcaaaactaaggttctggacaaatttggagggctcagttgctgggctggccctggagaatgagactgaattctcgaccctttgaaaacaggtgccatgtttgatttctttttgtgtcagcaatgcatcttctattaaaagaatggcattagggtctcagtcaagatggcctgaggcattcagttaagggtacactgatatattcctcctgctggtcagtgtcaagattctgctcctgttctctttcatccctgtgtacccatcttagatatttttgagtgcccatgatgtgctctttgttgtagtatctgagatctctagttggggaaacctaccaaagtaataaactattctatccattgttaggacaaataggaaaatcttactgactctaggagaaaatagcaggtatttctttctttctttttttttaaatagactatttcaaatcctaaagtagttttacttgatatttacagagcacatgtcataaactctatttaaaaacagaggtaaaaagggggaagcactgaaaaatataactcgagtaatcagtttcattcaaaatgtaagtgggagaatcagaatagaaaataatatgatttgcagatttattttaaatcagatctaaatttttagatttgcaaggtctgagtgaaaaaaaagagtgtcattgcttagaacttcttaggaaaacaaatcaataaatctgtaggaaataggctgtgtgctgaaccttatttggtttctgctttttgaccgagaagaagcatattatattgaaagggtatatacttggtacatagaaggaaggcgacctttaatctctgactttatataaacataaaaaccgtgaatagaaaagactgagcctaggaagaaataaaaaaggagccctgaatctatgaggctgagccatatgaaacagccataattgtaggccaaaaatggccaaacacaggcggtttctcataggccaacaatacagtcgttctgagagagcaacagcattacttttgcttagttgaccatctgattatgacagtttagaacctcatattgatgtggcaaacatgagttaacttctctattgttaatggatatgattttattctaatttagatctgatttaaaataaatctgcaaatcacattattttctattctgattctcccacttacattttgaatgaaactgattactccagttatattttcgagtgcttcccccttcttacctctgattttagatagagtttatgacacatgctctgtaaatatcaagtgaagttattttagtatatggtgcaacattttataaataacaagaaagagtatgctactttcaacaatatcatgtttaatatacataaaatatataagcatgtaaaatatatgtaacatatatacttaaaatgcatatacattatatacatttaactaagtacaaatataaatgttgcctaagaggtaagcttcaaattggaatttgagggaaataagcttcaaattcatttctcatatattcatcattttatttgttcatatgttatgttttttgttgttgttgtatgggagaggtactgatttaggttacttcttttgtagtagaggatggtagttaaaaatacatactctgaaccccatctgcctgggtttgaatcccagctctatcccttgtgagctgtgtgattttgagtaagtgacttaaactttctgcacctcagttttaatatatatgaaaaaaggataatattagtactcccttaaggttgtgttagggattacatgaattaatataatgtgtttggatcagtgcttatgttggaagcactaggtaagtgtttattattattacttctcattgtagtctcctttatgaaacgtgtgtgcatagcctgtctggaggatgactttttgtcttttaaagagagaagctgtactacttctactgtaccagaaattcatctgagagcaggttactttctcattgtaaagtccatgcaagccagataaacctatagggtagcacttccttaattagtttacaatttctgaggataggttggtgggagtaaactgcctctgagtgttcacttctctgggaactgtcccgtctgttgttgcgtatcatatgttctagtgcattttttttcagttatgtcctttcccacaaagcagtttggtgtaaccactgtaatcccagtaagctatggttggggtctatgtataggaatgtgcaccctgaaattcattcacttattcagcacaattttattgagcatctactaagtgttaggcactctctgtgtcagatatattatagataatatacaactacctaaatgcatagtaagcaagatattgtaccattgagagtagtaagagtgatgagaagagttcagggagggagtagtggtaactgttttacataggtactcaagaaaggaatctctgataagctgatctttgagcagagatttaaaggccgtgagggataagccatgtggttggttatctggaggaagaatgtcctaagcaaaagaattggtaaatgtgaaggtatgtgacttctgggatagtttgacaaacagttcaagaggccaattggctggagcatagtaaatggggattgggatcagtagtaggaggtgaggtcagagagattgctgaagacaagggcgaattatattaggtttttacaaccattgtaagggctttggcttttctctgcatgaaattcaaagatgttataaagttttaaatacagatgtgatgtgattggacttgtgttttttaaaaaaggatcactgagacttctgatctatacaagatggccagattagatattggacctgaacatttttctttgttcttcttccctaagtacaactatacatcccagacataatgtgagaggcaaccagcagaggactctgaaaggtgctaagaggaaggcagactggtttctggcatcaggaccagagaagcagcatggggcagggtatcttatgtttcccccagccagtaaaagaaggtgatcaggaccagcattttacaacctgtgacctagcaacagaaggtggttcaggaaagctccttcttttcatggagtccatccagtgtcaacagggaagcccagcaccattggcaaagggatcagtcgggaattcagttatggctagccatacatgggcagggtaaatgctcttcttcctgaccaggcctgggacttctccctctaccaagagatacaacacagggtcaccaggttgtaccagcaaaagggggcccatgcccatgacaacaagcagcctggcctgggatacctctttctccatgggtctgaaactcctctctcctgcccagagacactgagactgctgagtgacaccggtaagaggtatttcactacaacaagcgcttggcccatgaagcctatttgtctccatagacccaagatgctattctctcaccaagagacactgtagggtcagactgaaaaaaacctgtcagccctctcaggtacagggacctctggaagcccctctcatatcatctaaaccaagcagaccaaaataacacagcaaaggttctgaaaattaaaccatcggtggaatgacaacccacaaaagtagaccagaactcatgtgataaacttaaaccagggtgactacctgctaaaaggaaagatttgaatagaatttagtcttctaatatacaaaaataaaacgtccaggatacaactgaaagttgctcatcatactaagagctgagaagatcatggcttgagtcagaaaaatttagtcaacctcaagatggatcagattttggaattatcttacaagaattttaaagcagccaccataaaaaatgtttcagcagtcaaaaacaaattattttgaaacaagtgcaaaaatagaaaacttcagcaaaaaaatagaagtttttaaaaagaaccacatgtaaaggataaaactgaaaaatacaatggccaaaataaaagaacacaataggtgggttcaatagtagagtggaaatgatagaagatagtgtcagtgaattaaggacacattggcagaatgtactcaatctgaacaacagaagagataaaatagattttaaaaatgaactgagctccggggacctgtggaacaataacaaaatttctaagatttctatcactggagttgcagaagagacccaggggaattgggctgaggaatatttgaataaatcatggctgaaaatgtcccaaatttggcagaaaaacacaacctaagaatctgagcgcacctcaaacaggatacaccttagcaaatctacaccaagatacatcatgtgtaaacttctgaaaacaaaggcaaaggaaaaaaatcttcaaagcagactaagagaaatgatgcattaactacagagaagtaccaattcaaatgatagcagtttcttatccggaaacatggagaccagaaggcagtgcatctttcaatggctgaaagaaagtatctgtcaacagtgacttctgtgtccagtgaaaatatcctcctaggatttctctcagatgatgaaaactggaatttgtaagtagcagacccacccattaagattgactaatggaattttataaaacagaaaggaaagtatagaagaaggaaacttggagtatcagaaacagaaaataatggaaagagctgaaatatgtgtgcaagcaatagaccatcctatgcctcaacagtttgtaaattatatttgatggttgaaacattatgttagcatccgatactcaaggcaatgctatttaaaagtaggagtcagtaaagggacctaaatgaaagtaagatgatttccactcttcagctgaagtgtaaaatattgatacccataaaatgtaataaatcacatatgcatattgtattaggccaggtgcaagggctgatgcctctaatcccaacactttaggaggtcaatgcaggaggattgcatgaggccaggagtttgagaccagcctggccaagatagcaaattccatccctacaaaaagttaaaaataaaaataataaaataaataaaaaagatgggtgtggtgacatgcgcctgtagtcccagctactcaggaggctgaggcaggaagatgactttagcacaggaaattgagggggcagtgagctgtcactgtaccactacactccagaatgagtgacagagcaagaccccatctctaaaaaatattaaaagtaataataaaaactgcaattacttttgcaccaacctaataacaaacaaaaaccttacacttaaaaaatttataaagaaatcaagataaaatcctaaaaaatatttgactaacctccaagaaggcaagaaaaggaaaacagcagaacaaaaaccagagtaaataaatggaaaacaaataataaaaaggcagatgtaaactctaatatgtgaataaataccttaaaggtaaaagcaaagagaacctagatatagacccatacacatatgctctgctgatcttttacaaacatgcaaaattagttcaacaaggcaaaggacagtattttcaacaagtgatgatggagacattggatattcataggcaaaaaataagtaaaaataaaaaaaaaagtataaaatgaagttcaacataagcttcacacttcatataaaaatgaattcaaatagatcctagatataaatctaaaacataaaactgtaaaacttttaggaaaacacataggaaaatctttggaatatggatctaggcagagttctttgacatcaaatccatgattcataagaagaaaaattggatctcattaaaattaaaataatttctctgtgtaaaatcctaaaaagaggatgagaagacaagctacagactgagagaaagtgtttgtaaaccacatatctgccaaaggacttgtatctagaatacataaaggaccttcaaattcacaggaaaaaaaacaaaaaacaaaaaacctaaaccaaacaatccatttagaaaatgggtaaaaggtctaagtagacaatccactaaagaggatacacagatggcacataagcatatgaaaagatgtcgccttcattagccattagggaaatgcaaattaaaaccccagtgagttctcactgcacacctatcagaatggctggaattaaaatagtgacattaccaaatgctggcaagggtgtggaggaacagatcaatggtaggttaaacagtctggcagtttcttataaaactaaacatgtagttactatatgatataactattgtattatgaagcgttgatcccagaaacatgttttaaaagtatgttcacacaaaaaatctgtacacaaatattcaaagcagctttattaataatagcccaaactgaagatagaccagatgccttcagtgagcaaatggttaaataaagatggcatgtccatactgtgacatatgctactcagcaataaaaagcaatgaactattggtgtacttagcctggataagtctccagtatgctgaatggaaaaagccaatctcaaaaggtttcatactgtatgattccatttatataagagttttgcaatggcaaaattttaatgagggacaattttgtgtctgtaaagtgttaggcacaggcgtaggcagggagggaggctgctgtagttataaaagagcaacatgaggaatgcttgtggtgacgatactgttctatatcttgactgtggtgaggaatacatgaacctacagatgataaacttgtatagaattaaatacacacacatgcacacccacacacgcaagtcaaacgggggaaatctgaattagattaatagattgtatcaatatcaatgtcctggttgtgatattgtactatagttttgcaagatattaccattagggaaaattgggtaaaaggtaaaagggctccctctatattattacttacaactgcatatgaaatctgtaattatctcaataaaatttcaatgaaattaaaaggaacctccagagtagtgcctgaggactctcagtattagccttgacctcagaacatctctagacaaaagtgatagaatgaatattactttattaagagtttttcataatatattatcaccactcccttctcagtaatcagtagtataatattatgtttatagaaaaatatctcatggtatgtcaatgtttgttggtattaaaatcaaattaaaataattttacacgagagtgcaaatggctgacagatttaactcttatgtttttgtccccccaaaaaatcatatgttgaaacctaacccccacagtgatagtattaaaaggtgagtcttttgggaagtgattaggtcatgagagctctgccctcatgaatgggatttttgccctaataaaagaggcttgagagtctttttacctttccaccacatgagcattcatagaaggcaccttctgtgagaaatgggcaatcaccagacgctgaatctgccagcatcttgatcttggacttctcagccgccagaacagtgaggaatacatttctgttgataaattacccagtctaagtacggcattttgttataatagcctacctggactaagacgatgatgttaattcaaataaatatgactgctctgggagaaatgattttgggcaatatggctttattgctgctgtttctattctaggctgctactccctcctataagacacaagggcagaaatcagcaacttcaccctctgtttatgaagggtgctatgcagggcccaagtattattattattattattactatttttaaaattttactttactcatgtttgttctggtatgtgattcagctttttaaaaaacttttatttattttcaggggtatatgtgcaagttggttctatagaaaaattacaggtcccagggatttgctgtgcatattatttaatcacccaggtaataagcatagtacccaatagatagtttttcaatcctcaccctccttccactctctactgtcaggtaggtcccggtgtctattattcccttctttctggacagaaatgtgtactcaatgtttagctcccacttatacatgagaacattcgtgatgtttggttttctgttcctgcgttagttcacttagggtaatggcctccagctccatccatgttgctgcaaaggacatgatctcactcttttttatggctgcatagtattttgtggtgtatatgtaccatattttctttatccaggctactgttgatgggcatttaggttggtttcatgtctttgtttttgtgaatagtgctgcaatgaacatacatgtgcatatgtctttatgatagaattatgtatattcctttgagtatatatccaataatggggttgctgggttgaatggtagttctaaattctttgagaaatagccaaactgctttccacagtggctctgaactaatttacattcccaccagcagtgtataagtgttttttgatttttctgactggtgtgagatggtgtctcattgtggttttgattggcatttctctcatgattagtgacattcatcattttttcatgtgcttgttggtcatgtatttgtcttctgttgaaaagtctctgttcatgtcctctgcctacttttaatggggttgtttgctttttcttgttaatttaaatttgttatagattctggatattagacctttttcagtttgcaaatgttttctcatattctgcaggctgtctatttactctgttgatagtttcttgggctgtgaaggagctctttggtttaaattagatcccatttgtcaatttttgttttcgttgcaattgcttttggcatcttcgacacaaaattgttgccagggcctatgtccagagtgatatttcctgggttttcttcaggggtatttacagttttcggttttacgtttaagtctttaatccatttggagtttatttttgtatatggtttaaagaaatggtcctgtttcaatcttctgcatagggctggccagttatcctagcaccatttattgaataggcaatccattccccattgcttgttttgtcgactgtgtcgaaggtcatatggtagtaggtgtgtggctttatttctgggctctctattcggttccattggtctacgtgtctattttgtaacagtaccatgctgttttcgttactgtatagccttgtagtatagtttgaagtcaggtaatgtgatgcctccagctttgttcttttgcttaggattgctttggctattcaggctcttttttgattccatatgaattttagaatatttttttctaattctctgaagaatgtcattggcagtttgataagaatagcatcgagtttgtacgttgctttgggcagtatggccagtttatcaatattgactcttcctatccataagcgtggaatatatttctatttgtttgtatcatctctgatttctttgagcagtgttttgtaattctcaccatagagatctttcaactctctggttagctgtattcctaggtattttattctttttttgtggctactgtgaatgggattgcattatttatttggctctcagcattgatattgttggtgtatagaaatgctaccgaatttcatacattgattttgtatcctgaaaatttgctgaagttgtttattagatcaaggagcttttgggcagaggcaatagggttttctaggtactaggtataaaatcatatcgtctgcaaactgagatggtttgacatcttatctttctatctgcatgtcttttatttctttctcttgcccgattgctctggctaggacttccagtactgtgtcgaataggagtggtgagaatgggcatctttgtcttgttcttgtcccagttctcaaggggaatgcgtccagcttttgcttgttcagtataatattgactgtgggtttttcatagatggctcttattattttgagatatgtgccttcaatgcctagtttgttgagggcttttttttttttttttttttttttttttttgagacggagtccctctctgtcgcccaggctggagtgcagtggcgggatctcggctcactgcaagctccgcctcccgggttcgcaccattctcctgcctcagcctcccaagtagctgggactacaggtgcccgccactacgcccggctaattttttgtatttttagtggagatggggtttcaccgttttagccaggatggtctcgatctcctgacctcgtgatccgcccgcctcggcctcccaaagtgctgggattacaggcgtgagccaccgcgcccggcctgttgagggcttttaacgtgaagtgatgctgatattttttaaaagcctgtaatcgtgtggtttttggttttagttctatttatgtgataaatcacatttactgatttgcatatgttaacccaattttgcatcccagggataaagcctatttgatcatggtggattagctttttgatgtactactgaattcagtttgctagtattttgttaaggatttttgtatctgagttcatcaaggatattggcctgaagttttccttttttattgtgtgtttgccagattttggtagcagaatgatgctggcctcacagaatgagttaggcagaagaccctcctcctcagatttttagaatagttttagtaggaatggtaccatattcccagggctatataagaaacagagttgaatttggttgaatttggaaacagagattaaggaataggccaaaagtgatgaatacaggggcatgtaatatactttcaggaatccaaagtccagttcattgaaaaaaatgtatttgtaaatttccttttaaattccaaatgaaaatttgggttaactcagaagaatatatgccatctaggataacaataaatgagcctaacagtctttaactatctggtgatatgggattgcctgaatcatggtacctctaaacattgcaacccttaaaactcatgctatgtgtgaataattaatgccacaggaaatacttatgagacattaaatttaaaaaaggaattgcatttgtcattttttcatacattcataatgtaaaagtgtgtgtgtgtgtgtgtgtgtgtgtgtgtgtatgtatgtgtgcgtgtgtgtgtaaagaagaatatgattgggaggccgagagaggcggattacctgaggtcaggagttcgagaccagcctggccaacatggcgaaaccccgtctctactaaaaatacaaaaattagccaggcgtggtggcatgcctgtaatcccagctactcgggaggctgaggcaggagaattgcttgaccctgggaggcggaggttgcagtgagccgagatcatgccactgcactccagcctggccgatagaatgagactctgtctcaaaaaaaaaaaaaaaaaaaaagaataagaaaaaaagactagaaaaatgtatgtcagaattgtaacagtgctttgctttggggaatgctaggaatgtgtgtgggatttagtttctttccaatgccattgtgcatcttcagatttctttatgatttctttaccttattgttgaaataaaaaaagcaataacaatacacaattattttttaaaaggaagaagtttaagcaaagggaaaactagcatatgacaaaatagctgaaaccagaggtagagcttataagccaatatgccaaaagaccctgcacttggcctttttagtccaagtgatctatattttagctgagtttcctagaagtatatacaaggattctcagtggtgactagaatgaacagactagctgttcaggaatctaatgcctaccatagctattaatagctaccactggctgttcgtggtggctcacacctgtaatcccagtgctttgggaggctaaggcaggaggatcacctgagtccaggagtgcaagaccatcctgagccacaaaggatgtctacaaaaataaaaataaaaaatatctgggcatggcgaatcacatctatagtcccagctacttgggttggtgaggcagaggatcacttgagcccaagagttacaggttacagtgagctatgattgtgccactgcactccagcctgagctacagagtaagatcctgtgtctaaaaagaaacaaaaaagctaccactaatactgatatttaagagatttctccagtatatacccataaagatgaaaaaccacatcttttagtgagtgacatccctgtaagacacaggggcaatagcgttcacaggaattagtctcatatcattctgagacacagatcaaaagtttttcattactagcaattctagcagatataaaaccatgtgaaccaggtgtgcagcagctttccagtgttgagtgtgaaggatgggtagctctaatattccctttcctgtggcatacctctttgcagtttgactttgtagatcctcccattgagagttggagactatttcctcaccctttaaaactaggctggggttgtgagtttctttgtctggtaaaatgtggtagaagtgatggtgtgtcatatctgagcttggtcttccagtggccttttgtgtttctcttttatcctgtggacccctacgtctgtcaagagaacaagctcagattatcctgccatcctgccagaagatgaaagatcatgtggaaaagagacgagtcatcctataccatcaagctcccatttgacttgccagttgatcacagttgattatcttttttttctttttttttttttttgagactgagtcttactctattgcccagactggagtacggtggcacgatctcggctcactgcaacctctgcctcccaagttcaagcaattcttgtgcctcagcctcctgtgtagctgggattacaggcgcccgcaaccatgcccggctaatttttgtgtttttagtagagacagtgtttcaccatgttggccaggctggtcttgaactcttaacctgaagcaatccgcccacctcagcctcccaaagtgctgggattacaggtgtgagccaccgtgcctggctgcacagttgattatcttatttgcagccactgagataaaatttgactctatatccttaactaactattagaataaccacaaatatgactcttctggttaaaaaagaactgttttttttggtatttgagcccgtgaagctgcattcagctgagctgggcccagatcagcagaaccattgatatgtcccatacacacatgagcaaagatgaggctttgctgtatgctgttgagcttttgtagttgtttgttatgtggcagtgttgcggtaatagatacatgatccatctggcttcatccttgtagagaaggagattggctatctttccttcagggttccagtcctggttcttcctttaactagctatgtggctttagcaaatattttaacatcattaagtggcatatgtaaaatggaaaaaaactaatttttgtctaactcacaaaattgctaaagtgaagtgaaatatatgtaaatgtatttattatctatacatcacaaggtaaaatttgattaatctaaaactctctgctctgtaataatgtactacatttaagtttttttccaatgcatttgatctttcagctactacataaaagaaataaacaaacataaggactattctaatgccatgccagtcacagtgttaaaataacttaggcatattttgataccccttgatatgtttatgatgaatttgaaatatactagagaagaaattttgtttagttttataagtgtggcttacagaaggagactttaaataaaataaacccaaacaagttttgatttactcatggacatgttttagttcggaatgtcaagtatgaatgtccgtctccagggatatcagggtgtgaatcagatgtgcatgtttcacaatccacaggtttccatatgtttttgaaatatagaaaaaacttcactaatttaagcttatcagcattcaaagttatcttatttgcagccactgagataaaagttaactctgtatcctaactagcttactatttgaataaccacaaatattggttaaaaaagaaccaaaaatagttatcttggtttgactgtaaactgcattcttccatcttgaaaattttgaatttttctagattttcaatatgtttttggggtaataatgatatgtaatattataaaatttgaagtaataataatgaatgaatgaaattaaataaaatggactccagataccttcacctagagacttatgctgttaattaacttttagagactacaaactcaggtatcagcctgtgcatatatacacatagaaagataatgcataaataggagtgcttttagaacaactagaatataggatgcatactaatttaattaacatcttaaatttaactttacttgaaattaagcataaaaaagaagctgaatataatctaagtggctgaactctagcaacaatttcactgcagaataagttgtttctaaaagatccctctaaagttcataagaaatgattatgaagaaattgaagtttacatcattacttatgtaactaaaaattttcctttaacctctctaattttgttatgaaagacaaagaaattagattaggtgggcttcttttttactttaccatctcagcctctgaatttgttagttatattatttttatatttttgaggcttctgccctgctaggatgctttgtggcaataatttctgaaattcttcaaacttaattttatcagattttataagaaacttagcaattcaattaaaattggaaatgcaaaaagtcttcagttgcataagaaaacccattcatgatagtagaaatgtaaattgtaaccacactgagtttccatttcttacctatcagattgtcaacatttcgaaagtttggcaatacctttattattattattattattattattattattattattatactttaagttctgggatacatgtgcagaatgtgcaggtttgttacataggtatatatgtcccatggtggtttgctgcacccatcaacccgtcatctgcattaggtatttctcctaatgctatccctcccctagccccccactccccaacaggccctggtgtgtgatgttcccctccctgtgtccacgtgttctcactgttcaacccccacttatgagtgagaacatgtggtgtttggttttctgttcctgtgtaagtttgctgagaatgatggttcccagcttcatccatgtccctgcaaaggacattaactcatccttttaatgttaaggctgtggggaaacaggctttattatgcattgctgggaggagtgtagtttagtgatatctaccaaaactacatgtgcttagcttttgacccaataatttcttttctgggcatttatctttttatatatatctgcatgtgcacaaaaatgatgtgtttacaaggttagtcagctgagctgcttataacattctaacttacaaagaacctaagtgtccatcagtaagggactggttaaataaattatggaacattcatacagtgaaatatttttcagctaatggggagcagaaggaaaaggtagagaagggaaaaagaagagatctctgtattgatttaggaagatttctaaggtatgttgatcggtaaaatgttcatgtccagaaagtgtgtgtaaagagataagattatatttgtttgtgtatatatacatatatttatttattacttattttatatatataaacactttatatataaacactttaaggaaaatgtttaccttgtgtgagaggggacaggagaggaagggcactgggagactggtaactctgtctctttaatttgtttttatttatttatcactaataattacttattacaaaaaagaatgttaaagcattaagtggattcattctgaacagcagtgctttgtctcagactcctcattcatgacttctttaatttgattgactttttggttagctagattttgccgtctagttaattttaaaggaaatgaatgaatgttctgtttcctaaattgctgcatgaatgaggatatctatcaaaattgtgtgtatcaattctcccttgaaaacctttaaaatcttttggtctcacttgttttctacctcaaaacgttgttagtagtattccagtgtcctctggaatgagattgtggcactttcaaaaagtagagtttttcaccctatacttcgcttttgtttcagtgaattttttttgaggtggaaaaggagctcactaaaatggtttatactttctgattttatcccaaagtttggatttctttttgggttatcttttaatgttgcattattttgtggattttagctttctaactttctgttatggaatatactcagggaagtgttttacatctggagagatataattcaaaattttctctatgtgattatttatacatttttcctgagtgtgtgaaataaatttaagaataatctgaagttttgtgtttgttttagttgcatataccttgaaattgatgttaattgatgttgtctttacttttactatattgtttaggttatgaattgtgtgagtattctctaatggagaagtaggctgtttcatgtctttattctatattgactgtgacataagccttgtagagaaagtttttctatgtgcagaatgtacaaaatgtcttgcaaatctctgtgagtttgcccccgtgatgcttgtttcagcatcatgactgaaacaataaaaggaggaacatcatctagtttctctatttgcctgtgataagtccagattctctgagaagcagacatcatcatgggattaaatgtgcaaaaaccttattagagagaaaacctgtgcgagtgaaaaaagggaggcagctgggggcagctgacagagccctcagactgtgatgcacatttgaccctgagtgaaggagagagggagacaaggttggttggaagtgtcctggactggcatgaagtttcaggaaacctgaaggagcatcaaagttcacagttagaggagtcccatatctcctaggaacaggcatgccttaatctctctgttggcagtagtcattgctgggagtgctagatggccccagcctaaatggggtgatggctttcagaactaagcaggctgagcaccttggtcagcagagatccctatagggattcttaccagtacatctttctaaagcttatatgggactcttcttactttacatttgttcttggatgacctcatccactactatgaggtgaattatcacctagtctcagtctgtagtcctgatcactatctttacctggcatgccaagcctattttccaattgccttctgtgtactttgctgccctgcaaaccctcagactcaacaccccatgatgaacttatgatccttcacctcccccagtcccaccctttattcctgtattagtttaccatgtctcctttcttcccctttcccatattgaaaactaggagtcacctgtagctcttcctctccttcacatcaaatatccaaccagccaccatgtcctttgcatgtatctaaagttctaaactctggtgcctcctcccatttctgttatgacagttctaatttggttcatagattcttctttagaatcacatactttaagatggagtttgccactataggtccatcgtctattttttaacagtagtgactggcaggtatctctccacttcctagagttttccttgctgatctcatcctcagccattcttctgcacttagacttgtagaaaaggtccagatctgcaatgtggatgctgttggagtgctggcattttttccttctgcttctcacacggatattatgaatgataaatttttatgatggatgagttcctgacaccagagccagcaattcctactccccatatagtaatacagaaagcatgaaaagtagataactgaatctatgagtgcataggaccactacatatttggtggtggtggtggtggtggtgttatgtgtgactgtgtacatatatgtatgttaaaactagatatgataaaaccttaccactttattgctgtatgaatcagttatttgtgtaaccaacaaccacagaatctctgtggcatgtaacagtggttgttatctctagctctctcatgcgtggcttggctgaggtttggctgatttaggctgggctcacataagcttcacgtcaagctttgtcttaggcattttctgttccaggctcaggatgtgtatgaggctctggtcttcccaacatgtgtttgttgtggggcccaggtttaagagccagcagccatgtgaagaagcttcttttcatagatggcaaaatacaagaaagcaagaccaatggcacaagtacatttgaaatctttccttgtgtactgtccactaacattcctttggccaaagcaagttacatggccaagcccaacatcaaatggtctagtgggaggggctacaaaggaagtagacacagggaaggatgaagtactgggaacaataatgcagttgaacacaattatgatgattgctttccataagaagaaaataaatagaaaaaaaattggggttggttacgtgcaaatgcctttcctgctttatgtttaagtctaattagcagaggagatgcattttcctataaaaattagaaactaaaagaggagcaatgtggattgctagacagaagtatgtttatgacattattatgtgctaattctttcttaagagtggccatcaatttataaacttccacagttcttttggaaacttcctgggaattgtctattttcgtccatgtttgtaatctctgagccatataaagagtgaagtgtattgcgacgttttcactttcaaaactattcttagccaattttgttagggtcttataaaatgtgctaaagagtcaaacgttaacatatcagctttgaatatatcaggatatagaatgtcagaagttaaacttagaattcttacagtattgtgtagcagactgctaaaattagtatatgattgatgacattgtgatttgataggtaattcaaatattttgtaagtgtttcagaggaaaatattgctataaagcaactgatttagaaattgaaatgagaaatgtcccaagaggtgaatagttgtaatatttattcaaaagtaatgttgcctatcctgctcctgataaccactatttcattctctatctctgtacatttgactgtttccttctaggattccgcatataagtgaatcatgcaatcttttttttctgtgtctgtgccagacacagaaaattatgcttatttcacttagcataatggcttccaagtattgtgttcgagatttttgctaagtgaatagctatagctgcttttgccattggagagttgggggatgggtaactatgtgagatagtggatatgataatttgtttgactatagtaactattttaatatatatatatatataaaacataatatcatgttatataccttaaatgtgcacaataaaatgtattttaaaatatggcctaaatgaacatgatgtagggtttcctttattagtattaggaaggattttaattgtgcatgtagatataagacatttccatatgaaatttatataataacaaagatattacacaaggaaaatgggtctctttcacttctacacctgaaatgtaggcggcgacacttttatctagtcatagaaaacacaatgaacttgtggttgaatgtactcaaattttctatcaaattacaaaatttgtcaaaactgtaacacatttatcatccaaattgtcttaagaaacgtgcatatgacaatgtctttaattttcagtcacccaaattttcaacagttgtattattcacagtgagattcatccaacaaatgtatatccatttcaacttggacaattttaagaactgacaactttccatgtatgatatttgtcattctcagaatcccttagaaacctcaacacttaaccatttaccatgtttcaagggaatgtttttccaggaaaaaaaatgcacaagtgtgaaaaagcaggagaaagagaagtgcagttttaatagaatgtccaagatttaaggttatgatatgaaaactaggtagcatgttcttagcaagtcttgaattaatggcaaacttatgacttcattgattttctttaccccatcccctgacatataaatatatgagaaatatagcttccataccaacacctaaagacagatttcttattcaatttctttgagaaactaaattcaatggcagatgacagcaataccagtgtactgcagaagtatgctctgcattcctgtgttttgttcatggtatacattcctaatgccctttttgtgaaacctggttaataattaagcaagtcaggatgtacgaaccacctgaaattctcggataagtagtttcttaatatctctttttgtacttgctattgaaagtatttagagttatttttgcttgattatttacaattttacactttctttataaactaatttttcctaaataccctagtgtgattttaaagtttgaaatgccttaacattctccatcagggacaagttatgttttgtagttagcggcttgatacccacatgtagctctgtgtttatgatggcagagcaaagtgaagattgcagacaattatcttgatggtcaggcctccaggtcagctggctgctgtgtttacagataaagtgagctggacattgggaagtccactggcaacttctgaaatacataatggtctaaattgccttctattctcagggcccaagccacttgctagtgtaagttggctatttaagggcgagcattaactctcgtgggtcaccagggaaccatttaataagtaactagaggcctggagatgttcacgtattcctctaaatgccctggttttgttactggtgcagttcactcaaggtcattctgcagcttcaaatatttaatgtcctttctcaagtgaatgaccgggtccggtggagaagctggctgatttgttatttgtagtcagccagtacatagtaagctaatcaagttcataataattatattctggcaagaaaaagctgattaacagatgtagtaggagtttagagaggctgaaataaatccgagttatgataaaacaacctcattagagaagagtatatacatgcataaggattttgagctgaatacctttatggtttttttgtaacttttacttttgacataatttcttattttttattttttattttttaatttttatgggtacatagtaggtttatatatttatggggtacatgacatgttttgatacgggcatacaatgcgtaatgatcacatcatggagaactgggtattcatcctctgaagcatttatcctttgtagtgatataatttcaaacttacaaacaatttgtaagatcaagacaatgaacaactatacatccttcacacaaattcactgattgtttctcatttttttccatctgctacctcattatatctaccaagatatcaatccacttaatttttttttcctgaaccatttcacggtaagttgcagacaggatagcccttcaccttaaataattcagtgcatatactccaagaacaagaacattttttacgtgaccacagtgcataattatcaaaatcataatggtgcatactactatccagttgtggtgtatgattttaatatgttatatagagagaaacaaaaatgaaaatgaatgactactattccaaaatgcgaacgtgtgagttgcattgggacagattagtatgctctgtaaaggggaaattaagctgacttaattatttaagtcatgtattaagctaaatttcaattatgaaattactggatgatccaaatacatattagatgagggtcagtcacttattcaataactcatttgcctattttagtcaatgctcaggtgtcttgtttttcctaatgacttccaaaggtgatgattactggcacttactcaagcctaactttcacataccacttgtaaagcaggtttgaataaaagatgcaaggaaggttgacttcaatattcagccataactggacctcttggtgtgttggatttctggttttcagtatataattcagtataaatatagttaggatacaataaaaggctgatcaaatatgtctaaaggagagagtcagtatagtaacataagtaatatagacaaggcatactatttgaattttggattttaaaaaatgtcatccttttattcagactttctaatggtgcactattgcagtgataattagcaaggttaaaagcctcttcctgaagactttagggagatgcttgccattagaataatctgtttatacctatctcatgtttgtttttacagcctgtgtttcaaagaatagtattaagtctgatggattttcttgcccgagaagctaatttaaaaaaatcgtattcactaggtgaactgcagactgctaaaaggtgggactaagatgaacactaaagaacaacataaaggacagatatcactcacctgtgaggatttggttagcgatgtgggaggagagccttcctgagtatcttaacatcagtgcttctctgaaggcattggtagattttttttttttttaagaatgcaacatcatctgcaacctgaagtcagttctggaggcaggatgtacctcatccctaagccagttatggaggcaagactgtactcatatcactgtactcacatcatttacaaggagtaaatgctacataagtggcaccagtgtaagtatctaaggattcaggggatggggagatatcttagagacaaatagagcagacttaaggaattggataggtagaaaggagggaagagaataagaaatgatgtaaataaaaatatataactgcagagaagcagataactgttgaggagtggccaaatatggaggggggctaatgtgtgtgtcagggatttccagtttccagttctcatgaaacaggatgggggctaaaggagtggtctctaccatccagttagtagaacaggatgtacataatgagtggatacctttcaaatattcaattacattcaaaattttgctaaaacatttgttcatgcacatcttgccatagtgaagtccagcccaggaatttctgcctttgcatatgaaatgggatataaccagagactgacaaagaacattcaggataaagagaactattaacttgacacgtattttgtaggagatgctgtgggaaaataggcacattcacatattgctggtgggagtgtaaatcattacactacctataggagggcaacttgatgataactatcaaaattacaaatatgccctttgccctgaaagtccagcttctgtaatgtatcttacggaattacttctgtacgatgcataaaaagcagaatattaaatcccaaaccaaatatttgaaaatggaaactggtcaaataaaccctgccagccatagaatactatgcagctgtaaaagaaaaaatttttaaaaaaaaaggagaagaaaaagaggaggaggagaaagatgtgctctatgggttgatttggaaatatcccctagaaagaaggcaagaataatcacatttgcatatatttgcataaaggaactagaaggagatataaaaaacagaataaaagtgttttgtagtgggtggaaactggtagatggagacaagggtgggtgtgaaagtcttcactctgtaaaactttttatacttcataatttctgagctgtttctgtactagttaatggaaaaaatgaaaagagaactattgtgttcttataagaatggcaaggactgctaattttctaccctaacatttattctcccaattgttttttattttaaaccagaacattgccctgtagacttaatgtttccagcttctcttgcagctaggtgtggttgaggtcaatgaggtatagtaaatgctgtgtggtatatcttggtactttttaaatggatctgttaagctatgagggtctttctgccttgctttcttctttccaatatagatgtgatgttcagaagctcagcagacatcttggcaatgaggggaccttgatattggaaaccatgtgctaagaggacagagaaagacagacccatgagtcccgggtgatactatggtgccaacatactggctgcttcttggtttctcttatatccaagaaagaaagctctaccctgtgtacatcacacttattttgatctttatggtgttgattaggcattggagtctaatccagtatttgccccaaatgtagaatactgtttttctttaagatcttttctttgcaaactttgcttgggccctctaagcttgtgactttacttcaaatccagttccactttgggttgatataattatggcatgtgaaaagtgtttctggagaatcatgagatgtgactattatctggtaaagtgtgttgcagtccaaagtgccaatggtggaaaaactcccgtaagtgcaccctgtcatttttctttttaatttaggtgtacagctgaatttttaatatttcatatgcagttaaattaaccatacttcttgtgtcaaaataaatatgcagaatctcaatcatggacttaaagatgcagaaacacattgattttaggaaaagtacatgtctcttttattaccacacatataattctggtaaaaattatgatgaataatagagaaaaaatatggaaacatggatgaaatttgttttatagatttgcaggatgcttgctaacatggtggtagggagggctgatgtattttcagtctgacatctgttaatgtgactataataaataaactgtatttactaagtaaacattcaacttttctctcaaaaagatttggtagtaaaagaatatgtcattgtctcattgctggaagcctcatactttttcatattggatggggaagggaattccattagtggtagcacaagtccatctgtcttacattagacatttgtctaaaccaactttgctcactgaaaagcagtgtaataacaccactgaagagagttcttaatagactgaggaagcaaacaaattcaactggtgtttcataatatctaaatttttagacctgagatcatttctttggattcccttctacagattttaatttgcatgcctgatttagcagcctctttccctgctttaagtagaaagtagaaataatattttaaaactaatttttacatctttttttgcattatggagatgggctttcctgtgtgctattagtagaaaatcttttaggaaaataaggaagaaaccatgcagagggacataatttttcaaaaaaggctcagaagatatagcagtttgtctttatgtttttcaagttaagattctcctatagatatattaaacctaatccccaatgagagggtatttggatttggggccactgaggggtgattagggcatgggggcagagccctcataaatgggattagtgcccttggaaaataggcccaagagaactcccttgcccatcagccaggtgaagacacagcaaaaagatggctttctatgaaccagaaaatggccctcatgtagtgtgtctgcatcctcttcatccaacttcccctaacatcttacatgaccatagtccaatttttaaaagcagaaaattaacattggtacaatactgttaagtaaacgagagacctaattcaaacattacccatttggcaactgatggattttttattctagaatcaactcaattttcccacagtgaatttaattgttgtgacgttatttagtcttctgaaatctgtgacagttccttagtctttccttgtctttcacatccttggcacttttaaaaagtattggtcagttactttatgcaatgtctctcagtcttgatttgtatgatgttttctcatgattatattgaggttctgcatttgtattagtcgattctcacactggtgtgaagaaatacctgagactgggtaatttataaagaaaagaggtttaattggctcacagttctgcttggctggggaggcctctggaaacttacaatcatggtgcaaggtacctcttcacagggtggcaggagcgagaatgagagcagagtgaagtggggaaaatctccttttaaaactacaaaatctcatgagaactcactatcaaaagaacagcatgggggaacccgccccatcattcaattgtctccacctggcccctcccttgacacatggggattatgacaactcaaggtgagatctggatggggacacagaaccaaaccatatcagcattcttggcaaaaataccacagaagtgatgctgtgcctttcccagcacattctatcagacagaaaatgatattttgaaataccatttggcagttggctctttgaccaatttgcctctaattcaaactctgtatcattattgagcaagcatttagtagcttgaaattgtagctgcatattctccattttgctcacaagtgtatcacatttagaaagaaagatgggattacttttatcaactaatctggtgtttttttctacctctgtagaaatggaaaataaaagctcaacatctgattattgtaggtgttcttactagctgggttaggaaaagggataaagatacatgtgctgcagtgcgtttatagaggcaggtgatggtcaagtattctttgatggtcaagtactccttctgtctaacagcctcaaacaagctccttttctttatatatatatataaaatatatatatttttaattatactttaagttctagggtacatgtgcacaacgtgcaggtttgttacatacgtatacatgtgccatgttggtgtgctgcacccattaacttttcatttacattaggtatatctcctaatgctatccctaccccctcccccaaccccacaacaggccccagtgtgtgatgtcccccttcctgtgtccaagtgttctcattgttcaattcccacctgtgagtgagaacatgcggtgtttggttttttgtccttgagatagtttgctgagaatgatggtttccagcttcatccatgtccctacaaaggacatgaactcatcattttttacggctgcatagtattctatggtgtatatgtgccacattttcttaatcctgtctatcattgttggacatttgggttggttccaagtctttgctattgtgagtagtgccgcaataaacataagtgtacatgtgtctttatagcagcatgatttatattcctttgggtatatacccagtaatgggatggctgggtcaaatggtatttctagttctagatccctgaggaatcgccacactgtcttccacaatgtttgaaccagtcccaccaacagtgtaaaagtgttcctatttctccatatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaggtgtctgttcatatcctttgcccacttgttgatggggttgttttttttcttgtaaatttgtttgagttcattgtagattctggatattagccctttgtcagatgagtagattgcaaaaattttctgccattctgtaggttgcctgttcactctgatagtagtttcttttgctgtgcagaaactctttagtttcattagatcccatttgtcaattttggcttttgttgccattgcttttggtgttttagacatgaagttcttgcccatgcctatgtcctgcatggtattgcctaggttttcttctagggtttttatggttttaggtctaacatttaaatctttaatccatcttgaattaatttttgtttaaggtgtaaggaagggatccagtttcagctttctacatatgcctagccagttttcccagcactatttgttaaatagggaatcttttccccatttcttgtttttgtcaggtttgtcaaagatcagatagttatagatgtgtagtattatttctgagggctctgttctgttccattggtctatatctctattttggtaagagtaccatgctgttttggttactgtagccttgtagtatagtttgaagtcaggtagtgtgatgcctccagctttgttcttttggcttaagattgacttgacaatgcgggctcttttttcgttccatatgaactttaaagtagttttttccaattctgtgaagaaagtcattggtagcttgatggggatggcattgaatctataaattaccttgggcagtatggccattttcacaatattgattcttcctatccatgagcgtggaatgttcttccatttgtttgtgtcctcttttatttcgctgagcagtggtttgtagttctccttgaagaagtccttcacatcccttgtaagttggattcctagctattttctgtagaacctcttctccattcaaggttgcagaagtctgtgacaaccaaggaaaagagacagcaatggggctctcttacctgtgcctaggaagaatcttacctagtatcttcttctgctaggaagagagaacagatgtataggatgaagtatctcaccttttgggatctttttttaaaataatctcagaccatgtaaactccagccatcaagggaaatgtgctgattcccacagaccgtatttcttttcttttttttatattgcctcagaaagagaatgcatggaactgctgctgcttcaaactagatatctgacactagtgctaatggctggtttctcagctaatccacctgtccttcacttctgaagaactgaatgatagtctttgtatttccaactacaattacaaattacatgaagcaagaacaaatttttagttttatgattatgtggtaagcatttcaataaagctccacaaatgatggaaagtgtgaaggagagaaagagggagagagagaaagacacacacacagacagacagacagacacacacacacacacacacggacccattacccattatctggacagaaacatcttaatttgcgggaacattaaaaattttttttctatgtggctatacataattatttataaatctacaattttatttaccaaaagtgtgtgtgtgtgtatagtgtatacttgcttttaataatagatatattttccttgacaatgaacattgagcaaatattatcatttttaaaggctggacagtagccccttctgtggatgatctgtacctgatttaaaaggtctcacattgatggaaatttcgccattgtcggcagcgctgtagtggacatccttgcatgttgattgtgcattctactcagatgtttccctttgggtaaaagcctagaattggaattattaagtcaagtatataaaaaattgagtcttattgcatatagttaaattgtctctcagaataaaactgctccaatttcaacttccaccatgaatgtatgaatgtgcctattgccatgaatgtttgccgaaataaatctttggcaatatcaaaatatatccatgtagcctctattttatttctttattttgaagttgagcctccttgcctaagttatttttcctattatttcaaccttatttggtgatttgttgcttatattttaattagtttgtatgtgagattcttaatgattttatatattaaggatcttaatgatttttcagtaactgcaaataatttttctagtttataacttatcttttaactttatttgcttaaaatattacttctgaaataattaaaaataaactacataatgaagatctttgtacgtactaatatttaatatgtgataatgcaacaagtatttgtgaatattgtaataggtaatatcttaagcatttacaaatgttaacttattttatcctcataaaattatttaaggtgtatcctgatactaagtcgattctacagtgagcatacttaggcacagagaggttgaatatactgcctaagtttacataggaccaagtggagaaactgaattcaaagccaggcaattacctttagagttcttgttcttgccactgcattttataattggttaaaaaaatatttatttattccggatattaattcattgtcactcatttgcattactaatatcttctccctcttggaagtctctcttttaattttgtttatgctatattttgatatacacaagtatgtcatagccattatatgattataataatgtgatcagccttatcaatatttttcttcctgggtattgtttttgcagcatactagaaaatccattgttactcttatgccatgaaataggccttaatattttcttccaaaaatcttgaattttcatttttaacattcagagctttaatctacctggagtcaatttctatgtttggtatgataggaactgaattatacctcttttgttatagaaaatgtgtaccatcagcaatatttatcaatgtaactaactttattaagtccttgaacttcccattttatttctatgtgctttcaaaattttattattacagagaatgaaattgttttattgcctttcaaaattggttattcttgtgtataggaatgctattggagcttagaatattgatctagtaacccagtaaccttgcttaacaatcttttgaattttaatagtttttttctgaagatcctcttggattttctatgtagaaaattcataatctatacatcaccacacacttttccaactgttttaccattttatatttttctcatctccttgaattatcttgggcctctgataaaatactgaataaaagcagtatttatctggatccgtgtattttctctgatcttacagggaaggcttcttgtgttttaatattaagcataatatcagctttagatttgtagaagatatttcttaacagattaagatctgttcccttttatgtctgattcgctgaaggatttagaaaaattatacataggctaagttttgtcaaatgacttctctgcatataataaaataagcttttctcctctgctgcaaacttcttgctaatattttattttgcatctatatttgtaaggcaggcccacctaggattattatttctcagacttttcttgttcaatatcaagataataccacttcatagaataagttagaataattgtcttatttatttgggtttctttagttagttatttaagctttgttatgttcccagttcttctcagccatttactactagtttctgtcttgtgtgttttatttattaaaaaaggacccccctccagcaatagtataaaaataatcacctctgtttttcttatattttgaaatattgtgggtttttttaacctttaaatcttaaatagataacttagaattggcctctccatgtatgtaatcaaaatagggttatacaattcttattttaaagccagaggaaaaaaatccaaaaatttttttagcaaaaacttcaaatggattcttcatgatgacagctggggtgcccaagagaactgctattggtttcaggtttaaaataaacctgaatctctacgtaattcaacattatgatttggtacttaatgcaaaagtaagccttcaactcaacatataactggagaagaaaaatttaattccagaagctttccatctcatataggttattactctgccagagtaaggatttactttctcaagcagttggaattcccaagcatactgaagcaagttatagatagcctgaaaagcaatgtgaaaagcaatgcttcatctctgaagcaaaatttcctttcagctttacaatcaatgatgctatcagtgacatggtttttaaattctcgttgagaaaatttaaaggaaaatgttaactttttaaatgagcagacatgaagaacacagtttacctacaacatgaatgaagaagtatagagttattgcctgtgttgggttttgtagatccttcttgattcctgcttatatttaatagagatgtcagaatgaaaatgtccaacatggttaatattaatcttattcctcagccagtatattcaggaaggcagtatagttattttataatgttgttcttttgtttgtgtattttgttgttgttgttttgagacagtgtctcactctgtcgcccagactggagggcagtggtgcatctctgctcattgcaaactccgcctcctgggttcatgcaattctcatgcctcagccttgtgtggtagctggaattacaggcatgcgcaccatgcccagctaatttttgtaattttagtagtgatggggtttcccatgttggctaggctggtctccagctcctggcttcaagtgatccgcttacctccgcctcccaaagtgctggattacaggcgtcagccactgcgcacagcctataatgttttttttacagcatttatttcttggcttactttttattcctgttaatgttgatattgtaccatttggaaattcagctattttatgtgtacacacatatgtgggcactttctacttagtctgtttctacagtgatatctatctttctgtggatatttatgacagataggcagacattcaaatgcagaatacatcaaggtatttgttggactagataatatcaatatcacatggaataggtttgcttgcttgtttatttaattcaatcgcatatgttgagagtacagtgtgtgccaggcaatgcattgtgttctgggatcccacacagggataaagacctcataatggtgggaggtagatggtttgcctgcaataatcacatcagacaatatgttgactgatagtccagtgtcatcaacaatgtgtcgagggagcacagggatggaaataatttgttttgcagggacttgagggtgaatgtgggagcagagatgaggaagaacacgcagagaaagtagaatttggtctaggccttgaagagagttgtatttcatatgagggggagcgagtcaaaacactgaatcaccagggtactttgcttctttagtgaatgggaaatattatagtgcacgtggcaagtagtgagtagtgattacggagcaggaaagtttaagctggaagagctcagtcattctgggttgtatgcacacacacgcgcacacacacacacacacgtacacacacagaggcagtggcatggaggatcatttggaagctggagaaagtaaaaatcactagagttgaggatacagatgagaatctgagcaatgggagtagtctgaacaataggaacgtgggaccgacataagaaagggatggaattgatgacaaatttaatgtgggaaataaggaagaggaagaagcaaagatgatatggaagggtctagcttgtgtgaccagatggaaagtgactcattaatggaagagtattaggatggagaaattgttttatttttaaaataatttccagtgtagtgatgaaaagaaaaagttactgaattttattttgaacatactgagtttgaggagcctgcttaactatttaggtggaaatgtcactttacctaaggaaaatgagtttgggctctgaaaagagagaagtacatgtcaccaggccgggggtggggtgggggatgattgaagccaagggaggagatgtgcttgttcagggagagatgcacagacaaatcaggttcctgaaaaacagaaacatttaatgcatgatgggagggatctattgtcttgctgaagaatgataagtgagatgcagggagaaaacttggaggacactttattgaaaattaaaggacaaatgtttctggagggaagaggcaacaaaataatagatggagattttttaatacgtgccttagtgttcttgcccttgaattggtacaaccctgaagcacattgcatacagtcttccagaatcccctgcaggattcagccccagttgcccatagtgaaggacttgtactttataacacctttcattgccttccatcccttctctgtctcacttctcaacttccctcttggtgccttctggggtcacctcaggataacctacttgcaaccaaatccttgcatcaggatctacttctgggagacaaaatacctaagacaaaatagaattttggtttctttcttcctaagaatggactggaatgggttagaaggaagatgaactgtggaaagagagagctaagaatgacagggtggggaaataattgaatacgtagtccggtgtcatgagcaatgtgtcaagggagcagagggatggaaataatttgttaaattattaacaactaaataattggagttggaggattaggggcttttcctctctggagaaacacaggaaaagattggagtgaaggcacataatgttagtggtgtgatcattcttgatcattcatcctgtcatttctcatagaaggagacagaattgtttactgaactcaggcatcttcataagcaccctaggtgatatagtttggatgtttgtcctgggctccaatctcgggttgaattgtaatccccagtgctggagatggggcctggtggaaagtgtttggctcatgggggcagatccctcatggcttggtgttgtctttgtggcacctccttccacccaaccttgctcccaccatgtgagatgctggcttccccttttgctttccaccatgattgaaagctccctgaggcttccccagaagccaagcagatgctggcacatgcttcgggtacggcctgcagaaccgtgagccaattaagcctcttttctttataaaatacccagtctcaggtatttctttatagcaatgcaagaacagcctaatacactgggatagtccattcattctaagtctgttgttattcaacaaatatttataaatcatatcctatgtgtcacacctatgattttctgccttaaataatagggttccctttcatcattttttttccttgccacttatttgacaatactggttgcttctgctttctgacattgaattcagttaatcttattctgcttttgccatctgtgataataagttattatcctagaaatatgttttgaatttaaactgaatatccatcttgaagttgccttaaattctttatgataaaatccatttagcataataatccgaaaagacagagtgaaaaaaacattatttaaaatagttgatttaatgttgttatgaaatataacaggactcttgaaaaggtgattaatattcttacacatgttgaaacagaacaatatgagttttttcttatctacttttcttatctggtcttctctggcttctaactttattagcattcgtatattttattaattaaaagtcttcttgatatacattctgtgaaatacttatacaaaaacaaatatcaaacctgaaattcttcaagcttctcgatccagctactgatttattgaaaacactgagaagagaaatgtatgattaaatgatgtaggatgaaatttgtccatactatactataggaagtaggaaaatcttcaggacaatcaatctggtttagtcaacaaataaattccaagaaaaaaataagacagaaggggaaacaatagtttagaacacatacagctcatcttaaacaattccaatgtatggctttcatttagattgggatttttaaaattatggcacttgtgagataatttgaatattgagtatttgatgatatttaggaattactattaatttgctttaggtattttagttatttgcaaaagagggaaactacaccgttagagatacattctgaattatttacaggtataattatatgatatctgggactggattaaagtagaataggggcatgggagaaggggttggggttggataggatgaccacgaatgaatggtttttgaggctggtttatggctttgagtgtgcattatactattaagtttacttttgtgtatattcaaaattatccatgataaaaatggaaaaaattaaattaatatataggtagatcatcctcagtgtatgaataaattatagtttattttttccaataaaaactttgttatgtaatagcatggtttcttaaattcacctgttcgatagaaataaggttaaacaagttcaagaatcaactaacatcctcctacagtaagcttcattgcaaatccagttttgacctttgctcaaagaagagaatgagaaaataacacatttgtgtgtgctcttttcctgacctatgacttgtatagatgttagcacagtggctttggttttaaggtaaacattctttcagcatttctcatccttctcccattttcctgcatttctcatccttctcccaccttcttggtattttaatcatttatgtattgtgaacattttagataagatgtaaaagtcttatatagtgcccctcagttaaatttgcttagtttcagagctgtgggattcaataaaatgagacaggaattatgggtaacctcataaaggagtatgaaggcattgttatcgttgctacctttttgaaggaaatatgccctcactctgacttggaaattaatagtctttcatataataatttgataaatttagtaaaattcatttttggacctgcatctagatttgcttctgccacaactaatgtgaaatataaaataaatacttactatattttagctaacatactttttcattatttttattcctaagaatggtaaatactaagaattatctaaattgctgtgctgaatcatataaatgtatcccaagaaaatatttcaaaaaaagaaaacatgcacaaagatagtcattataaaggataacaaagtcagcagaaaaaaaaaagattgtcattatagtattttcaggactaaaacaattagacatgaatcaaatgataaaaagtttcaaaaagtaaatacataaatcatgatatttcagcaacaggaattattgaagtaccatgagaaataaatttttaaaatgcaacaatatggaaatattgagatgtaaaattagggaaaaatacaaggagaataaaaattgtgccttcactctgatataaatatgtaaaatatgttagtttatagacaaaagactgtaagaggatgttcaaaaatgaagccagatgttgcattatagtgttggtattaaggatgagttatttttcctttaaattctcttctgctgttatatgatatttataaaattttaaaagtgcagaaaacaaaaaaaattctgccatgaaaaactctaattatattgaaaataccatcctacagggaagaaagtgcaagattacttttaagttagctctaataaatacagtgaatgatttgcaatgaactgccacatattttaaagtctagtttatattatacggaacaatgcagagaatctcctctctgtccttcttaaacagaaaggaaaagtgctgttataaatcttacacccttaaagaagcatggcatcactatgaagataagcttcacctaatgtccagtacagtgctggacccaggtgggtacttaccaaacactgtggaaagtctgaagggatgctggtgagtgcctcccagaggtggtattttcttttccattgccccattttgttcctctataatattattttgcttttttaatttttttaagacacgagatcttggtctgtcacccaggctggtgtgaagtggcatgatcacaggtcactgcagcctcaaactcttgggttcaaggaattctcccacctcagactcctgagtagctgaaactagagtcatgcaccacaacgcccaactaattttttaatatttagtagagacaaggtctcactctgttgtccaggctgatctcaaatttctgggctcaagtgatcatcccatctgggccacccaaagcactgggattacaggcatgagccacctgcctggctaagttcttgtttcaataactgcctcctttctcctcctgcagcttttaaattgtagataaatattttcaggtgctaacctagagtcttactcttccatgttcatatggggtatctgcatgctgggggaaggaagaggttgaggagggaattggccttttgctgggggtttagtgcactggaaggcatttttagaacatctggagatttgcttccttttgtcagaatcccaaagactagacagatatttgaaccacaccgtagataactgttttgattttttctttttctctttttttcagagacatcataggtcctattctggggccccagtgaattgttccatagactttaagaaattcttgggctgttggatgggaaggcaaaaccatgtaactggatggagtgattcttaacttatttcttttcactctacagttaagctaaaattagaaactctgaaaagctggctgcttttaaaaggagataatggacacaacctttgagaagggctggtgatggaaggggaagggaggaggcggtcattttcccatacatcaataaaccatagacatgcttggttcattccaccactaggttattgctgctgggaagcaaatattatcctgtctcttgtttatggagtaggtttttttttcaaattaattaaagggtttatcatctcactaaacacacagatgtcttaataaaatgtagagctatgtttagtatcatggcatctgtttcctagatgtcatgtggagtgctcttggaatataaaaatatggtccctgccccaaggagtttgtatatgctttttggtgcacatacacaaacataagaaaatgggcaagtcaaattatagatgaggatgatagtgattttttttcacatttcatgagattattgaatataatttcataaaaatgagaataccctttcagataaaagtgtgcaaaatattttatttatgaatgtaaatttttccatccaaagccactgatcaattagttaagtaaaatagaaagcggaagaaatttttgttctgaatgatattaaaatttttctcagtttttgtcttggctctcttaaaagtaaagattataatcagatagtcaagatggtattaatgtgtttgtttctaaaaatgctttgcaggcagttatctttgaagaggatgattaatagtggtagagataacattaaagaaaaactggttctatggattgtacagatggtcttcaaggggtggccgtcctgaccacaggaactctggctgctattttaattaaacttgagggcagaagaaaagaaactgttttttgttttttttttctaagtaagtaagtattgaggttacacaatgtgtttaacctcggggtttgtcaacaattgtagaaaaactgaacagtttacaagaacaagccagtttgcagtttttcagttcagtaaccaaatgactttcctattgtaagtgaaagtgggaaacagcttttcttagcaaatgtagactttgttcttagaggagttagttattgtcttcaaacaattggtattgtaaaatgtgacttaggaacagaaaagaagtgtgtaatcttatggtaattttattgtgatgtgttacattgttttaaaatgttattttatttccttaaacttatttgtttttctttttttaaattataaaagtagtacttgctggttgaaaatattagatgattttcaattccggcatcataatttctgttgggaaagaagaactaaataatacagaagtatgtgaaacaaaaaggagtttctctcttcattccctgatccacccagtggtcatgcttgtgatcaatttgatatgtcactatatagaacattttattctaagtagaggcaaacatactgacatagaaaatcatcatatataacatgcacaagtgttcatcccagccctgtcctatttaagtgcttttatacactttagccacttcaattttactcactctgttacccatgctagagtgcagtggagcgatcctagctctatataacattgaactgctgggcacaagtgatcctcccaccttagctttccaagcagctaaggccacaggcttgtgccactacacctggctgatttttaactattttgtagagatggggtattattatgttgtccgggcttgtcttgcactcctggcctgagccaccgagcccaactttataaatatttttaatgtgaaaagtgtaactttactggaaatatatctcttaataagataaatgagaccatcttttcaaaaaattatttcatgtgtctggggtgaaaattattattactaaaatgaaataagcattaatatcaatagtatttctctttttctttttcataaatgtacatgctgaaaataatgctcacataaataaatgggtggtaatggaagtctgttttatagtcatgcctctccaatctttgaactcctaagttatatgccaaaaaacatcatcagtgctttgtcaccaaaagccattttattaatctgttgatggaagacttaagtaggcttacctttaaattcattaaatctgagaaattggaaacaacctgacttgtaggaggatttatttaccagcattggagtcttttactttctcaatttggggcaagggatcaaaggatcattctctgtatcagttactttttcacatagcagaatcatgtaaaacttagaaaggttcagaatattggtaatttcagtacacttttgctcatgtaattttttttaaggaaagcttttatctgaagtttatgggtattcaatccttggagttgtagttttaattcattcaattcaattcatgggaaatgttatttacatataatctaattggagaactcagccctcaatgtcagacaaactctgatttcatttcttagttcaagtgaacatgttaatatgtactgcaatgatcttcatttcatttctgaaattttgaattgagatagaagaggcacaaggcttggtgatgtgacactctgctgctgtcaaggtgtcttccaactcattcccatttgtcctcctgggactatccctcaggatggatgcatgcattctcaatagcagggataaagaggcaagattatttaatgaaaactgttagctctaccactgcctcactctataacctgtctgcactctgagcgtgtgtatgatgcagggaaaaccaaagcacctttatatgcttatggtgccttggatggaagaaacttattacatccctttgtttggtgccccagaggattctacttcctgagattatgccccttagcaagattctggttggatgagagacttggctttattttttaagggatgagaaggacaccagtttagggtggataagaaaggagcaggagtagccagcagtgccacagacatctcagacttatcagacttgggaaagttgaaaacctaccggaatttcattcacttaaaactctccacgcccatgtttctcttgaaaaatctttatgtatacttctatctctatttgcataacaccattttagaccatttacatggaagtgtttgttggctactatgagaaaaatgccagtgatgagcatttacaaattttactgaatttggacttttaggttctctacatataattacattcaaatgaagttgtagggatatagattggtctatataaatcttcagagaaaggagaggatgcagaatgatggatattgatgatgaagtaagataggaacatatagactgtgttgttttgagttgccgagattccttaaattttacttagttttgtgttttagagcagaagatgtattcatttcaatttctcttaacatctattgcagttcttttgtgaattatgattggaacagattgcaaaatctcccagtgtatcagttttcctaaaataaatcattaaaagcagttcattatctataaatctttcctgggttaaaataaaaatctgctttctaggtcaatcttcattaagctattaatatccttttcatattataagccttttaatttcttttattagcaactgaaagtagctgaaatatgaatgtcattgttttgaatattaattgatgtttgaattatttttagtaattatgctccgacgtcagtgaacttcattccagcccacccagggacaaggaacttctccaatatatttatatttactgaactgtatttatatttgtatatttgtattttacttcttgtgatagatgttcctagtttctatgatttttattgcagtaaaattcaagaattgtcacaagggtgattcattagtggtacattagaaaagcctgatttttgttttgctttattttcaagcaaatcaaaacttcttcagcataaatacatgagaactcaatttcctaagtctagaacagcatttgaatttttagctcatcatagtaattgttcaattttttccagaattactatctaaccattttgtatgcattttattctaaatacaattgacatcaagaaaatacggtgggtgaaaagagccctggagtaagattctgacaggagacttcctctttctgctctgtgacctttttcaagtaaacatgtctctgagtcactttgttaccatttataaaatgaaatggtttagtcatagtgattcttcttaattgttactgagatttataattttaaaagcaatataaaattagagaaaacacaagccacgtaggcatacaaaacgcaaaagatgaaacatctctacaacttcagaccttggccaaaagcattgttcactgctgatggctgaatgatatacccttgcatgagtatgccattatttatttgcctctcgaaggacatttagagcactttgaagttccagttgcactccacatgcagagactcccaaagaacattctactacatattttagaatttacatgtgaaaatgcagaatcaaagtatgtgaacatttaaattttcaccttcgttaccatgaaagctatatcaaaagttgacattgtagattttttttttctttgcaaatctgtatgaaggaaaacaaagtttcttccttcctgagttctcttcctccactcctgtctttgtgaatggccacttcattcaagcctcttcaggtacctttgagattgcacaccatgtttccttctgagtcttcacaactctattgtctcaaagcttgatggtgacaaaaagtgtgttcactaattcatccaagaattttgggggcctggtgttaccctgaaggctaaagtggtaaacaagagcattatgtttcatagttgcttttgtgaagcttaaggtctagtggatcaagaaaaaaatgtccattagataatggcaggaatgcctgtgcttttccaaaatgcgaagggtgaatacagaaggacatgattcagtctgatggtggctggcagtgaccagggtcttcagggaaaagctcactgggaagtgatcttagctccaaaggtgagtaagaactaattatccaaagtaatgggggtaggaagtgggctgggaggaagagctttgaaatcagagacatacaaaggccctgcagcaggaggtagcagagcaagttagagttgttgaagttataaggcccagtggctgagcccagaacacaaggtgaagtttggtcaaaggtaaagccagaacaggggtcagaataaagcttgctctgttgtgcattttttgttacatctgaaatgcaataagaagccaatgaagaatttaagcaaggtggaaataagggaaatggtggtggtggtggtggtgtgtgtgtgtgtgtcttcataagagtaacatgattaagtttgcattatcacaaattgtcatgaaatataaaaagaatgcttagaatttaaaaattagatcttgcttatcttgtatgacttgtaagcagattgtaagcatgtaagcagattgttcatgattcttttggaggaagttctccccagtaatgcggttactttccagcatttagcaaggaaatacaaataacgtcattttccgacagggcagagagtcctagtctaatttagtgtcacaactagcagttctgttatactttaatccttaaatattagaccaaagcagggacaatagaaaatgtgtttacaaaccctcctgattaaggtgactaaaaagcaaaagcgaaacaaaggaggttgaggtaaagagcagtcttacacgtaagcttccagctttgggactgatttacaaaccacaactgaaatgggtattatatatatgctgatgaaagtagctatgtaacatagtttggatctgtgtcgctgcacaaatctcctgttgaactgtaatccccagtattggaggtggggcctggtggaaggtgatgggatcatggaagcggatttctcatgaatggtttagcgccatcctcttagtgctgtcctcacgacagtgattgacttctcaggagatctgcctatttaaaagtgtggcgcctggctctttctcttttgctcctgctcccaccatgcgagacccctcctccccctttgccttctgccatgattgtaaccttcctgaggcctcctcagaagcagacatctgtgttatgctttctgtaccggctgcagagccaattaaacattttctttataaattaccctgtctcaggtatttcttcatagcaatgcaagaacagcccaataccctgtgtcttcattcattaaaaggctactgaactatgcctactactgcattttgcagacttgcttttcctccatttagaactaatgtcttttatttcaagacctaatgtcacctcattcttttttcatgtgataatatcctctgatgtggcctgcgagttgcccataaggaatcgtggagtttgggatgatagttttgggggtgtgtgctattttgccttcttttttcactctcaaatataaaaaggatctaagtgctactcctgaagttatttgcggggactgtttgcactttcttgcttgaggtgtggctgtggagggcaagacagacaaaagtccaaactaaatggaaaatggtgcagttattgctgaaataggtttcccaccatctaattcctttgtgtgctactggctgaaaaagtccttttccttctcagctccacagctactttttcaggacagagtctgatttacatagacaggctgaatgcagaagctgtgtgtttaccatgtgaatttgaggccactgagaagattattttgttgttctgatctcttgaccttctgaaagctcccatcagacctttctcctcccaccttccaccacactataaataaaagccaacccataagcacccactcagatgtatctgcttcttaaatttcggaatcgatttgttaatctcaaaaggccgtaaaaacctgaaaacttaagtagctaacagagaaaaaaaaaagttcaaacagattcttggaaggctttgaagctaggatgcttggggagcatctttgtagtctgttgagggattagagacggcaacatcatgtcgcctcgcaagccagaggacagctttgaattgcagccaatcagaagccatagtatgtttttggaaggtggtgggggccagttttttcccttcaaatagctgacatttcgcagcccccgtccctcttggagcacgacagccagagagtatgcaatttgtttggaattctctcacaacagtcctagtttgaggctaaggctaggttgtgaacatttagagtttttgtacgtcttgacaaatttgtgttcatcaggtgctccgtgaccatcagtattgttttggttatacagaccaagtgttctgggctcagatccaaaacttgcacaagtaaatcagcctcagaaggcagccttagagatctttgaaaagtgctgaagtagggctaaatattagacaatctgccataatttaagttttatatgtatgtatatatatttatatatatatttaattcacagcagggagcagtacacacatcgtaagagagaaatctactttatgcagagttaattggatgataccctaatttgatgatacccacatcattcagtaattcagttttgcgctttctttctttttatgcttttcatttaaaaagcctatttatatgatgttgaggagtttgttaaaattagctgatattttaggatccttttgacattttatatgattataggacatggggacatgagttcagaaaaattggaaggctctcacagttgaagaactgccatatttgggagtccttggcaaagttttatgtaaactgtatgttttttacttagggagtctttataattgaaagcacccatcatactttgtgcatggacttctattcacagaatgaatttagcaaagctattgggcaatataaaattttaggatagggaaaacatagctcaaatgctatggtcattgtggatctcagactgagtacaaggctgcaatattcactcctgaagctagaaacaaacctcaatctgaaaccatgctggaattctgtaattctcttccacaaagctaaagtagaatgtgttgtgttctgttttggtctccacagtttaaagaggacttctaaaacagaggcagagttcagagatgaatttgagtttaaaaatacgattctaagtaaagatagaaagtgggtatggttgagtagaaatagaaacctgatcgtgactcatggtgtccactcaaccaaaggtagtttcctgggaagtagaagatccttcccctcaaaaaggtcagagaaaaggccccacaaatcctcatatttaaagatatcttataagagtacacaaaaatgatatagcataagagggagaaattcagagtatttctcttgctatagatgaacataaaaatatttgacatctgcggtgcctatatagaaactcaagtacatggagctctaagtctattcattatagagcattcagaaccctgggcaaaccaaaaccaaaatagtggtgtcaacccacttctttgacatgccacaactagtggcagatacctcctattctcccccttaccagggacattctcccaaatgtgtcctcttgtgcgtggctcaccactgaggtgctttgtcactcaccttctctatatgatttcagtctgactgtgagtgggtactgtgatgaagcctttgtccacctctcctaaaccttgttttaaacccactttactgaaggtgacatttccccagttattccttattcacatctcctttgtaaaagcatctgaaaccttcacgcagaagccaaagtgtgttacagttctgagtaaagaccccattaaatatgaagattctagggctagtggatctctaaccctaggtgatctctgcaataagtgcagtgaaaccatggggtcagagcctcaggaaatggtagagttgaaggccaagatctgctgattgataacttcacagagaagaaaactcaagaagaaaccaagggactgaatgaagaagaaagaaaagagatgagatggagtaccccatctctccctgaggatggaaggagggaggacagaggaagagcagcacagaggcttccaggtggagagaaaggtgtagctgttcaataatctgatgaaagtgataggaaggaatttgtgagactgtgatatcaatgaccttggacttcttaccaaagtatgaaatgcagtgtgatttttccagtaggatgatgcatagagctgaagatcttgaggaaagttgtaaaggaatggtgctatggtttcagtatgtcctccaaagtttatgtgcattggaaatttaattcccagtgcaacaatggcttttcagaggtgattaggtcatgcatgctctgcccttatgaatgaatcaatgtcattattgcaggagtgggatagttattgcggaagtgggttcctgattaaaaggatgagtctggctcctttactctcttgttcttgctcccagtttcactcttttgcccttccaccttccatcatgggataatgcatcaagcagccccttgccagatgcaggcacttgatcttggacttcccagcctccagaactataagaaacaaaactctgtttattataaattacctagtctgtggtattttattatagcaaccacaacatggactaagacaggtgggctaactattgaactgaatttttggttcacatttattcattcatctatgcaataatattcatgctcttcattatatatccattatatgtgttaggggcatgtgcagtgaacaaggcaaatgtgttccctgttttcattggtggggaatgctcttgcaagtatggtttctaaaagggcagtgttttatcccctgggagagtgttagagatgggagtatctaaaggcgctttggctcttccctgcataatacatatgctcagagttcagataggtcatagagtgaggcagtggtagagctaacagttttcatataacaaacttgcctctttttccccaactagtaagaagcattagtacacagaaaagcgttgattctggagccagactgcctagttcaaatttcagcttccaccgcttaccagctctgtggcttcgggccagtgatttaattcctcagttacctctaatgtacactgggagtaataataatacctacttcacagagctattttgaagattaaataagttagtgtttataaaatgtcttggcacatagtaagcactctatagctattgacaaataaaaataggcccttagacaaaatctagtatgtaaaaggcaacagagagcatgaattagtcggtctcaaggaaggggcaatgctactccctagaaaatatttcagaattttgtgggcattttggttgttccatggattggggaatatggtgggaaagggccagcacattcctgcacaagtttcaaatattctagcagatatttatgcagatgcaaaaaaggcattttaaaatgatctgaactacatataattccaccttatatgtaggtgtgtcagtgttttattgagctgtgaattagaagtttcagagttttattctacactggatttccaggactgtgactgccttctaaattgagggatgatttcctttgttttgttaagaacattaccaagagttactcactatttcagaatgtcactgatacaccaatcctagcatttgaatcccaatgtaatgcacctccatcaatgtgtgacactcattgtggttctccttatttgtacaagcatctcaagacttcactgtgttttctagtgaagctgtaaccaatcactaatatattgagatgcatatgctgttagaataacttgctttccttttacatcttcatatttaaatgagagtattatattgtcttttaagaaatcgtatcagtggctagacagattgcatgatgaatacattttattttcttatacgtatttgttagtggcaatgttgggactgctgtgggtgagaacttctgctacaagcaaaggccctggggcaggtttcagttagagttatagagcctggatagttgttagaaggtgggatgctctctataagggaactactgctctccataaggaaagcatttgttaaatgggcaggaactgtaacatgagcgatttagcattgtcttagcttgccaagctctagtttgttgatgtaagatactgacagttctctttaaatctttgtaaacaaggtagaagctcatgtctttctgatagagagtagtcactacacctaaaccaacagctcggatttatgtccaaatctatttacatactcacacaattctagagttaagttcgcttgctcacacaaatgtgttatttgacccatttctcccacaaataaaagttacattattagagggatacataagaatttgaattgttatatgttaaaaacttatttcttcacattgatgcatttgatatattattatttataagtagtacatgtggcccatttaaacaacgtgagggtttcataagtgattttttctttgggttgcaaactattgacaggtggggagtcaaatttgaatatctttgtgctcttgttaactaaaacaatgcctggcatacaataagaatgcaatacatctttgataaatgaatgagcccttatttgtggggtggtggatttgggaatgtaaatggagttaaagttatacattctagattctacttcctgatctgtcacttaactgagttttgaagtttgagaaatgacttaaaatcttggtatcatcatccaaaaactgcgattggtatcacatgcccaggttatgtataacatttttaagatcaaaagagagaagacagataaaaacatttgaaatccacaaagtgctaatcaaatacaggtgtactaaattccacaaaaacaacagaatcagattagggcttattcagagagaaatgatgcattcactaggggtttagttggttgaatagtgttccctgcaaattcacatccacccagaacctcagaatgttaccttatttagaaatatattttttgaagataaaattagttaagatgaggttatattggatcagagtggacccaaaatcctatgtggcatcctgataagaagaggagatgatacatggggagtcacagagaagaaggccatataatggcggaggccgagattggggtgatacagctgcaagccagggaatgccaaggactgccaggagccacagaagctaggaagaggcaaggaaggattcttcgctggagcctagagaaggaacatggccctgctgacaacttgagcttggacttccagcttccagaactgtgagagaataaatgtctgttgttcaaagtcacccagtttgtgacagtttgttatgggggccctaggaaactaatacaagtgttcattattttttcctcttctgaagaaagggacaggatcagaggtgaaataatgcttctggaaatttgcctcgtgtcctggcatcagtacaattggccagacctttatggaaatagaagcagttagcctaaggtttaaaagtactggctttgggacacagatgagattatggtttcatcactggcaacactctgggaagttggaaatcttccacttcccacctgtaaactccaagtgatgatagccatatccagtccattagttgacttgaaggttaaatgaaatattatatgcagcttgaatatatgcatacatatatcttctcaatgttaatgattattactatagactagataacttgaggcaaccatagttcaatttcagatagctctagtttataagactgtgagccaagaacttaaaaaaagaaaggtgacggttttcattttgattcaggactcgatcacctctttgtcagagcatctgaattagcctttgtcatcatgatgatgataaccaaaactggtcaattaacttcacttggctgatttgcattctaattgcaattttttttatatatcttttaagtaactgcaacttttgggcactgtttaataaaaccaagaaattgaaagtgaggagcttgaaaaagtccttgaaccttacaatttctttacagattctatatgtttcacaataaaggcaaggttttaaatctcagttatcatgagaaggctccaggctggctctttgccagtgtgtttaattgagagatgaacacgtcagattcatctctcacacactatcactatcactgtcctctctgagctcaggctgggctcttctgtcccccatcaataaataattcttccttaggtttaaaatctcaaatagcaacctaagtgcattaacaaaatatgtattatataagaaacattcagagaagagaagttcaaggtcaaagctaaaatttacacagagtttcaatatttaaatgggtctgaaaactccatattccatagccctgtacatttacctatactcctcaaacatctctttgcataattacttatgctgaattgaagcaaaaacatcaaaatgtctggaaatttaggtttcactttccattatttttccaagaacttttagtaaatgttttcaaaacagctttaatactatatctcatcatatagaaatcatgcaatcatagaggctcatttacatgcttcttggttccatagtggttgtatgctaattacacctacatactttctgaacctgacaagacagtgtttataatttggcttcaaatgctaatatatattttaaagaaattcagatggaaaatcatctttaaaaacaccttattcacatatttaccacgatcagtgcttgttattaatttctgaagttctgagtttcacttctcttcagcctagcttcctttagcatttgccattgtacagatctgctggagaaaagttctctttattttattctgtttaaaaatgtctctacttttccttcatttctaaatgatattgttttctagatatagaattctggggtaacgtagttgtttcaatacgtttatgatatttgtcaacttattgtgcctgttgttattaatcactcaaattcatagttcatgtctaagtaatattttgtattactctagtggctttcaaaattttctctttacttttggttttcagcacttatactatgatgaatctaaacatgaatttctttgtatttattctacttggtttttgctgagtttcttcagtctgtaaattcatgtctttcaccaaatttggcaaaattttgttcatttcttcaaatatcttgtcccactctctgtcttctcttcttttgggactccaattacatgccgttagacttttttatgttgccctattttacattatttttaataattttgttcaatatttgtcttcaatattgtaatcagatgcaaataaactggctttctcaaccttaattacatcagccttctctgtgaaataaattcaatcctttattacacagtttttttttacaacagctattcaacaaatgtgtatgtcatcctttctgtaaatgtgtcatggtaatagtatttgattagctaaattatcatttcactcatgagtgattacctatgtccataggtctactgcctgtcctaaattgaacagttttgtccacttaaaacaagcaaacttccactgataggtaaatgttccaactttactgtagcttgcagcagtgcctctgttaagtggaattctatttctgccacagcatcaataagctttcctgtgtatgtcccatataaggacctggttgcatttctattatggaagccatagttgccctgctaaggagtcttgccctttcagggaatttgtgcttcagataaactgccaaaacccaggccttctttgaacatttatattgtctcacagctctatttagaacagtctgtaagatcactctgtcctgagtaagacttgaagactcatttttaccatcacattggataataccctgcaagccagccctttggaggaatcaaaattgaacaatcaagcctgaggacttgatagagtctcaactttgactttttagttttttttctctctctcaatctttttctttcttagaaaatagaaaaatgactgcttactactgattgtaatgtgtctcaacttttgaaattcagccttaaacttgttttactgtgcacatttgcttttgttgaattaagtccaggtctcttcatttcccagggcaaaaaatcttggttaaattccatgggaaaggattgtgttttgggtatgtaaacatctatccaaatacttgtagaattcaaaaagagcatacattcttaagagtgactcagttcaaacacatgcgtgcagattaaacgtcttctttaaggaagcatatagttaatagttttaaaaatgaatttccccaacctgattcaaagaactctcattcttccagaataaaatatatcttaacttcaagtgggataattggcctcacccctacagtgcttgcttggcgtctagcaattatgcactagaaagcacaaaagggatagaattaataggtaaattttagtgagatttggcatgtgtgaggttaagggaatttttcaaagttgcttataaagttgcatacagtttcaaattgttttcattttgagttattttggttaaaaacagaaaccacattttaaacaagcagtctgcttaatgtaaaataaacatgtaacttaatttgcacatttgttgggtgcttgttttggaaatcattgtggtaaaatggaaataatcacagaggcttctgagccaggtagatgtggatttgagtcctggcttactaattctgtggcatcgggtaagtttctgagctcttcttagccaccatttctttttctataaattaaaaatgatcgtatctatctttaagggtggattagagggttaacagttcagcacccacagggtttttaataagtactttgaattttgagaatagacaagacctaaacattaaagtattttgcttttgactaataacgtctagattattagtctaataacttcaggctgttcatagtgatcttgctgggttgaggcaattgagactacattttgaaatcttttgttttgtgaagtatacaccacacataaaatgcataaaccataaatgttaatgaatttaatagtaatagacacctatgtaatcatcacgcagcatatcagctttaaaaaaaatttttaaagaactttttgatggtattatagcaaagatacagaaaagtgaacaaatcataaagtttataattcaaaataattttcacaaactgaacaacctcataaccattgcctgatcaagaaataagacatttctggcaccatccccccgcccaccacgccacccctagaatctccgtgtgttctttctattcactatccatcctcaccaaggtagaatattctgacttcctctcattagatgagtttcgtctggttttgaacttcatatacacggaatcacagtgtgtactcatttatatcatggcttcttcagctcattatgcttgtggtattcattttttaaccactcattatggaaaatttcaaatgtacacaaaatatgagaaagtatagtgaaccctaatgtgtccatcacttctttaaaaccatccttaactcataaatactttgatctaaacaccgtcttaattctctgctgtccccaaggcaatggattattttccccaaacatcctatcatttcatccatgaatattttagtaagtatctcagcaagaaaaggattctttttgtcacatctacgaacttaacagtaattacatgttttcaatatcctatcttggatcagcatttctccattgtgtcataagggtttttttgttttgttttgtttcttctgttttgtttttttctgcagttggattttttacaatagggtctgaatgaagtgtgaagataccttattttaaatgcctaattgtaaattgggggagagtcccatttatataaactgagtctttgagttctttatggctcatgtgaagaaacaaacatcttgcatattttccaattaaatatgttgaggcttatagtattttagaatattagaattcgagataatcttatagtttcttgatatcttgtgtcttggcatacttggaatcccctctgtgttttgaaagtgaacttttagcttcaccgactttttcacctttggtattatagagtctactttctgctatttttgctctcttgatttacctgccaagtggcaggcacaatgggcaattttagctcagctcatctgaagaaattcatcactgagacctacaaaaattccttgaaaggaacagagaaagccaaggttgttctcactttcagttctcacttttgccagttggatgggacagtgactttaaggatataacaatacagctgacacgattaggtgtttgtttaaatgatttttcatttcaagtttatctttgtttaagctgaccacagcaaatatttgatgttaccagttaaatatcttgcagtcttttcacgtttaaaactttttcagccttaagtttctgccttcttatttgtaacctgtacaagggttttcctctctgtctcttccatcacgggatggtgtctaggcacatggtaagggccatcttgttcttgcagttgtcactggttggttgagggctcttatattgtttaatgtcaagccaggtcttctgtggttattgaaaattaagtgtcttttgcaggtcattctcacacccctgttgatgatcttcactgttgcttcgagccataagcttacctttcactgtgaactctggccccaaccccagacctacttctgtccactaatcctacagcttcccttggtacttgtgcactccctgctgctttctctccactagctgtagtgtgttggaccctgtgaggtcacctttgcctggtcacctccctcacgtttgccatttgactgtgcccaggtcatactgagcacactgccaggaggaaggttgagcttggaggacatgaatgaggagaagctgggggcctatagcaatgattttagaatcattgattcaaagttggatgctttcctcatatcttctgcatttccctgaagaagtttccaggacctctctatctcctttatattataacctcctacttccttctccatggcttgtttcagtcttccagaattgacgcaatgacttcctttaaattaacaggtaatgtgaaatagtctagttgccaaattaaagagaaatgaaaaggagcaagtaaaactaatttttttttttttttgagacgaaatctcactctgtctccctggctggagtgcagtggcgcaatctcggctcactgcaacctccaccctctgagttccagtgattctcctgcatcagcctcccgagtagctgagattacaggcacctgccactgcgtctggctaattttttgtatttttagtagagacagaggttcaccatcttggccaggctggtcttgaactcctgacctcatgatccaccctccttggcctcccaaagtgctgggattacaggcatgagccaccgcgcccggccaagtaaaaccaatttttaaaatatttttatttagcctaaaacatctgaaatgttatcatttcaacatgtaatcaatataaaaatttattgagatattttacattctccttgtcttctttttttgggaaggaatgggtacagagtctggatcccagagtgtgtatttttccctcacaatacaccttagtttggaccagccacattgcaggactagaggctaccatattggacagaatgagtctaggtcatgaatgaggaagcttctagataattttaagagaaaagcaaaaacaataaataaactcttaggatggtgcggctttgcctgtctacattagcatttcattaactccaggtgcttgtttcccactgccacttggtatgtaaaatttgtcttccactcaaccaggcagatttttgatcacagaaattaagcctctggtttcctctcaatccacccaaacacatagcatactgctgacctcacagcaggtactccagccaaccaatccctgaattaaaaactgattacaggcagctgctcgatgccttgccacttcccctctcagtgagtccattttatttgtctgacagcaaagctccaattctgtcttcacccctaccaacccacacttttacaaattgctttttagcttaatgttgaaacagccacgctttaaaaatatcatttcattatgtacaggttggcaatcaagaaagaaaaattcccataggactcaaatgaaacaaatctaaaaatttaggactgaagctcgggaatggtcaatctgattttaatgctctcaagagtccacataaaatatatgggcttagcaaactttctgggaaaacccactcaaagagatgacttattgatgcatggatgaagcaagagtgactcccagattttatccaaaaatatatctaatgatatatgaaaatgatcattctagttaaatatattctaatgatttgaacatatctaaataagttggttctatccctcataaaatctaatgacaaacttcggagacttaaaaagtgtgaaaaataaaagtcgaattctggagggtaaggcaggagaattgcttgaacctgggtgggggaggttgtagtgagctgagattgtgccattgcactccagccctggcgacagaagtgagactctgtctcaaaataaataaataaataagataagataaaataaaataataaaataaagatgaataacaatcggcccatacaatttttaccccagcaagaggatgtttggttaaatggccagcactgattattcatacaagtacccacctccccactatctcatacacccactcagtcaccaacctttatagagcacatctttttaattcccctcaaagctgcactttcctctctgttccttgccatccacctatccttctggattgctggaatggcctcctgacaagtctccttgccttctctgtgcatccccacccccgcatttgtcctccaggtcagtgtttcaaactctggtttctgttttgtttcgtttctgagactgggtccttcacccaggctggagtgcagtggcatgatcatgatcacagctcactgcagccttgacctccctggcttaagtgattctctcacctcagcctcccacagaatactggaattacagatgtgcaccaccacgccccactaatttttttttgtatttatttatttatctatttgtagagacaaggttcatgttgctcaggctgaactctccacttgtttttcagtttttaattttttaattggcatataataattgtacatatttatgaggtacatagtgagttttgatacatgtctagtgatcaaatcagggtaattagcatatctatcacctcagaagctcacaatttgttttgttgggaacattcaaaatcctgtcttatatatatttgaaaatatatacaatttttgactgcagtcatcctacattgctgtcgaacactagaactcattcctttcatctagctgtaattttgtgtcctttaacaaatccccccatgcaccctccccgctactcttctcaccctctagtagccactgttctattctacttctaagagatcaatgtttgtagcttccgtatgtgaatgagcacaagcagtatttatctttctattcctggagaagagcaggctttttcctgaatacattgctgtccaatattactataaaacataatacacatgaattattagaacaattaaatgagaaaaacccaggcatgcaaaatattaaaaaatatttaaaacattattttaaaaatttaaataattattaatttaaatagactaaaattgctctctcaacttgctctgtaagttcccatatttactctcagtttctgtacttatcttcctgtgagattttaaaacagcttggttcataattcaggtagcactgatatagatccacagtccaatactatagccagtactcacatgcagatgtttaaagttaaatttcaattagtttaacttaaattcattaaaaattcaattcctccattgcattagccacatttcaggtattcagtagccatgtatggctagtgataactatattggacatcacagatatggaacatttccatcatcgcagaaagttttattgaacagtactgctgtagacccttgctacttacagagtggtccatgagccagcagttcttacttcacatgagagcttgctagaaatgaagaatctgagctgggtgcagtggttcatacctgtaatcccagtactttgggaggccaaggcgggggtgggtcgcttgagcccaggagtttgagaccagcctgggcaacatggtgagagcccatctcataaaataaaataaaataaaataaaataaaaataaaataaaaaaaataatttagccagatatggggacacacacttgtagtcccagctacctgggaggctgaggtgggagtatcacttgagcccaggaattcaagcctgcagtgagccatgatcacatcaccacacttcagcctcggcaacagagttgcgacttggcagcaaaaaaaaaaaaaaaaaaaaaaaaaaaagaaatctgaaaaacagaaaacaaagtaggcctaaacctcttgaaacagaatgtgcaattcaataagtttcttaggtgactcctatgtactttaaaagtagaagccctactctgggatgtttctaggacaatctaaagtccaaatctgatcagactatcctactaatccttttaaattgatacataatatgtgtacatatttgggatacatgtggttatgggatacacctgatcttttggtacatgcttagaatgtgtaataatcaaatcagggtatttaggatagccataaccttcaacatttatcattttttgtgtgtgtgttggaaacatttcaaatctctcctagctattttgaaataaacaatatatacaatgtatcattgttaggtatagtcatcctactgtgctgtccaacattagaatttattccttttatctaactgtatatttgtacccaccactaatctttccatagcttgcaagaccagctctatctaaagtggtaggtattagccacatgtgtttatttcaatttcagctaattaaacttaatttacattaagtttaatgtcaattaaacttaaagtttaaaaatcatttaaagttcaaaaattattttcccagcccgccagtcacatttcaagtactcatttgtcgcatgtggctggtagctactgagttggacagtgtagatacagaacattttcttaactgcaagaagtttgattgcacattgctgatttagactctagtttaacatccagagatctcatcatctagcagaactaccccctgcctacctctcaagcccccaaaccatggtgcaccaggttggcccttgtctctaacacaatgagttacgtaatttagttcctatgcaccatcaccctcattgttcctttaccttgaccactatttttccattcccttctttccattcacctctccataatcttcaactaatctctgtgtcaaaatttacctcatggtcagctgctccagaaagcttttctagaaaccatcccatgctgcaaccctgccacaatttagattgtcccctttcatttcttaggtagaagcctatgtatgcatgtatcacatgcttttgctgttgatttattctctccatttagatcagcatttctcagcctcagcactattgacatttggggccagataagataactctttcttgggaaagtagacagctgtcttgtgagctgtaaaatgtttagtctcattcctaacctctactcactggatgtcagtaacctccccagttgtgaccatcagaaatatatctgcacattgtcaaatgttccctggggagcaaaatcaccaatgcataagaaccactaccttagacctatctgttttctaaggagagcctcttgaggtctgtgagacacttcaaaccacagcatggtacataggtcctgcacacaattggcactatgttggtatacatgctgaatgaatgattgattaggaaatctgttgtcagcaggtgtttcttctttccttgcatcctttgtttcttctttcttttattctgcttctttgcacgcattcccaagtctaagcaacacattcccaagtctaattctatttcatgagtgaacccattgaccaaacaggagagccctgtgcagggcagtcattgatcataggtgtctcccgtggccagttggtttggttggctgatccacagtagagggatagacaaaattatcaacctcttaaaatgaagactgggactgggaatgaatcagatgtaacagcctccctgtgatgctcagttttattagctattttatatatactgtatatatgtatgtaaaatagctctatcttatgtaactattttatatagcttttagctatgggtcagagtcgccaatctatcatcttttcagccagctgtcaacacatggtttcagaatttggaagaaacctaaaagattatgcattccagcagggcttggtggtgtgcgtctgtagtccctgctattcaggaggccagggtaggaaaattgcttgagcccaggagttcaaggctgtagtgcaccatcatggtgcccgtgaaaagctacagcactccagcctgtccaacatagcaagagcgcatctctttaaaaaagagagagagagagagagagagagaaaagatcatgctttcagattcctcatttttttctacatctggacactttccttaggtcctactccagccatcattagcatcttaagataaagatagaattttgaagttccatcatttataaccaatcaaatgcaaaattataagacagtgatattcttgatttgaaagctgtaaactctgatgtctgctgctctgctcttcactagtaagttccctggcactagagcaatgttataggatggtgacctagtttagctctaccgtatttctcgagccaagtagagaagaactggaagttctctgccatccaggcctgcaacagctttggagtctctcatttgctttgctcttcttctatctggaatcctttcagaagcctgatcccccacttcgtgcattctgaaagtctgggccttatagtatttgtgcttcttgctgggcaccatttctgcccagtgttacctgatatgtctttacacacctagctctaattgtcctaatattggcattctcttgttttggactggaggaaagatggttaagtcctctctcctttcttggtttagcacttcttgcaatgtttttctagatttgacctacctttaatctctgcaggcatggtccaatacccttctagcagctggcgctggcattgcaatgtgaatctgccactatgctatgggctgggctctaagtggaaatatgtatacattttttcactgcaaagaatcagctccctctctcactccaggagatggttgcctcagccctgtcacactcttggtcctaggcagctttcagcttcctctgtaactcaaccatatggccagttagatggattgagagcatgaccaccaaatcacctgggatcctacttatcacaaaaccgtgaagctttgttacagtcatttattcaatcccatcaaatatttatcaaatacctgctctgggatagctccagtggatacagtaagatgtcatattcatcaattgctggtcatctaatgggaataataatgaagcaaaaacatgattattgtacagtgagaaatggatatacaaagggatatggaacacagataagggggaaatcagagaaagacaataagaatgaatcctttttagtaacagtgtactgtgtgccaggcaaggtgcttgtaatttctatatagtttacatttctatttaaagtctcataaccacttggtgaggcagacaggcattcgaaaatagcggaaaccctctttagaaattgataacttggttaagttgattatttttttctttcctttaccttttcttgaaatataaaatgcagttaaaaaggtacactcttctaaatagtatagctcagtgagtttttacaagatgagcacatccctgtaaccagcagtctgataaccacattaagaaacaggacatttcctgcatcccagaggtcctcacatccccctaactgcaccctcctcccaccaccctgctcccttcctgaattctgctgcctctctacccaaggctaatcttctggctttaacagcatagataagctgtgcctgttttattcttacgtcaatgaaacaaactcatctactctttttgtgtgtccacattttttcactcaacgtggtgtttgtaaaattcatcccacattgttgcatgcgattgtaatcctcattgctgtataatattccattgtgtggatgttccatttattcattctactgttatgggcagttggatagtttcatttttggatcatagttcatagcattgctatgggtattctagtgttcatattttcttgcacacatgtaaaaatttctgcttggtgtgtgtcttagagtgaaactgctgagttataggcatttgtgggattgaaggtggaatgggaaagagacgtatgcaatcagctcacgagctggtgacactgctggtaaaagggagtgcctatacctagctttaatagatattgccaaatggttttccaaaatggtttaaaagtgttgagttttgaggagcatgcaggagttaaccagaaggttaaagtaataataataataacaacaacaataataaaagggagcagggtggagttacagaaatagtgttacagaaatatgcagtgtatgattgtcaaatttggttgttactggttagctgggtgcatgaatttgcaatcctgtcatgtgttcattttgcttattcttccctgaaatttccagccactaatggaatgtaacactttaccctttttgaacttcttccttctcaatgcagtaccacattaaaggtcaactgtgaaatttccacgtcctattaaatactattcctagagctggatataatatttcagaatgctacccctgttccaagacatacgcatactttagtgaacatgaaattctgtgtttgaatatccagatttctttttttgcctctattgtctttgctttgactttgtggatttggcaatggttgataaattgttttagagtagaagatcactagattagaaacagtatttaactaaaaatagacctcttggctgattatcagtgtctcaagagacagtgtgagtgaatttctgtttctttttgccatgatgctaactgtcacccggaatataatgcttactggcttaaccccttttgttttttatattatgtttagaatgtgtatgtctccttgtaagaatccaatttgaggggttcagaaacacatagtgaatatgcctgatgagtagtgatttttcaataatgatttttacatgttatgtctcctcaaagataacaacagagcaccatgttgcctaaattcatgtaacttccttctgggttaaactgtttattggacatttctgaatatatgcaccatatgtggctatctttcaaagtatgtgtctgagatattattcagagccttttccagccatttagagatatatgtggagcttagagagaataaaaatataatgtgcattatttactagtaattcacataaaatattccatttctaaagcatgttgcagaattattctactggtaaattaagattgaagttgtccttagataatagctagcagtataataaaaataccacataatagaaattgattctgaaatgtaagaatgttttattattggaaaatatatccatataattattacttctacagataaaaagaggaaagccacatgatcatactgataaggcaacaaaaagatgtgacaaaattctaataattttaaaaatctcttacaaattagaaatagtaagatgctatcacaaaccaacaacatcatacatgatagtaacattcttgagcatgtctctaaattgggagagagccaaagttattcgtgcacgtccctattattgaacactgcttaataaaatgaattaagcactataaatattagaattgtcattttataacttgcgtatgagatgactgtctaccctgaaaaaacaagatcaactaaaatgttaatcccaaggaagagttcaacacggaaattatttctaaaatacttttataaaatgagaaagttttttatgtccagtaatcaaaagttagtgaagctgacattcaaaacctcaagctcaaatataaaggacctatatttaaaaaaaatcttaaggcgtgtataggattcttgtattaaattgaaactctcaaggcaatccaaagtagttttaaataagtagaagcactatatttctggaaggaataatattttaaagatacatgttctttccaaattaaattactacaaattcagttaaagttaggaaggtgtttttcaaacttggaaaatgactcaagttaatttgaaattttttgaagaaactactaaaaaatgctgagggaattatgccaaccaaaatttcaaatatagtgtaagacaactaatatagcactctattgatatggaaatcaattcatcagtaaaacagaatagaaagttcataaatacactaattactataaaaaataacacaggcacagtgactcacacttgtaatcccagtaatttaggaggctgaggcaagaggatggcttgaggccgggagtttgaaatcagcccagataacatagtgagacccctgtctttacaaaaaattcaaaaaattagctatgggtagtggtgcctgcctgcagttctagctgctcgagaggctaaggcgggaggatcgcttgagcccaggagtttgaggttgcagtaaactataatctcacaactgcactccagcttgggtaacagaacaagaccccatctcaaaatattaattaattaattaatataaaataaaggtactaaatcaattgggtaacacaggattattcaatgagaggcagaaactacaaaaggagagtaaagacaaacttgatagcaccattatttaaaaatacttctacacaaaacaattcacaaatgccaagtccgaaccaaacaaactggaatatttttgcaaaatagatgacattttagaaactttaaatccttattctgtactagcctttataaattaaagaataatagaaatatgggtaaacgatatgaatgggaaagtaaagtcccccaaagaaagaaagaaatgcaaacacaaatagatatgagaaagttattaatttcagcaataatcaaagaaatacatactataacaataattattttcacccataaaatttcccttattttcaaaactaaaagttccagtggttgacagtggggaggttaaataccactccaaggtattttgcagataatttacattggttcagcttttctggtagcctttggcatatttatcacaagcatgaaagtcctcaagccctttaattcaaaaattttatttttaatgtattattctaaggaaattataatgaaagtaggcagacattgcaaggaaattgcttgtagtactgatcaatagtataacaaattgaaacataaactgtaagtattcagccaaaggaataaattaaataatcataatatatgtcaatagtggaatcgtaggcagacattaagaaagctgttaccaaattaaataatatataaatatgttcatgctctagtgtcaagggaaatatgcagattacaaaggaaaatgaacaataagatcttattttttaaaaagaaaaaatgcccagaagtcatatggacatgcacgaaagtaacagtggttttctctgtcttgtgtgattataaatgattttaatttacttacttgtacttgcctcacatttgcaagtgtttttctacagcaagcatatattacttttataacatcatgataaaaatcatatttcattgtattttacaatggacattttgttttctaaaatcagaaagcagaaatgaaataattataactatatcttaattcagagtttaaaggagaaatctccatttactggtttccccattactacttaattggctaatctagtttttcatttaccctgatgtagacacaaatagaatctgcaatataatcaggcaccaaccatgggattaattagctaactaattacgtaaatgggatcccagttttaacagtcatacctctgcaaaaattgtctttttctttgcaaaaacaatgaagtgtcaacttttaaaaaattaatcctgccaacttcttataaaaagattgtgtaatgtcttggggaaagatttaagatatacaagttaaagatggcctttgaaagacagacagatttgaatttaatatttgactcttttctaagaatttaaaattattctcaaagacgaaaatgaatggtctgaaactcaacgaaatcttttccatgtgagttatgcactcatggtgtccctgtaggagttagagaggtgaataaattgaacgagtaatgatttgtactcttaaacttcctggaaggagaagtggcttggagggtgttggtgggaatagccaaggtatgactgtgatttcaggtaagataatttgaggagctgacaatttacctgcgtggaagtatccagcaggcatttgggaatatgtaattggctcctgaatcagacatgtcagtgaggtgatactcatataggagtcagttacctaaaagtgacagctaaaccttatgaaggcaatgaattccaggttagtgcagagcctctgcacagttccaaacccaggggatgctcttctcattctcttatctgaagttaagctccagggcttatcattcacataaactacattatgaacaatgctgtttccatctctctatcatgccagatgtcatatactagatgaggtctctcagaagagctagacagaagtataaggactcacctttatatatacaaagtgaggaacaagacaatatgtacaaggactcatattaacatatgcaggatgaaaggggaaaaagaggtcagttaattggttttaaaaaaaagatgaaataagacaggctcaaggaaaacggaaagggggcaaaattgcgggaagtgtttggcctgtggtttcaaatgttatagacagacctgaggcaatgataactgagacaagccactgggcctaaaagtatatagaaatgggtaatcttagggatggtggagtccattgagtaaatgggtggctggggggaagacatcagaccccgagaagcagaagctaaggcctggggaggaatggaagactatggacttaagagtgtagcatcattggtcgaaagacttttatttatatttagggagactagagcatgtctttaggtagagcaaaaggaagcaggagagaggggaacactgaaatacaggaaaaagaggggatagttgagtaaacagaaagaaccctaagtgaaagcaggaggagattggagcagtataccaggaccgggatgagccctggaaaagagaaggagcacctatttctcagagctaggatgagactgaggtggacagggaactaacgccttccagaacagaaatatgtggtccgatgagtattgaatgcaacttaaaatctagttggaatgtgatggataagaagagacccaaagtcatcaacaagccttctcatgaactttcagtcattaaccttcctatatagtaaggacagaaatgatgatttaagccatcttaggcaaggcagtgctaacaatatgcttttgtaaagtcaccatccggtgtaaggaataggcaccagcttagtgatgtttgcaaataagccagtggtgggtgtggataaattagagagagtaccaaatgcagtttgaaaagtgttaagttttgtctctagtaaattgcatgtagttttaccaaatagtgcttcagtgttctctttgtgtttcctctttctggtacttaaaaaaaaaaaaaagtaaagtcagttcatgtagctgtgagataaatcttgagaaaaagagtattgaatagggtactgagtttattggttaacacttaggaaagatacgatgcttgataggagatcctttttattaaacacaaagaatagcattttattctatgccttagaattttgtgatagaattggcaacaattcagttcacaaagagccttagcactgtggccactaatgcactgtaaaatgggtttttgttgatgttgatttggaggctgtgttaaatatcttgcccacagctctaaggttttgggtacaaatctataaaactatttcacatttatgctacttccttttaagacgataggtaattcccaatgatttgcttataaatcagttatggtttacaaagcagaccaagagacattcagatttctgaaaacaaattatccatagttttctattaaacatagaactgggaaaagacttagtgattacttagactatgcctctgatttttaaaacgaattgtaattacaaccataatctatgattttttttcatgaaaaaaaacaaaagctgtgtgaatgaggtcagtaacttcctcaacacctctcagtctcccaaacaacaacacaggttaaccgttatcagtttgctgtgaaaccttccaaaattttcatgatattgacacacacacacacacacacacacacgcacacacacacacatttgcttaatatgcagtatttaatgtatgttcaatacatagcatttttttgcattttgctttttatacttagtgatgtatcttagagatttttgcatatcagtatgcctagagctacttcactatttttatttgatgcacaatatttcatcacatggatgcgccatcatttttttcactttctccttaaatggatatttggcttgttttaattttttttctgttaccaatgatgctggaatgcacacacctccttgtgcataagtattggccttctttgggatacatagggaagcgtaaatgcattttacattttaagtggcattgccaacttatccttcaagatgatagtatagcagccttttaattttagaaattaagaaggttaagaaggtaaggcacagagattttatagcttgccagatagcataacaatttaggaactagaaatcaaatatcctatttcctttatagatttctagtgtctacatcaaattttttccaaatttataaaagaagaaaataatgtatattaaactagccccatgaaattttgcttcatacttttcctattctttaccagcaaagcaaaaccagttctgattggtcatttaaatcaatgagttgaatacaaacagaagtataattgccaaattatgggttttgggaaactatggtgaacacgagattctttacttgtctgttttaggttatttttccaggttatgtgatcctgtgatcacatatctgccaacattttcatgttttgggtatttcctaatgtaattgaatttctcctggtttagaaatttatcaacagaatcatctttatttcttcccttgatgtattcccaaatgtaagaaaaatatgcatagtgagttgataaaaagaatgcaagtaatctacttgaaaaattaagcctctactttccaggaaagataattttaatggggtttgggttcattctctatgagtccttctctatcctaatgtcatgttgggtcacaattgtctgatgatcctggctaagcatttggttaacctcattttgggtcctctttctctcttcacatggaggagcacagcacttgaacgctctcgtgtttgaggacaactgggctgacatcgagtgaatttttggaaaactattatgtctttgtagtcacttaatgtcagcttgatgttgaagcaaagttctgtaggagtaaaaaaaatacaagaagtgcaatgaaatattaattaggcaccgagtagaggcaaggagctgggctaggcatttttatgtatgttatctaatctatgctcacaagacttacaacccatgttgtaagtcttgttttgtttgatttccgtatcaggaaatggaggctgagaaagagaataacacatcaactagtatacacagaggttctctagctttccctacttctttctaccacccttcctcccacctcagtagaaatcagtgaacactggagcaaagaagtcctcttggaagaagcagagttggagctaagtcccaaaaggtggctgagatttagatgattgaaggaggagggttccacatttaaagagggagagtagtctgtgtaaaggcacagatgaagacaggcatggtacacacatgctttcactgggttaatgtacaagaacagagctctgttcaactggctttgggaagtataattttggaggataaagggcattggcaagaaactcattggggtctcatgataaacagccagatattaggagtcaggagctagaaggactccctgtgtctctccagagaacttagtgtctcttctttctcccttgaccttcctgctacatgtttctgttgttgttgtttttattttttttctctctgcagaatggcttatttgctctacccagcgtgtggtcacatcagctgcagcaaagattccagctactagcatcactaggcctcagtgccagattccacgggccagatgtctatccctggtccactcagctatgatgaggataatgctttcagattcttgtttacctcagcctgggagcaggttcttttatatcatggcacaagcagctcctctaagaaggcaatgattagtatttgaaccacaaggaacaggagaagtgaggggtcaatgtggtcagacttactaaggagtacttaaaggccactgcaaaaccaggcacctgatcctctaattgagaggggaagtttgcaagggaaaggtgtttgatatatggcaagttgaaagggtggagaggctgagcgccagaggtgagctgaaaggtaatggtaacaatagaggcctagggatacattagtcgacttagagagaaaagagaggaatggcaattgctgaggatgcaagaagttaccttgaaagaaggaaaagcaggatttattgactggttataaaggcagcttttagctccagggatagggacaaggttgtgtggctttgggacataaagaaaggagaaggaggaggaacctgaatgtcaggagagacataatgcttctggtttggaaatgtcatctctggttcaattgtgctatgggaataatggccataaggctacaaatggggtgtgcagagtgaattggataagatatgaagctatgttaattggaagttaatgagatgagaagtggggaattttggagaaaaacaggaagtcagtggccagtagcctcaaatctaaatttgcatcgttacgggcatgctatctgtgggtttgtgataggatttcactcagcttccaggtggctaggtcatattatcaggtggtgaaacagttaaaaaatatcacgacctaagataaagttttggtgtttgctggagcacagtaataacagatgagttctgttcggtagggaaaactctagaagcaagcccagcacttctgtggataagactgattctggaacctactttaaagcttgtgctaggcaaatggccgatgattcccaatgcttgccttagactacaaatgcaaagaggaaaaggttaattttctaacacaaatctaaatatttccttcttgtactaataggacctagccattctgtaatgcaggcaacataggtctgaaagaatggttgtattttggccaaaccatgaacttctttttgagaccctgccagttcctggtggaagccaggaaatatatttttaggcgtctataactccggctaagggagctatgtacctcctaatggttgtcatccaatggatataaatagaacctttaaagagacaagccatatgctttgtggtgcttactttatttaactccagatctgatttacaagcactttaattcctaaaaaccactctattttgttcattaagaatatgcaatgcacataggaatgctttgtaacttggctatggaatcagagatcaagaatattttcctccccaaaacttgtgataaggtcaaatgctaaaggcctatagtaattgtttttagctgttctcttagaattgaaaacaaatgttttctaataccaccaaagtggtgtgctgttagtaatgaatctgtatggcataatttcagtttcctcataatttttatgcatgacctcaaaattaaatgtggttctctaattttttaataattgaaagaataggtttttactaattaagatcagatttatactcttttgtatcagagaatgtcatggtgaaaattaatataacaaagtcatactgacatttactttagatcagtgtaaagatatactacatgtccactggaatggcaaaaattgaatgactggcagtaccacatttggcaaagatatagataacgagaactctagtgcattgctggtagcagtgtaaattggctactaccactttggaaaactatttattaatgtttgtctgtgccctacatatatctactgtatcagtctaagataaatgatcatatgtgtccactagaagatggttacaagaataatcatacagtcgtatttgtaatagccccaaactgtgaacaataaattatttatcaacaattggatagataaacaaattgtagtatattcacaaaatagaatactgttcagcaataaaaagaatgaactattaatccatgctacaatatggataaaatttcagaaatgtcatgttaagtggaagaaataggacacaaaagagaaatatgattccttgtatatgaaattcaagaaaggcaaaactaattgaagctggtagacatcagaagagtaacccactctcttcctggggagggtttttccaggaaaggggtgcctgataattttggagatggagatgtctaagtggtgctttcatgagtgtgtacatatgcaaacactcatcccactgtgcacgaaggttagatacttccccatgtatatgctataccgcagtaaaagtatgaaatatatgttttatacctcaaaatgtttcacaacacattattttctcctttccaattccacagagaagagagaggctaagtctagtacaaaaggttggttctgggccaaactggagaggagatgatgcaatggaagtatccaggcaaatacaaagggattttaacttgtctgtgtttattgcaaaaaaggaaatttgttatattgtgaaaatagtaaaatagtgtggcttaggagaggttctattttggagggggggatgtatgacaagtaatatttttatattttatatcatatccaattagatacattgaagaagaaaaaatgtgttttaattttaagcagagtttttacttttaaaatgtttatatgtatataaatatatacccactcttgtaaatagagccttatgcatgcttgtggagcattttggtgcagtcttttttgaaaatgttttccctgtttcttctacctcttttactttacctctctattgtcacaacctatgtgtgtcctacttaatatgtaagctcatataataaggcatacttatcacataaatatgtgtgtatgggtgtatatgtgtacacccacacatactaacattcatagataagtacagctttatttgtctttgtgctataaaaatgatattatagtatgcaaacttccctgcattttgcttttattcacccagtaaaacttcatggaaattcctgtaagtcaacttgtatattatggtggcccagtagtccctgctgtagatatagcataatttacttaagcagttctttgtttataggttttggttgggcaaggtcttttgtgtactacagtgagaaagctttggcctcagaaacagcaatcagagtttgtcacttagatggtctgagcccatgtctcctcatccatcaaagggagataaatttatacttggccactcacaatacagagcaattataagaatcaaaaagactatatgtaagagtgtatgcgtttggtatgatggaaagagcattgccattgttaacaatcaaatttgtttgtgtttagtacttgctgtaggtgaggcactgttctaaggtcttttcatgtatttatttaatatttacaataacgaaatgtggtactgtgtagtattattcttttaactctttccaaatgagggaattaagaaaaaattgaaataattttcacaaaatcagcaggagacctcagattcaaatcctggattttccatttgagtgtctgtgatttttatctaccatgcaatattacttctcaaatatgatgttcaccgtaccttttattttgtacatgagcattcattggtaacatgaaatagggtggtttataggagaatgatctcattacattgccaatcataaaaaatactaaaatttaaaacacaaaagacatgcatcagatagctatttttgtgcaaaagccatcccaaaatgtagtgatttgaaattacaactacatatttaggctctgattatgtgatcatctggtaagggcttagcagcagggttcttctgttgcatctgggctcattcaagcatctatgataagctgctgagtcagctaggttgctttgctctgaagattgacttcagctatgaaaataggggcaattgagccataaagcgcttatcctccagcaggccttttcaggcttatgcacatgtaggggtatggtttcaagagagaatgtagaaacatgcaagaattcttgaggcctgttgttagaactgacacagcatggtttccaccacattttctgttaaagcaagtcacaaagtgatctcaggttcaaccacctgatgggaattactaccaggacacatagcagaaggcaaagaaagaggttgaggaataattgcagctatttcattcagtgtaggaagcaaagcaaaataaattttcttactaccttatttaattcatcccatagagcctggacactgattttttattattactatgtaagtatgtgtgtgcatatgtgtttctgctgagaataccttgtacatagtttttatcttttaatttgcaaatggctggttttcttttctcggggaatttttttctgagatgaggatttgcttcctctgaatgactaagctgaactgaatctttccactctttagagctaccctcatgctcttgaagtccttatgtctgcaatgattttaatctctatttctcaggtagccagaagacaggatattatactgtggttttccacagcagcaggtctgtttggctagataatcaaggtatcaaaactaattctttaatacagatggcttacaatacttgtgaattgcattttccaaggagcactgtcatattctcaatattaccacacttcctacacctttagcatcctctctcaatactatcagttcccaaaacctttgccctattgtgccaagaaaagacatttatcagatgagtaaactgaggcataggaaatatctatcagtttcataaagggttcatcacctgagatgcatgggtttcttatttcttggccctcagccatatgaattatccaatttgattttcagatttctctttttttctttatacagcttaaaatgacatattctctaactcattcattcaacatatcatttcttcttgaaggcctagtgacatagaaatgagggtatctttagaaatcattagaaattttaaatggttaaatgaaggagctttagaaaaccatcttaaattaggagcttagtgaatgttgctttattttttaattcacatatagtaaatgaaaacatgaatttaagaattggccaggctaagattcaaattccagtgccaccatttataaataacatgagtgaacttagacaatttaatacagcacacacacacacatacacgcaaacacacacacacacacacacacacacttttgcctaatacctggaacatagtagtaaatgctcaatatttttttactctcaaaagcaagggcagcataggaaatgaccctctcaagtcagatcaggagtggtgactaaatgacaaaggaccacttgtgcagacgtccttgtgtttcttcatcttagctttagggttttctttcaagtgtccagattgcacctatattacccttgggtaagagccaatgagataatccatacagaatgcctagggcagggtctggaaggagtaagtgctgtataaaattatccttcttcttctttcacttcctctctttcttggggctgaccagctgataaactagtcctctgtcctagattgtgttccccagaaacagaccttgaaatgaggattatgtgcaggggatttattagggaagcatctcaggagagactggcagaggagcaggccaaggaagggaaagaagacacatctgggttccatttcaggtgaagttccagcctcttcatgacctcatagagtactctggaacataaatagcacctcagagtatgtcctgcctggaggcaaggtagcttggcttttacattccttcatccatctgtcactggctatgggccctcctgggtgggctatcacctcccaagcacttccagctctccatagtgttagggcagttgcagtagcaaaagagaaatttctgaagaaggctgctacagatactgctgcagcagtatcttctgttgccatccagattaccatttccattctcagccttctgaagaaggctgcagttggaaataaagcatgtaaaagctgggaatgggagcacagaccctgcaaaagggacagaggtggcaactctggtggcagcagcagtatctgctacgtcctcttgggttttataggcaccagcaaaacacatcttttgttaaaatggtggccttctgacgggaagggcaggtctactactgaggtcaaaattcatgtgttatttttgtaagcagctactaaagcagtatcagtccagagaaacgagtctatctttgaagaccaaatacccaaaagatctgcttcaaccttccccagttaatcttttgccagaagattcacaatctgaatgtggctgtgagtatttgattagagtattagtaggtgaaggaaggtggtatgcaagaatcagctttaatattatccccgtagaagggaataattggtgattagttttcaggctatataggactattcctcctaaatgaatggataagctgagagatttacttctaaagaggtatggtcttttcattttaactcgagattttaggaaagaccaacttaaaaagaaagcaaaggaagtttcaggagatttcagaatttagaaggaattctgaaattctcttctggggaaatgaaatcctaagacttgcatggatatttctgaaaatcaaaatgaaatattttggttgcataaatcgtcaactgtagtttttaactaaggaaatgtaatttaaaaaatccaagtgttcgatttacataagaaatagagttatttaaatagaagatttccaaaacgctgttagtggtctttgacgtctttaaaaaggcatttatatttgtgaaaagatgatctattttaaggtgtaattatttctaatgtgcctcattttggggtctcttgagagattagaaattgctaataagcaattttaaatattttcgaggtaagttaataaaacacttcatcggtaattcatgacttgttatcattctcacattatccttgtgtgggtaaaggcctgtccatcattggaagtaattggaaagaaaactttgcctgaagctacatgagaactggaacccttaaatcatgaatggtggcaagattccaaaattaattatgaagactattggaatgatgtagcatcctttaactcttattgtgatcgacagaaagtatcatagatggacaactcactttccctttgctctgtgcttcctggtgattttaggtcacgtccactctgaaatctgagctgtcattaaagccatgtcttcgtgtctgtctgtctgaagcagcaaagatgagacagtctgtcgctgtgtgtgaccccagtgagccccataagcagaaggccctgagtctcaatttgtttcttttgattactggcagatcactcactgtgccatttctctgatgtgactgagcatattagctgtgccctcccctaattattcatgcttccaatgttacccattcaaaatttatgaccatgaggatggtgggttagaagcctgaggaactgaggctcaagcctgttgccagagatttactgtcattgttttaggtgcaaagtattaacaggcaggccaactcacttcaattcctgacttagtacatttagtggagaattagttgagaatgagtacattttccctgacacagctgcaaaatcaaacacacgaggagttattgaaaaactgggatttaagcttaaacctatcatttctatatctgatgggcgccatcccatatctgtgaaaatctgacattggggaagtgaaatgcaggcttaaaagaatgctttcaaggtgcatagcaaaagcaatcttactcctttagtgtttcccatttaatacttttcaatttttagttagttaattaaggagaaaatcacttaataatcacataacatagattgctactataaatacctgtattgtctatgttacaattttcgcatctattttactttattatttgtaatctgttgggttttgtgaccttgtgctccaaatgattttgcatctgtaaggtggttgggagttagatacccttcatcatatcttttgccatctttgagtggcttttttaacctttccttttaaaaaaaaatcccttaatccacagtctaataaagtaggaaaaacaatcaataaagcatacctacaaaagttccattttaaacttttagtgaacttaagtttactcatagtgcatttaatcttcctttctgtctgtcagttagcaaatatttattaagccccaacaatataacagagacattgctggctgccaggtcagggggcaagagccatgatgcatttcatcttactttgaggctgtcggtctacaaatatttattgagctcccaacaatatgccagggactttgctagctgctgtggattcagagatgaaaagacatagttccttttattcacagaatttacaggagtgatacaaacaaaacaacataggagacataagatatgtactctgattgtcttggtctgttcagactgctattacaacaataccttagactggttaatttataaacattaggaatttattgcttacagttctagaagctgggaagtccaagatcaagggcaccagcagagtcagtgtctggtagtggtctgttctcatagatgagtgcttttaaactgtgtctgcacttgtcagaagtgcaaagggacaaacaggctccctcaagtctgttttgtaaggacactaacctcatttgtgaggggatgtcctcatgacttaatcgcctcccaaaggccctacctcttaatacgatcacagtgggagttaagtttcaacataggaatttggggggaacacaaacattcaagcaacaacagtgatgatggttaggccaagaacggtgcagtcctcaaggagaaaagctttatatctgctagggagagtaaggaaagtagccttggagctgaggcttggtgcacagagaggagtttgccaggcggataagagcaggagaggtctttcaaagcaggggaaacaacatggtcaaaagcatgaagacctgccagagcttccagaatctatcagagactttgagttgttggagaatgaagtataaggcaaggagtgactgcagctgaggcatggttggatgagggtcagattacaaagaaactgtatatgctgttcaaagtggttcctatattttcttcctgctggttattagaagggcatgtgccccttttaggaggcatctgctatggttaagataatagaaaagggaattttcctacaactcagattacatagttgcgagtgagacacattcctaggtccctctccccaaaaagccttcagaattggaacagattttttgatggtgaagtttgtggtgacatcactggtttgctgctctaaaggccactggaattaggaatgcccgtggatgaaagatattttttgccatggacttaggaatctgggtgtgagtattttctcattggtgggtcaagactgacagctgccctctgcaagctctttgaaaaggtaggaagccctgaaggacctaggtgatgctattacttgatggctcaagcagatcttcacaaattcaatacatgaaagataggaagtaagacgtatgagtgatgggggagtgaggttagagtggtacatctatcatagactggatagaaaggaaagaaaagcagaggaggggaggatacacaacttggcaatgtcgagatccagccatccaaacaagcatggaagtccttggtgaagcttgactcccaaggggcattgctttgcatcaggcacctgctagtctctgtatgcaaagacagcatggctcttctagactgtaatgaatagccaccaaaatctcttggatgtgaacctgctgacttcccttgtgaaaactatgcctaaaggtcagtgaatcctgttttggagctgcttagggtcactaacaccaagaaaacttcatacttcacttttctcttatccctgcagaatgctggaatggaagaaaaaaaaaagatgaaaagtaggtcatataaattggtaatgcctaattctaatccagtgatctcatatagcattagaataaattagaatacattttgatgaaaatttccattttattaaatagttgcttcgtgcataagcagtgcagctggaccacactgtttctaagattgttttcaataaaatctcattagctcacaaggcaaattgaattctcacttgctttccccatccactgtcccttactcacccctgctgtatatagagcactgagtgtagaatttcgctagccagaccacttactatttgacagagatgtgtatgtagggaacagcattaagctatgccatgacttcctgtcatggctataattagcatcagttcaataggcttgagttaaaatggtttctgtggtgccattatagctttgttttgccttacttatatctaggtgaccacatgttcaggtttttctgggacagtccctttttatgcctgttttctcagtagaaattcttaataatgcccattctcactctctgaagtattccagtttggattaacaataatatggtctcctgtagcaaatactatgagtgttctcatagccctcagacctgagcattccagaatattcttactggcatcagcctgttgatatcatgtgcagagtgctctattgaaacgacagaaactcttggcccactcaccaagctggaattcagaggtattgacttccctaagggcatccttcagccaataactgataggaattggtggtcaaattttatttgttgttgttgtttttccttgttgatgtacagttactctagcactattcacttagaaaatttccttttcctagtccatttcattggcacccttgtcaaaaattaattgattttatatatgtcagtctatctctggactctcttctgatccattgacctacccatataccaatacgagactgacatatttatcctcaggtgactttaatttgccactaggtctgagaatcaccattttcgacaaaccatgatttattgcctggggctaaatgcatttctggtctacatgaatttgtggttttattcacagaggacaggaagaatattgagttgatatctagcagtgtctctcttcacatatatttatttattttcaacttttattttagatacagggagtacatgtgcaggtttgttacctgggaatattgcctaatgatgaggttttgggtatgaatgttcccatcacccaagaactaagcatggtacctgagtttttcaactcctggtccctttcctccctccccactctagtattccccagtttctattgttgctatctttgtgttcaccagtatccaatatttagttcccacttataagcgagaacatgcagtatttggttttctgttcctgcattaatttgctcaagataatggcctccagctgcatctatgttgctgcaaaggacatgatttcgtttcttgttatggctgtgtagtatcccacggtgtacatataccacattttctttatcaaatccacccttgacaggcacctaaattaactccgggactttgctattcacacatatattgaaagcatttatactaaacaatatgtttgttatgaatagtgctatattgtacacatttcagagaaccttttccctgctaaatcttcacgtgactcttggacacattgtctttgtgaccactggagcacattttgaagtcatctagtagacttttccagaacacatatttttcacttatatttatattgtttgaggtgctgcaaacctctttaaattgtgtacaacatttgcaattgttaggttatacccacctgggaataattactaagtctgtgctcatttttgtttaactttctgatatatttgtttcatttaagtaaacctctagaagtatccaaactaggattagtagaggtaattttgggctaatgtatcttccccaaacattgttctgttgttcaaaataaggtaattacgaagacactggtaacatgagtgactttgttaggacttgagtataaatcaggctcctctttcctgaggagtgcttaatcaagaaaaaaaaaggcttttcttcatataaaggcttatgtaatatacaggctaccaatctttggctttgtaacttcgtttgactatagtgcaacctgatatggttgacttattaggttgaattattttataccgctacgaggcactttttgtttaaaataatgtatgcctcttccagaagatccctgcacatcacacattcaaaactaactagattaccaggacatgggaaaatggtgtcatatgtcttagttgctgaaggttcactttatcttgaataataaaattacagatctacctagaattgaacttaattgcacaatattgtatttcctttgccaattaacccaatggaggtttgaagtaatatatttgaaaaatgctttgtaatctgaaaagcaccaggcacttgttaatcgttgtcattactatattggaaaaactacctgtggccacttgcaatggagaaaaaagtcttaacactgagcaaagaacagctcaacccttaggcaagtactttatcatcaaaacattttccgatgaccatgattcacagcagatgtaaactaactccagtgtttttcaaactagtggtcttgacccacgggtaggttatgacatcagtttattggttggacatcagcattttacaaaaatgaacagtgcaatagaacataacagaatatactagaaaatagtaatatcagaggtagtaaggataaatattcttttgagaagatctccatatatatacatatacacaaacacacagatacaaacactggatggaagtagaaaatgttctaattgtgactcattgctcagaaacaaaacagaacaagacaaattcaataacaatgtcattgccctaatccttatttaagatttttaaagaatgttatagttgtccttcagcttagcagttattgtattacttaaggtatgatacaaaatgttaagacttttatatatcatacgcttataattcctgagttcatagagggtctaagattttaccattaatatccttctaataaagcattgcattattgaagacaaccagttagccagttcaagtcaacacatttattaagaattaggaatgtataaaaaatataccaaggaaaataaattaagcttatataattatactttatgttaaatgacagtttaatttcttctatggggtgtaaatatttaataaattgtcgatattcaaaagaccaatacatattttaaaatattctgggggttatttttacatacatcatcatgatccccataatgacgtttcaatcagcgacgaaccacatatatgatggtggtcttataagattataatatcaaatttttcctgtaccttttatatgtttacatatacaaatactttccattgttttgcagttgcctacagagttcgatacagtaacatgctgtatagtttgtagccaaggagcaatgggctataccatatagcctgggtgtgtagtaggctacaccatctaggtttgtgtaaatacactctgcgatgtttgcacaatgaagtcaactaaggacacatttctcagaaattatccccctcattaagtgatgcatgactgtatttcctgtaatagagactgtatctgttaactattgctatataacaaccatcccaaacatagtaacttcaacaacaaccatttacttagtgccaattctatgagttagcagtttaagctggcctatcctgggtggttcttcctggcttccttgtgtgtatggtcagccattctgctaagccactctggttctgagagtcttttggctgtttgcctggggcacttcagttctcctctaccctggtcctctctaatcctcaacagactaactagcccaggcctgttcaaagggcaaagacagggctccaagacaatggaagaattgaaggcatgttgaggcctaaactggatcaagtacagtgtcactttgaccacatcctgctcgctataggaggtcacaggccagcccagatttaacaggaggggaaaataatctccaattttttgatgggagaaatggcagagtaacaaggcaaaaggtagagaaaaaaataaggaggccattaatggaggccatgaatgcagtcaacttatcagatgctcttctcctccctacccttttcattggagcaatataaagaaatccttcagtcaagtttccataaagaccctctttcctgcttctggctgagctcctactaaaaagaagattaatgtggaaattaatctaatccaggattaagagtagaagacttacttaaactgggcaattttctgtcaatttgattgtaataaatattttgcatttaagagtttactattgctaaaggaaggattgtgttttctctgggagcattgtgaatcttgtgttactgaacaaatgatttcctaaaagggtatgggtaaatggaactgtaaatcaaaccaaattttttattttgagcccgcaatttaaagggatcgttttacatgtgttctgtctccagagatacctctaaaagttctaggttttagatgaacgattccccaaagcaaccttcacctggagaacataattcctatatttagcttaatacttgggccagaaaggctaacatgtcatttacagtttacaggtaagatgaatgtaatctccttagagtagtttcatcaaccaagtctagaaaaatcaggtactagagtgatttttacacaactgtttcttattgaacaaattacaaaattagagaaaatgaaaaagaaaattagaaaggatagacttaaatatctactcatatggtaataattttataagaaaaaaatcaaaatataacatctgtttctacctgcctggcctgtgaattttgtagtctaatataatgagagagataatattacaaaatagttaggatggctgacttcaaagacagactgcttgcgtttgaatttaagcttagttatgtgttacctgtgtgttctacattatttaatctttttacgcctcccagtagaacagggataataatggttcctacgtcacagggtgattgtgagaattccgaaagtcagtatgtgtggaatacacaggccagtgatcaatgcctggtaggcaataaatgttaactctcactgtcaacactacagttggtttctattccaaccttcatgaattttcactgatttttttcacacttgtttaaagttacatgctgtatgcctctgccaggggcctgagagacagagataaaggacaaagacactgttcccaagtagcttgaggtattggatgaataccccccgaccacacacagatgcacagatagtgatgccacttgtaaaagggatataagacttaaaggtcattcagaatgtccatgagactcgtttatttttaaggtgatttctaatatataattttgtgaagcaatatgcattttttaggctgttggctaaaatgcaatgaattacctagatttactcaagtttacactcattccacatgtttttctaaatacagaaatttctcattatgtatggcatgatttttttaaaaagaaacattatatataaagagtacgtgaagcctaagaaaagtggcacattctttactcttgtaatatgccagcatcttattctttatttggtggtttctaattgttccctaaaaatgtaccaaccataatattgactgaattatgccacaaagaaaagaaagtgattatagttctcttcatagatccttggacctcatataaagcattgattgattgtggagcctgcctggagaacaggctgtatcagtgctatagaatctttactactaacttcttagatactcttgatttggtctcattcgtgggtttacatttgctctggaagtggtgagcttagatgatagaaaaacgtttggtatgtgaatttcatacacttgaagaaatagatcttgagttcagtttttccctgcaaagtgctagaccttaaaaatctgatttgcatagactggaattcattgatttaagaagaggaatttattacagattaataataattacttctgaagagaaaatactttgaatttgggattctaatacttatttaaaattggcgataatttcactcttaccaacaaatacactaattctgtttttaaaatttcgattagtgttatttttggcttaatatgcacattgttaagccatgtgggtttttttttctgtttttaaaatttaagtatactttgcacagagtaaaaggtacctgtatgtgtctacagttgtgcgagtcttaacaattctatacattcatgtatccatcaccaaagtcaagatatacgacagttctgtcactggcaacatttccatgcattcttttgtcattaacccctttctccggtctctggcaaccacagatttgtttcctttcccaaaatataaatggaatcatacaatatgtagccttttgagtctggctcttttcatgtagcataacgccttttagatttatccatgtatcagtgattcattctttttcactgatgagtaatattttattggatggatactcacagttcccattccccacttgaaggacatttgtttctagtttttggtaattacaacaaaagccatttaattatgttcttacttgttttggaaaaaatccaataaaatggtaaaataatcactttgtgtgtataggagtagggtgtggcagggaagtctgaatccaaaggtgttactctaagtctctgctggctgggcatggtgggtagtgcctctaattagagcactttgggaggctgaggtaggcggatcacttgatgtcaagacttagagaccagcctgggcaacatgacaaaccctatctctactaaaaatataagaagtagccaggcatggtgacacactcctgtggtcccagctactggggaggctgaggtgggaggatcgcttgagccccaaaggcagaggatggtgtgatccaagatcacaccactgcactccagtctgggtaacaggatgagaccctgtctcaataaataaataatataaagtctccactaaaagcgattatctgttgtctactggtataatcaggcataccagtagatctcagactgtgttcccatttgattaccattgttttgctgcttaaatccaaaatatgccaattttaaaaataattttcagaattagtacattgcatttcatcaatcttaagttttcctctaataaatcatttgaaatacttgggtatctcacagaggatcccgtgttacctggtttggcacacaatcattacattgattttcctgaagttgaatctagtaatttttgggtgtctcacataagcatgtaactttcagactctctctccctaaaaaaggagtgtcacaagaacatattctaaatcagtctatctggatgtgaaaataggactcttcttgtgttcacagtggccaaggaataaagactactacattctttttcttttcatttcttgtttctttttttttcttttttttttcagacagtgttgcccagactggagtgtagttttgagatcatagctcactgcaccctcaaactcctagactcaagcaatcttatagcctcagcctccttatcagctgggactacaggcacacaccgtagcacccagcattttttttttttttttctgttagagacaaggtctttccatagtgcccagactggtctcaaactcctgggctcaagcaattctcccctcctgagcctcccgaaatgctgggattacaggcatgaaccactgcacatggcctaccactacatttcttaatgaaaatcacaaagtaagactgggaagcttggagaggctgagaaagctgagagtgggtcctgtggaggactttagggagagtcaggaatgttgtctgagtcctctcttacacctctagtgcagtgagatggggcctaacaggaccacttgcaggatggcctgtgaccagtgtgggagtattcttagattctgtccaaggtgctgttataagagggacaagcaaatcctagcttagataagctagaatcatctatgcctggtgctaaagagggaataaacaatgagctagagggaagcatagcatgcccatccaaagagctcctaaagaaagagctcttgtgggagcgtggttagcagtgttgttcatgtcatctataacttctatacccaaggcatgtgcattcattctcaagctgctgcgggtaccagttactagaaactcatagctgcccccattctctggccaactgccctgggctgacaggagtcccctttcccagagatgccttgtagtttatgccttccaccaatctggagactgcccatggtcagcgaccgaaaaatgcagaggtataaaagaaagcacggctgccttgcctcaagacctcacagcccttgtgttgcaatccatgctccagaggtctccaagggatcgggtggggactaaatttcatctgaaacaacatgtttgtcaagctccttctactgcccccttctgcttctcttgatcttttagagggttcttctgagagcacttcctcaaaaatcatttgcacaagaatccctgtctcaggctctacatttagggaaccaaacctgatatagggaactctgagaaacgcccccaataaaacattaagaggagagagagagagaaagagaacttcatacacttgccgcgcttagagagcatattgacatgttactactttaacaatcaggtaagaacccctctgcctccccttatctcttcactaagctcctctaagtgccaaaattcatgttagcaaggtagaaaaggagatgtctaactaagctatttagggaaacataccttaaggctattaaactctttccttcctataagattccagctttgcggttgatgtcgagccttatgaagagaagctttaacgtgaaatgaacgtgatctttccatgagccattaatggttgaccaggggatctgggagagtataactagaaaatttatggagacttttatctaggagcccaagaataaccaacccacctaatttattgaaggtgacagtggggtagagtgcatgatatctcctgagtcttgcctatttggttacctgttatcctaaaacaattgaaaggacaaaaacataataaatgctgaatcctgacaaatgaagacagaaaacttacttttcttcttaaaccaagaggataagcattgtatttagtattgagattaattctcattgaaataaagtccatcagacacacaagtctccatgtattattggtcatccagacattgagatctaatccatcacaaaagtctctatgagttagacatccaggtagccccacatacatctcagacagggcactcttagctgctttcttcttgatggcagctggggattattccttcccttcattttttgtttttatgtgcgtttttgtttgtttgtttgtttgtttttgagacagagtcttgctctgtcagagtcttgccaggctggagtgcagtggcatgatctcagctaactcactgcaacctccacctcctgagtttaaggatttgcctgtttctcctgcctcagactcacaaatatctgggacaacaggcacatgccaccacgccaggctactttttttttttattgtattttcagtagagacggggtttcaccatgttggtcaggctggtctcgaactcctgacctcaggtgatccacctgccttggcctcccaaagtgctaggattacaggtgtaagccattgcacccggcctttcttcccttcttaacacaaggaaatacccaaatattagagggatgcagcagtggggaatgtataatccatggtgtctttgtttcgtgagaaccccaatgaagaaagagaaacagggagacatagtttagagcatgccgctcagcagaatttagaattgccttcagtcactggaagagtctaggtgtacctggctatttgaaatatatgaatacccagcttcattatctgaatgttttatgctccccaaaatttgagctctcttttcgtacaggctgctataacaaaatatcatagacggagtggcttaaacaacagacagttatttctcaccattccagaggctgggaagtctaagatgaaagtgccaacagatttggttcctggtgaggacctgctttctgacttgcagctgccttcttgctgtgtgttcaactgaccttccttttgtttgtgtatgagggagaaagagaatgagagagagagagaaagattcgtcttcctctttttacaagggctctaactccatcatgagggtccccctctgatgacctaatctaaacctaattacctcacaaaggccccacctctaaatataatcacattggggattaagggcttcaacaaatgaatttgggggaacacataaacattcctaatgcaggacaggcaacatttcagctctgccactgactgcccaaataatcctggacaacttacttaacctctctaagcctcagttttgtcatctgttagatgggaatgaatgagttaatatctatagtaccaaaaaaaaattgtgtctggcacagagtaagtgttcagtaactggtaactgttgattattagcctgggttaaactctggagtagttaagaaatgaggcaatttctcattactagaagaaaaatcaaaatgactgtattaaaaaggagatgctgagcatatcatcaataaaagttttaattggttcaatattatttcagattgtgacattaaacatcactttcaaatgctgaggttatttcctcaaatatgacatcagttgactcaatcccattaggagaaatttgaacgccttcactatgtaacataaaaattgctaattctttccttattatatattataatcatgtgtcacttaatgctggggattcattctgatattgtgtgaacatcagggactgaacttatgcaaacctagatggtagagactactacatacctaaaatatatggcatagcttattgctcctaggtacaaacttgtacagcatattactgtgctgaatactgtaagcaattgtaacataatggtaagtattcatgtatctaaatgtatgtaaacatagaaaaggtacattgaaaatacgatataaaagataaaagaacaatggacctgtataaaacacttaccatgaatggagctcctaggcctggaagttgctctgggtgagttgttgagtgactggtgagtgaatgtgaaggcctaggacattaatgtacactactagagaatttataaacactgtatacttaggctaaaataaatttattttaataaacttttcccctcaataataaattatccaccttagctactttaacttttttactttataaacttttaaattatttaaacttttgactcttgtaagaacactcagcttgaaacacaaacacattgtacaactgtacaaaaatattttatttctttacagacttattctataagtttcttcaatttttaaatatttagtttttactttttaaacttgtttgttaaaaactaagatgcaaacacacacattaacctactcagacagagtcagcatcatcaatatcactatcttccacttccacatcttgtcccactggaaggtctgcaggggcgataatatgcatggaactgtcacctcatatgatagcaatgccttcttctgaaattgccactgaaggacccacctgagactgttttacagttaatttttttctttaattattaggaagagtatactctaaaataataatgaaatgtatagtatagtatagtaaacacataaaccagtaacatagttgtttattatcattatcaagtattatgtactatacataattttatgtactagagttttatacaactagcagcaatatagttttgcttgtaccagcaataccataaacgcatgagtgatgtgttgctctgcaacgttatggcagccatgacatcactaggttataggaattttttcagctctgttataatcttatgggaccactatcatataggcagtctctcatggactgaaatgtcattatggggcacatgactgtgtgtgtgtatgtaggtacacacacatatgttcatctcttatgcctgattttgattctttattaatgtggtgtaagtcaatatttattggcagcaaaggatattttcaccttagcaaatgacagatatgaagtttcattctaaagaattttggtgctttcctcctactgccctggggaaatgtagcaatccatgtaatctgccaacatgtatggttggagatgcattttagggggtcagggagataattaatgaggaaaccttgagagtcctatccctatttctagctcttacctcaaaaggaaattactcgtaagtccaggaaatggctacgctgaaaatacttgtcatttgtctgacactgtacagaattctatgtttaagatcatcagttttagtggcaggtattcttggacttaatcctacctctaccaattacaccagtcattagctgcataattttgaacaatctcaatcttctcctccataaaatgggaacagcagtgtctattccttagagcagttgtgaggattaaatgagtgaatgcatataaaaaaacacttggtcctgaatctgacacatgaaagcactgggatagttgttaccatttgaattgtctaattcagggccttttcattccacaagcgaatggcgaagtaccatttaagacttgccaatgggtgggggaggcatttactatccaaataattatatcactgatcatgtctaactgaacacatttttggctagaagggaacttggataaaatataaaaacagagctttcacaggcatttttgttatttcatttatgctttgaaaaaaatattttggggcacctactattatgggtagctaactgcatctcaaatttatatcttaatgtgttcttgtcctttaatttttattctgcaacatatgaacttcagtaatttctaatttccagaatggtggaacataaatacatgtctccagttcctatcaactttgctaagtcataataatattattaacaaaatcatagtctttttctttaacctagcaacagttacttaacaataaaagcaggtgccaacacagcaggaacagtatttagtgttttgtgagtcattgtttttattatttttaactttttttaccatcaccttaggaaatcatacaaatgtcattgtggaaatcaatcattagagtaaggtggaggactaatttttattgtaaaaataaccatatttacctggatacttatttagaatctaagtaagaatgcctgtcttcttgaatcccttactttatttagtcaaatgctaagttaacttgctgttaaggctttgggttcttctttttcagtcgatgtcagtgttgaggctttgtgtgttggcaatttttagttgtgtatcgattaaccattgctacaataatgctatgtaacaagccatcccagaacttcaggcttacaacacttacttgtagtttctagtaatatggttgcattggttctactgatctgagcatatcccatcagggctcattcacatgcctacactcagctctgtattagcttgttggtttcatttgacttggaggggcaatgatgtggctgggctctcagcagagaagaatgggctctgctccacatggtacctcatcctccaagaggctagcactgggtttttctcaggctagtccagtcataatatcatggcaatcacatagcagcaaaaagaaagcataaatgctcaggcatcatttcttcttgaatcgagtcagctaatatcctgttgcttaaagaaagtctatggccaagccaagagcaagcgtaggagggagctacaaagttatagggcaaacgatgtggctacatggaggctattaattggggtgctaatgaaaccaatctaccacagatggcatggatccactgcatatggaagccaccacctttcaggaagacctccccaactggacttttaaaatagcctttctctccagatgccctacctatcatctcatctgcctgttaagaatgggtacatctgggccgggtgcagtggctcacgcctgtaatcccagcattttgggaggccaaggcgggtggaccacctgaggtcaggagttcgagtccagcctggccaacatggtgaaaccttgtctctactaaaaatacaaaaattagctgggcatggtggcaggcacccataattccagctacttgggatgctgaggcaagaatcgcttgaacctgggaggcggagggtgcaatgagcctagatcgtgccattgtactccagtctgggcaacgagagcgagacttcgtctaaaaaaaaaaaaagggaaaaaaaaagaatgggtacatctgggatgaccgtaccttaaatacaagacatgacctgttaacactgccaaaaagaaatgcttcagtgataccttctaatggtggaggaacatagcttgtcaatactcagcaagcaataatcatgccttaagggttgatgttggctttgtgccagatccccttgggctggtgattctccagctgctgctagtgttggcttttattagcccccaactgagtcctatggagaactgctcctagcccacggttcacatcccacccactgccttctgcggggtagcctgtctgacacagtgcaaacatcccaaccagttttcctcaagatgggacatctctgtggtataatccatgctccagaactcccttgggtccacgctcagggtggactccagctgaggccacagccttactcagctctgcctcattcactttctgcttccctccttctcctgttcctgagagtcactctcaagaaatcacgggcatcccaatccctgtctcagactctggttttagaaaactcaacctgaaatacatgttacaatgttattttctgtcattttcttttgtttttttaaagcaaaaaaagcatagatttattgaaacaaaagtatactccacagaacgggagcgggcttgagcaagtggctcaggagcccagattacagaattttctggggttcaaatactctctagaggttgcctattggttacttggttacaccctatgtaaataaaggagtggcccatgaccagtttgattggctctaggagaggaccaatcactggctgaagcagagttacaaagttacatatgaagacttggcccacaaccagtctgattggttgtgggacaggaccaatcagaggtactttccatctgtctttattattattattattattattatactttaagttctagggtacatgtgcacaacgtgcaggtttgttacatatgtatacatgtgtcatgttggtgtgctgcacccattaactcatcatttacattaggtatatctcctaatgctatccctcccctctccccccacctcatgaccggccccggtgtgtgatgttccccaccctgtgtccaagtgttctcattgttcaattcccacctataagtgagaacatgcggtgtttggttttttgtccttgtgatagtttgctgagaatgatggtttccagcttcatccatgtccctacaaaggacatgaactcatccttttttatggctgcatagtattccatggtatatatgtgccacattttcttaatccagtctatcattgatggacatttgggctggttccaagtctttgctattgtgaatagtgctgcagtaaacatacgtgtgcatgtgtctttatagcagcatgatttgtaatcttttgggtatatacccagtaatgggatggctggatcaaatggtatttctagttctagatccttgaggaatcaccacactgtcttccacaatggttgaactaatttacagtcccaccaacagtgtaaaagtgttcctatttctccacatcctctccagcacctgttgtttcctgaccttttaatgatcgccattctaactagtgtgacatggtatctcattgtggttttgatttgcatttttctgatggccagtgatgatgagcattttttcatgtgtctgttggctgcataaatgtcttcttttgagaagtgtctgttcatttcctttgcccactttttgatggggttgttttttgtcattttctctatgtattttttttaaattctcaatgccttgaaaaaatagagaaaacttcacagatacaaaatgagattaaattcagacatttatgagatatatttttaaaggccctatttcaaaatattcagtgcacatgtatgtattgaggcagtcttggaggaagggacatcaactttgcttcagagaaaatgaatttatctcctcagtctacctggctctgcacttattgatcctgagaatttatgaagaactttttttaaataatttttttattatgctttaatttctggggtacatgtgcagaatgtgcaggtttgttacataggtatacacgtgccatggtggtttgctgcacccatcaacccgtcatctatattaggtatttctcctaatgctatccctaccccatccccccaacccctgacaggccccggtctgtgatgttcccctccctgtgtccatgtgttctcattgttcaactcccgcttatgagtgagaacatgcagtgtttggtttttcgttcttgtgttagtttgctcaacttgattctctgtattctcatatgcaaaatggtaataataattactattgcaagggattttgttgagaattaagttaaatgagataatgcatgtcaaaggagtttcaagggctacagatatgctatttttacttgtagactgtattttcttataactcagagctttagaaacccgatgcaactacctaatgccagtaaaatggagtcgtaaagtaataaagaaaactgattgtcttgtttcctattttttttgaaaactgattttgttgcttactgtttttatcatttggtcaaaactgaaacgtaagttttgtatctctatccagatacaaagacagatttttggctttcgttacaacagcacagtaagatacaaaaatgttcacttcattttaatgttatattttgacttcctctcctgaatgctacttcaggcatatggcaaaataaactttcaaaattaggaagctctgagaaataaataataatgtaaacattctttatttgtgaaatgtagatcttttcctttaaaaaaaaaaagcctggctaaccttatttaattctactgagctttacaatttgggggtattataatcaggagattgtagattcgagctgaaaaggacacttttcttggtactgcatcagtggtaaaattcacctgtgttttgggttagtccagggttaaattgaaaataatactttttagtatttgtggccagaatgattaccaaacaatctctatcaaaacagccatttcttcttaataaaaataatgttccggagatgttgcatagcactgtgacccagattcacacacttgtgctaagagtacctgtgtgtgcaaagacttctcttgtcatcactttcctaatcacattacattgactttcttcatttctttctcccccacaccctgcccttcaacttgctaagtacacagtgtattttcttcctaaaagactttctttttggttcaaaaatatttttttcaggaatttgaaagattcaagggaaaggaaaagagttagctgacttagattcaagtcaaggttgatgctgattgttatgtaacatgggcatgtaataaatgggaatgcaaatctccaagactgttgatactggacaaggtttggggaattttggacagagattttcatatatgttacagcatcttcagttaatgaggagaaactatatgtgcttagattgatagataagtagattgattaatcagtcaatatactgattaatctgaaaaaaataggaatcacattcttcaaagaaaactcagtgatgagaattcttaagatgaagatcttaagttttcattctttggtatttattctttagtgtgtgtttatcctgctgtctgtgacttaaatccaatgtttcctcttctactttttgaaagtgaatactggtagaagattcttgcttatttctgtcaatagggtttgaaataattaatctgacttgattaaatgcctcagttatatagtagcatttaaaaaattatggagccactgttacataattggcctcaatcccatcttgtaccccttttgctgatagagcaaaacaaacctacgcaaatatggaagaaattacccacagcagttaccaacccccgtgctgcttagaagaatgcattgttgtgcataaactcaggataaaaatactgaacatttttcaaccatggctgtgtgttgatttctgtgccattgtgttttgtttgctattttaaatttttgtctacaatgtttcactgacagtggtagacatcattcccttagatgcttttggtttgcctagaagaaatgtgggaataaaagagatgaggacgattacactttggcttccttcaatttttcttttggcagtttagtctaacctcatcttcttttgttgattttgtaatatgagaatttaaggcattcaatagtaggttatatgattgaaattgttggccatctctacttccatgaagggtgtgtacatacctacctccagtagaatctcaatatcccattgtaattcctgatagaattaagaatccatgctttagaatgaatgaaaaccttaaaaccaggttaaatttattttatggaaaaccatttatattactttaagttcatggttcttatttgttcctctcattgttattactttttgagtctttgatcttaagtggagaaatttctgcagaggctcctcaaagaagtagcacatatataatagctgggtcataagagagcttgatttataaaatgtttgattaatagagaaaagaggcaaggtagagagtcttgtctccagaaacaaagttgtctttaaaagtatgtaaaattaaagcttgaatctcttggaaccaaccaagacagaaataaaattaatattcatgtaggtgtatgggctgaagcatcctacaatccaattacataacagggacaaactaaggtaaccctggtgtaatgtcttgtaaaagaagaagtgaggttatataattagactgcatttatcaagtagcacattccacctacacaggctctgaagaaagaaagaggaagtggggagggaaagatttctaaggaataatgactaagaacagtttgatatgtacgtttgtgtcatcctttcaagattttttttgcttttagtattatgcatagcatcacttaggcgtctaatggcttacagttttgtccttcaaagaccttgatcaagccagtctttggggcaaaaagaagagcttagatatgggtggagggaaagaaaaactggaccctttaagaattgtgtctaaggaaaacggtcaagaacagttaactaagaatatgtttacttggaaagatcattttcatattggtaagtagagttattaggtgaatagagagcatatgttttgtgccttgagaggattagactagggtaatattatcactgttgataatgcagatattgcagtatgttttgttaatccaacaaaggtatcataggaaggtacaaaagatagaaaaaaaatccaagatggtaataaggagctttattatggtgaccagtatacaggaggggcaatggatagggcagaatcattcgaaccaccacctttatggttgtctctgtttcactcgttcagcatcagtccttgtaagatgtttctcagtgctgtgctattaaagttgaaacaacagtaattcctgctgaagaagtatatttagccaattgacctcgagtatacccacattagaaaactacactccaaaccagtttcccaggttgttttctcctattctttccagtgttggagtttgttggaaatgctaaggaaatgtcctcgcaccaaatttatcagatatcagaagtgtagtaccttttgcttgtctcaaacttggggtgatagctgttgattgaagaaataaaaaatattgaagtccctgctaagttaaatgtaattgctgaaatggccaacatttcatgcaatcagtacaatcatgcaatcatacaatcagtacatgaatactctgccatcgttagtgtttttgctccctctgagtgcaaaacatctggtgaggagcatgcagcacatgtatgtatgacttccccattttcagtggatgtactcattcctgacacaaaggagagcaaataaaagtaaagcaatgacaattaaaatgtaccaattccccaaatacagactgatgcaataataagtttaagagacagcaataatgaacaacaaagattgttgaatacatgagaaaatttgtttcaaattctaccctttggagataatcatcattaaagctggatgaactaaattttaacaaggaagttggcgagtaaccaaatctatatttaaaggctttcagcctaccaaatcttgcatgtatgtaaccgtcattttatgacttggcttttcatttcattaatattaaccaacaataacttccttttggctctgatggacttaagtctaaaggtctcgaagttgaaattggaaaaattgagttgctttttatactaatttctgattgctatttttacttcttttatggtagaggctatattttatatatacatcatttggcaacagtaattcacttctaagcttttatggtgcaaaatcaattgccaatttggtgataatataggcaggcactaatagtgctgctttgccacttcaaagcatccagcccgagaaatttcataagcaggaaacctaaccccgctggctgaactgatataaagaactgcctcttatgtgttcccttagatttgaatttttcaaagctcctctggaatattgtatttttggagcaatcacaattttcatttatttcaagaagttgatttcctgtaggcttcaaagatattacagttctgcatggattagttttaaaaaccggagtgagcatatgaattgtttctaaaatgtatggtgtaagtgccatgggcactggtatggaatggatatggattctgatgttccctcttccatataaagtgtacttgggaaaatctgtttcctgatctgtaacattcagacaacaatagttcatagaactaatgactcagaagatgcaaatgtatctccatatgttaatactattgaaagtaataggaagatataggagaaaaaatcatcatactgaaattagtagaagtgatgaatggaggcagaagaaactagctggatattttcagtggaaaaactcattttaaatcatgaataaccactgttagcaactttccatatttgctctcagtattttttaaagcgtgtcattgtttttgcaccacacacacacatttgtgtttgtatgtgtgtcaaatagtgaaaaaaatcacaaaatcagagccccaagtctaccacccagaaacaaccattatttcattggcttaacatcattttaaatatacatgcaattatcaatatagataaaagcatataaaatagttttataaaaactaattatacagatactattttaacatgaagccttaaaatttttgttttaatattgattgcctctctgtgaagcatgagaacgtttgtccccttgtgtgtccctccctctctgcctctgtttggatttttgttacttgtgtcgttttttttttacactgtgtatctctaaaacattcatggtgacttgaaccatgatttccatatttcattagtactagcactatatttaaataagatcaatgttctcctgcctcatttgccagggctttgcattcttaaattattcatcttgcttcttctctaaattgtctctatttcatcatcaaggtctatttttttaatatttttaggaagggttcagaagtgtatgtgttttatgagatcttccatgttggccaatgtcagccatttgccttaaaaattaatactttagcataatataatatttttggagtcacatttgtagccattgctccatgggcttctagcactaaatattgctgtgcagaagtctgaggagaacctgttctttccctgcgatgagttatttgcttttcgtgcctggatgcttgaaaaagtcttctctttattttcctctggacaaggatatttttcatagttgttttgcccttttttaaaaatcttgcttcgatgccccttttcaaacattctctcttgtcttttaaagtattggtgacttcttgtctttctttatctgagaacagaatgcttctttttcacaggctttttggtttgagagctgaatatttcacgttctttctgattttcttgagaagggaggctgaagggaatactgatgtcatatatgttctttctagaatttcaggtctattttctctcccgatactttgttaaatgtccagtaccaggtttgctttgcatcagcgtgagtgtgtgtgtgtgtgtgtgtgtgtgtgtgtgtgtgtgaagcggcacatggtcaggcttcattagctttctcaaatcattctgaagcagtggatgaattcttcccttaattcaaagaaattattgtttcctattgtcctcagtgagaagcatctttgctattactcagactagggaaactaccaggacacccattcaacttgtttctttctcaatttgtggttatgaacaagaattctcagtaagtttggactcaaccattgacttggaggaggcatcagtgttaggagtcagtgacttgctctgccctagaaatttctgttattttcttagctgtcagagttactgcattaggtctagctttgtttcttgtatgttcttgttttattttgtttataactgttttgcccatgtttaaatgtattctgtgaagtagtttttatcttctgtcttaacctgaaaatcagtaaagggttttaacctaagcccggaaagttactgctatttcctttgcagatggtgcattgtccctgtgggggagctgtctagagggtataaccaactgtgtgaactaggcctatcagaaggacatttcactgaacacctgctggcttttatttttttactttatcttttgtcagtgtcaagggtattatattttttcctttttttttttcatcaccacttacaagccagataagacagaacattcacacctcactgactttctttttattgggaaatttttatttttcctcttgatttattttttcttgctctgagtaggtttataaaactaaagtgaggaacattcagataagatgcactgtcaagattattctaaaccccagcatctttactattttgaaagcaaaacttaaaacaaaaaagattaattaaaaatgttcttaaaatttgaaggtgttttcctttccaaaatgtatttctgcaggaattcccactgatttgaaagataaaattgtatcagatcaacatctccagttaaaaagctagttttccatgttttatttccaaatgctatcaaggggataaaatttaaactttttttgtgcacacatgttattcacatgtgagaataatgaaacataatattccatttttctgctgtatcctttgctacatgtagagtgctgcttgggaaacctgcctcacagtatggttgtgaggattaaatgtgcaattatatagaaagcacttgataagcacttaatacatattatctgtggctgctgctcctttcattgttatgtcatacaatggaaatttcctcatggatttcttcttttgagtgttctttttttacactgttaactccttaaatgagatttttgcataatatttaaagtacaaattctattggttgtccaaagctctatttgagcttttttccaaaatatgttgttttgtttgataaaatgggatgtaagggaagccaatgggctatgttggagataggcctcgagtgcatcctttgtgcccatcttcagaaattggccctcagcctgaatcaccaagcccagtactgtaaaggattcatatatacaacagcacaaccatagccccgccatgaaatactgctggaattcaggagttggacttctatatccttgattttaatcttaaccccactcttgggtagcttcttcgtcttcttcttttcttcttcttcttcttcttcttcttcttcttcttcttcttcttcttcttcttcttcttcttattattattattattattattattattgttagagatggagtctcactctgttgccaggctggagtgcagtggcacgatctcggctcactgcagcctccacctcctgggttcaagtgactctcctgcctcaacctcctgagtagctgggactacaggtgcacaccaccaagcccagctaagttttgtatttttagtagagacggggtttacattgcatttctccaatagttcaattccctttgcacacatgaaaattatatgtgaaatcatcgtatatgaggatcccatcataccaagccatgtataaaagagaaggtattttgagcatagcatcctaagtctggattattttaaatgaatagttattgtacttgatgatttatttcaaatttcctctttaaattactgtaaatgtttcacaacataaatgctactctaatatatttcttagatatataaatgctactctaagatatttctatatatataaatgctactctaatatatttcttagatatataaatgctactttaatatatttcttagactcacagttttgacactaagtttgttataagtgcagaatctcagactccaaccccaacccagacatactgaatcagaatttgcattttactgagattccccagaaattcctaagcatgttaatgtttaatattacagaactaatatagttgatactgttaatagggaaagccataacactcaagagaaatatggatttaaaaggcctttaaacatatgagactgaagctctccattcataattttaaaaatcacaatctaaaactacaacccaataccaatgttctcttcatagactggtaaaagtgcaaaggggtgacaatatactgtgggttgtccagaaagagcactagcattgctggaagttgaggaatgcagggggtataatccctagaggtttttggcatatctatcaaaagtgtatgctttaacccaccaatcctacctctgaaaatttatcctccagatatgcttgcaaaatgaaatatgtacagaaatgttcattgcagaattatttgtaaatgggagttgcataagggtcaatgagggactagtgcaataaatgctgcaataaaatattatacagctatacaaaagaattagagcatatccccttatactgattggttaaactcttcaagtacattggtaagggaaaacaaaagcaaggtgcagaaaaatgtgtatgatactgtttttttgtgtgaacaaagaaacaatcatatatataaatatattatataaatatatatttatataatatataaaaatatatattatatttatataatgcatttatatattatatatttatattatgtatatatatatatttgaattagcctgtatggacatttttaaaacaactttgcagacacacataagaaacaaattaagtatctgtgatacatgtaactgatgaagagcttgccaagacataaatgtaacttctaaaactatataggaaaatgacagataatgcactgggaaaaaagtagacaaagatttttgaccagtctattcataaaagaggatatcaaacagccaataaatgtataaaagtgttcaacatcatgaataataatgcaaattaataccaggagaagctatcactatatgtccatcagctggccaaaattaaattttcttacaatagcaagggcactagggacttggatgcatgctggtagggtgaagattggtgtaaacacttggacaaaaccatgttatgaatatattttctattaaaggtgaacatacacgtgtgttatggctaagcaaccccaattccaggtatgcactgttggaaatatattctcctccaccctaggaaacaggcataagaatgctcttcttaacattattctcagtagcctcagaccagaaataacctaaattaaatatccaccagcagcaaaataaacacgactatacagtgttttttaaaaaaaaaaacaaaacagaaaatagcaagtgttggcaaggatgtagaaaaattagaacttttgtgcattgctggtgggaatgtaaaatggtccagctgctgtggaaaaaagtttatccattcctcaaaaagttaaacatagaatcatcatatgatccagtgttccatacctagatatatttgcaaaagaattgaaagcagggactctaacaaatacttgtatgccagtgttcctagcaaaactattcacaatcaacaaaaactggaaactcaaatgtccatcccagataaatggataagcaaaactatttagccttaaaaaagccatgaaagtctgatatttcctagaagacagatgaagcttggaaacattacactgagtgaagtaagccagtcacaacggacaaatattgtaggattaaaataggcatattcacaaagacagaaagtgagattacaagggactggggagaaggaagaatagggaattattatttaatgagcacagtgtttctgtatgggatgatgaaaaatgttttggaaatagtggtaatggttacacaacattgtgagtctacttaatgccactgaactgtatgcttaaaatggttaaaactgtaaattttgttacatgtactttaccataataaaaaaacaaattatagtatgttcatataaaatagtattatacagtgatggaaatgaatacactataaacgcactccacaggttgaatctctcaaatataatgttgagtgaagaaagtcatatacaaaataatacataaaattaattgtatgtaagttcacttacataaagggcacacaggcacaactaaactatgatgtatcgggatgcaactatcaggatgaagtaaaaagaaaagtaagaaaggaactgccctagaaggcaggttagtggttatctttggtgaggagcagatgaggcgtctttggggtgctggcagtgttccatctcttgatctgggtattcacttcataatgatttgtttagctgtacatttcttaatgcattttacatatgtgtgttacatatcacaataaaatgttatttaggcagggcatggtggctcacgcctgtaatcccaacactttcagaggctgaggcgggcggatcacctgaggtcaggagttcgagaccagcctggccaacatggtgaaaccccgtctctattaaaaatacaaaaattagctgggcttggtggcaggagcctgtaatcccagctacttgggaggctgaggcaggaggattgcttgaacctggaggcagaggttgcattgagcagaggtcacacaattgcactccaacctgggcaacaagagcgaaactctgtctcaaaaaaaaaaaaaaagttttttaaaaagaagtgaaaaaaggggttatgtgttgaggttggtaatacaagaactgcatggtgtgggcatgattctcttaactctactattttctatttgggtttttaactgtaaggcttatgtcatttaattttttcaattcaaataactaaaccagtaaactacaaaatgacctggatcaaatgactgcaagaaattttgattctacatatttaaacaatatagccttccaggaaatgtaaatacttgttttatataaatataaaaacaagtgtcttaaatataagtattgaatttgatttgtcttcagaatccaacattcagtactaagttccactttgaaaccctgttttttgacataggttattaaatattaagcatttaattattacaaattaaaaggaaaatataaaggaggatggatttgtttgtttctttttcagattgaaactgcttggccaaggcctagccagggtagctggcctacccatggcaaggacttgcagcaagccaaattaacttccttgtttggatcacacattaaatttcggaataaagccatttccctggaaaggatcaggaagcattaagcagtagtgctcaagaagattaaacttccatgttgagaatctcactggttatctttggccttctggatagctagttcttttctggcctgtgtacctttctatggctacataaaaaaattaataacctttctaaaagtaaaaatcctatttggagtaagatggcattgcaaattaaataagtattggaataaacaacattagcatatttttttcaaagctatgtgtttagcactcaaaacaatgtcatgttgggcatctataaaacagcttatcaacatttgcagttggcaaataggtgtgttttggagatgttatgagcccttcttttaaaatcactaagatttcttattagtgtaaagaaacatcatgtaagtaaacccagagctctttttaatacatttttttctgttttctcttgtgctactgttttatttttttaaaaccttcttaacatagatgtcatggactctgttcataattcagcagcaaagatcagatttttttttaagttcatagaaattgaagctgtttgtttactagatccccttaaactttgagactcatttttaccaataaatctttacacactaaagaacaacgatctatataaatagttcaattaggtagcctttctctctgctccttaatctgtttccaaagagactttgtaactttggcttagaacttgcatgaagatgttttctagtgttattttcttggtatggttgcattgccttttacttttttttggttttaaagtaacacataattcctgacacacttatcattcaacacataagtgcttctatttagatgtctactttcattttattttttaacattgtactgtaaaaagacaaaacatacctactacaacaacagggattgttctaaatgctgtctacctactaactcaattgtagggaggtttgattttccattttatttgtgtgcacttctaatatacttggcaactccctatcatattcattaaagaaaaaactttagataaactatcataggaaaatctaaactgaaatatttaaaaaaaaattttaaatcagccttatttatttacatgcatatacaaatacacacaaacatgttaaaatgctcaaattatccattttacattccatacctcataactattatatacatttagtattaccatgtactatatgtttgtatgtagtgcagtttatccaacagcataagtcataccttctgggaagatgaggtgtatgtcaagcattggtgttctactgcctgccagttttagtttttaataaaaacaagagaatcacaaagatgaaacagaagcaatccaaagtgtataaatcatgcttctttcccttatgatcctattcttgacttttattacctcattggaggacaaggttatacatctcactgttaatcctgggctaggtcacctgttgagtaaaagaaaagcctttggttctcagattttaagtcatctgacattttaaatttgcatttggagacaataaaggaatataaccaactttttctgtttctttagatcttgaaaaggaagttgtttgaagtcaattctttgttttgatgtttggtcaataatgaaataatcttcattttatgttatatccggcaaagaaaaacagtaacagcaatatggagccaggatgtaaatagattgtattgcttgaaatccacttgggtaaaaaataagcatgcaaagcaagggaaaataatcaatcaaaggggttggtagatgtttttcttggttgtggctttttgggtggctttttggactataagccaaagttggatcttgtcccaactgcttttaattaaactcctacttctttttcttttaatactattttttctcataaaattaataagggatcatggtaggacttttggaaagtatgagtattaattaggatatgggtctagctactctaacagacatccaagtgtcttatgattagagtttatttctactctgagataattaggcaagagctgacgtggttctccgtggtgttcaggactcctaacctggactccctccatattgttgctatgctgctgtcctccaacattgcttccacctcctgatctaagatggctgcttcagctccagacttcacagtcaccttccagtaagaaggagaacagaggaaaggatactctggacattcccagaagtgacacatattatctccatttaaaattcattagtctgtgctcagccacaacagaaaactgggaagtttcatcttaattctagttaatcctatgcccatgtaaaattggtggttctacagaaagaaaagaagactggttattgggagagagctagcaatctttcccagaatgcaaaaaagtataaagaagaaaataactattacccataaattcaaaacctaaagatactgttacctttaatttttggcatagttcatttcattactttactgcattacatatttttaaaaagaattatactatatattataatatgctttttctttttttaataataaatgctctaacattctaacagtctttaaaactttattttaatggctgcatagtatcatatacttataataaataaataaaataaatcaatcaataaataaaataaaaaaattatttttcagttctctaagatatgtaacttataggtcaaaatactcactttaaagtttttatttttcatattacctctcaaaaaggtggtgtaaaattatactcccacagtcatatttgagtactcactgcatcaaatatttctcactactaaatagtacaaattttaagatgattactcatttaatagttaacaaatggcctcttattgttttgatatctatttctttgtgaacaacatagaatctttgaaaaaacaattcttggtaatttgtctatctggtttaaattttctctatatgaccgttatctgtttttctacttataaatttatgaaaactctttcaataatatggatacaacttatctttaaccatggtgaaatattttcccaggtttgagttagtcttttctttcaatatttatattcttggaaatttgttctgttacaatatttagaataaatatttatttgtatctagtaagcaatcaataaatgttaatttaataagggattgaaagagtgaataattagatttattaccacattgtattactcttaatgcttactgctagtcttttcttcttttaactaggtctcccccttttggatgcttttcattttggttttcatcttgaatgactagaacatatattttagcaatacttttgagatgcatatatgcttcatatacacatgcatttcaaaatatccttctattgactttacccaaggacttgggtgattgtatagaattcattaatcctgttttccttcaaaactctgtataccttttcctaccttctggtatgtgacataacgtgtaagagtggcctgagttttatttctttgtaagaaattattggccaagcacagtggctcatgcctgtgatcccagagccttgggaggctgaggtaggaggatctcttgagtgcagaagttccagaccagcctagacaacatagcaagactctgtctctgcaaaaagaaaagaaaagaaattattgctcttttggttttatcgtcctggcagttctaaggtactttttctctcctcttgaaattgccccccaaaattagctcaatataatatgagtgcacattgataacatttcataacttcccctgggaatatcaagaattatattaaatagacagatctggaaatgtttccttccactttgcccttaattcttatttctcttgggtctgcttggcctcttcctctggaacatcagtttatactacttgagtttgcttttcatatatgttgtcttctttcttagtctaagaatctgtttgtcttttgtgcctcttcattctgggagaatttaaagggtttgttcctgtaccagtggtttgctttttctgatctgacatttatgtgctcgttttctaataaagattttaatattgttatggtatttttatttctcagtgttatgttagcctaccctgttcttgttttgtttctgcatgtgtctagctcctgttttatctcattctctggcatttttgtctcattgtttatagagttattgtttcaaggaattttattgatcctataaaccagatgcttcacttgtgtttgctctagtaaatattttcccaaatgtatgctccttctcttcgttttgcttttatatatatatatttctatacatataaatataaaatatttctaaatatatatatttatatctatatacatatacatcacagtatcttcagggctcaatcttttgaaatgtttttattccttttcatatttattcagaattgaacatagagactatgaagtaggccagatatttgaccataaacatgaaataatggtggctagattctagtatattttcacatccaatttttaatttttattttttaagaaccctatctcatctcttaacctggaagactggatattacagtcataggttcatgtggctggttcattgatccagacacttgaaggacatggccattttctgtgtttaactttctgtttggactggtctctgtatcaggtacatagtgtgaccatggatacatgaccctccttgagcagctacccacggcattattgaaatgaagctccaggtcaggaagatgagccatagtttacttgggtagctgcttcataagatagagcaacctactcctatggccttcacacctgtacccaccagtgcggggtttgtaggatactgtgagcattgtcatgtaatcatgctgtgtttatttctcaagtgagaggcttccaagatagttcctggtgtttcccttcaaacaatttctcttctcactaatatttagctaaatatttatgtttctcaaatattgatggtattttttcagggctggatacattagtcctttcatatagtagtccattggtcattttataaggaatccaagaagcatagcataagagaaaaggataaattttcatcctggcacagtggctcatgcctgtgatcccagcactttgggaggccaaggcaggcagatcacctgaggtcaggagttcgagaccagcctggccagcatggctaaaccccgtctctacaaaaatacaaagatttgccgggcgtggtagcatatgcctgtagtcccagctactcaggaggctgaggtaggagaatcgcttgaaccctgaaggcagaggttgcagtgagccaagatggtgccactgcactccagtctgggtgacagagtgtaactccatatcaaaagaaaaagaaaaggtacattttctcagcaccaagtttacgtgaatgccattaacttagcctgtttactgccctgattcctgatttctcatattatgtaatgatatttccatgttattcaatatactgacaaaaattattttatattactatttcatcatagaagcaatatatacatactcccagaagtatttgaaccagaagataatggactgttggccagtagagcagatctgggcacgggacccacagcatccagtacattaatcctttacagttccttccatgtgaattgtctgagtgtgctctttgtccattcctccttttgttaattaatttttaacaattcaacagttattgtctactatatgttagagctcttgaatctttctaagcgctgtccttcaatgaaacacagggatttatttgccagttccttatattaaagagaggatctccttatagtagctgctatataatagtctcttgtctgctttatttttaatataatactttctcagtttcctgttctccttgtaagtaagtatcatggttttggcctggacagggtgaaaattctcatactgtagaaattatcagtggacttttgtctatacttcttccatttgctttgtatatagtaagaccagccaaggatataaattctcatatccaaatttttcatctaatattttaatatttaactttttaatccaacaggattttatgttgaattttttgtgataagagagatttaaaggaatgtactttcctcagaaaacaagacaaattctacagtggtgtctattaaatatttcctacctattcatgtgtgactctttactctatatcccaaaacaatctcacctcagtataagtaaacttagtccatatttatgtttatgtataaatatatttaatatttaatagtgtgttatatatgatgttgtagtagcctgtgatataatatatacatgtacattgattttttatatatttagcacagtgtttctgggatcacgaatatttaataatataaaatttgtgattagaataaagaagaggataagatgtcaccagcttattgatggtaactgccacccccaatacctcatcttgtccccaggaggcttgctaaggcatgtggaggaggaatggagagccagatggtgcctgtggctccatgtagatgattcctacagggctggaaagcaattactcagtaccagtcccctgggaggctgccgacaaggcaggcatgttccccgcattcatctttacaaggtgtaataattaagccagcagaatcatagcattgcctgatggatgtacaaagaatcagcatggaccctcttggcttgttcattacctcaacgtcacctacacaaactagtaattactcacggaatttatggcatttacatgtgacaatgatctttgctgcattaacgcctcctaaagctaaggtccatggggccagttaaaaacctatttattaccaatgaagcttaagcattgaggatttgggtagattttactgacattacacttagagaaagattttagatgtcttcatcaagaagaagacaaagatgtgtgttggacgcagccattttgaatatatttggcagcagcttattaaatgccctagagttagcctgtttaactctgctttaaacaagcacttgacatgtgctaaaccaaagaacttctctatctgaggtgtaactgtctattatatttcttccactgacttaggctagttgcagaggaccctccaatcggtacattggaaattcttggctgaacttgaaggctgtgttttaggtctgcccttctctatcttgcgtttctatccagatgccaatatgaactaaaatagagcttcttgttagtcagcttcttgtccttgaggggcctggaggctacaaaaaaatgagaagtagccattcatcttgatatctggaactcttgccctgggaggctgtcaaagaaagaaaattctggaaagaagaggagaagttactattttttgtcagacggtctagaagcagagcttgagatggagattctgatgcaagtgatttttggagggaatgctctctggagaaagagagtgagaaagaaaaatagggtaggattagaaataaagtaaaggtgggacagaaggtctagcctcaacctggtcccacagggagctttggggtaggaattgcaccacagagctgtcctgcagaatgtcatggactaccagcagcctacctctcccagaggtgcatgcataaacttccaggcatcttcggccagggtggtactcctcagccaacaacagtccttcagagaacggtagaggtgccagctgttagcagctgacaccttcagcatctgcaggatgggtgcaatggccccgtgaagggaacctgagtggggcacggaagtactaactacagttactgatccaccttcctctttcttgcctccaacagtcactctattactctgttatgtatagtcatagcatttatcactatctggaaatagcaggtatatttatatatttactgcttattatctgtctcctttccactagataccataagctccagagcacatcagtgttgtatcatcagtttctaaacaagtgccaggcacatagttaggtaccggggacacaatttgttgaatgagtaggggcgggatgaggtaggaactttggaaatctgtgtcatgcccaactgtagtggatgctatcagtgtcccatccagatcacctcagatcctggctttttcaacccgggttcccattctccagcttctgcatgcttcactcctaacaagtgtcgtctgcttattagtgtgtgctttattagttgagatagtaatagctagaattgattgagtgctttcagcctgtctaacactgctttaaacaagcacttgacatggactaaagcagtgcttctcaggctttaatgtgcacacaagtcccctgtggatcttgttaaaatgcagactctttcagtgggtctgatgagggacctgaggaactgcatttccactgagactcccgggaaagctgatgctgctggtctccagaccacactaagagtggcaagggatttgttcattaatcttcataacagctcggtgaaataggttctattattatttccattttacagatgaggaaattgaggcagagagaggttaagccatgtgctcaaaatgacacagctggcaagagatggaagcagaatttgaatccaggcagcctgaatcccaaatgtgtcacctgaaatactctgaataaaggcctctattgaaagatgaagttataagtcaggttgaccaggctaacaagtaaagacaatgcatccctctggtggatctcacagtgaataaagtctatacactgccccaggacactcggaatcttgaacgagcatgactcaatgggagactgttccactgtcagtttctcttccagcctcccatgactccaaaccattaggctgcagttttgacagtgtttcccaatggcttgaaagtaactaatgagtgagtgccagtgcctaatagaggtggatgatggcagttataatttctcaaagatcatttgattcatcttttgtaatatttcaacatttaatataaaacagcaggcaactggagatttataacttgattcattctaattgatttcttggcttccttgggtctaattaatttttactgtgtaccctaaaatggtgcaataggcttcctgaaagctgttagaaggcagctgtatcatagtttataaaaagctgaaacttggcttttatttgataggtaaatagaaattgattttgcttttgaggtccagacataaaagagaaaaattgactccagaactcaagagaagatcctggattactctgtcttggtttgggttcccccaggaggagattccgagacaaggactctgaatgcaagtagttttctggaaggtcgtgccaggaaacctgccaagaatgggaaagtgagacagggagaggaggaagccaaataggggatgcattgtcaaataagtcatattatgggcagctggtgttcaatctatggagttgtctaggagacagcacaggttcacacttaggttttattccaaccaggaacaagtcaccaatcacatcagtcctgggttgagggctactttttcacattaactccaagcattctggacataggcctggctggttttgacagccagagaaaactctccatcaaagagatgaaagcgcttgcacttgaagctgtagggttgggtctacctgggaataataaatggcaaggggatatagacagagaacacagtgtctgttacaatgtccaaatataaactgtgctgctttgaccttttgtgcaccagtgacttctccccagttcccagccgcttgcccctgaccttgtgtagagcccataatcaagattcctgtgccactgacttgaagacctttaactaaggcagttgtccatcttacattttataatacaacactgtatcaccatttggaagaacataaattataactataaattatataaattataagttacaactattgacaagattgtgcatagtgtaaagtgctttgggattttattcatcagtgctcagaatagacctcatggtgacttggcttttagtggaccctccagtaacaatctttttgtgaaaaaaaaaaaaaagaaatgagaaaagaaatgccccatcaaactgaaaattgagtagaagcttctgtgttgcagtaattttttgtgggcttaagatttaatcttgaaaatgcaacatttgtgtttagcattgtcaaaggcaaaagaggaataaaatagtgccttccaggtcaatgaaaaataaatccagctcctgatcaggctctgctgcttgcagggtgttgttctctgagtgttctgattggcacaacacaggctttcttgccacctcccaggcccagctgctgtttgcccacctgtgagccttattcctgcccaaaacaaggaaaacagcaaaaacagtggggccactgaaactgggctcaaggtccaagaacagctttccctttgggttctgttattgccaccatgaagctacttgtggaagcccaggagcaactagttattaatctgttcctctcaactatttctttaggaatcatgtgagtgtatagacactacagacaacgaggatgatttcaaaaccaaaccatgatttatttgttgatatttggaaatgtacattcaacttcttgtgttttgttacacaactcgatggcacattttcatttttgttttagtttaattaacaaagggtgtgctcaccgtgtgccagaccataccagcacttggcaaattaaactcatctagtcttcataacttcaccatggtgtaggtactgtctttattcccattttacagatggggaagttgaagcactgagaaattgtcatggtggtattatcatgaaaataacattaagattgatgaaatgtatatattaactaattttgactcacaggttaatccttctgcccttccctgatcctatcccagatggcttttggaatgctttccaatacatattaaagggtttatctgtgctatctctggaatgttgcccaggctctgttatagtgaagggtaggttataaagtcagcacatagtggagaaaatgccatagagtccaaattaactctgaaaatgctttcaaatacctcaaagtactgcagtgtggttttatgcttatgaccctctgtggtaattctaagggagctaaagttctagaaaaactgagcctgactgaagaaagaaactttcaaatcactcagcttttaagataactctagggtcgaatggggattggatgaatcaatcaaaaagcttctgcttgcctgcaaagttgattcctttctagttacacatcaagattctttaatctcaatgtctggtaataggcttatttgttaccttaaacatatttgttcaagcacagttgtgctttttagtgaaatgtaaccaattgcttaagaaaagggtctcaagaagtagaaggcctgagtttgattcccagactcttcatagatatttagcaatgacaaattacataaagtatttgaccttcagtttgttcatgtttaaaatgggtgcataatctgtacctaaccttataggttcagtgtgaggactaattcccatgaagctctttgaagggtgcctggcacttagtaagggtgcttgaaatgtcaactcttcctgttattctaaagtcaggaggaaatttaaagaatcggttatgagattcagctgtaccatattgtcctgcataatgctataattatgaattgacttaaaaggggcctggttccattacttacaagcttgtgacattaatcaagttactcaactcctatggctcaatgtccacaactacaaaaagaggtttttaatgttacatttcttataacattattgtgagcattaagttaattaacatatgtaaaactccttggacaatgtctgggtttttaaatctgttaccactgctgtacccagaacgtagcacatagtaggtccttttgttaagtgggtgaatacactatcagtagccatagtaggaagagcttatcactttaaagtgttatgttttgattgacactgtggttgcaaaaacatggtttttggtcacagtgtgatttgatgtcatatgtggtcacattcattaatgtcaccactgatctcttaaaaaaaagtctgtaaatattgagaagcccatcaagctcacagtggtggatacaagcttcccaaaattctaagttttgcttggtagcttgcattttattattggcaacacatactgtcagttatttaccttgatagacccactttattcattttcaagaaaatatctgtcacatatccaagtctgaataaccctagttttcctgtcattctttcaagtaaaaatggtgttacttgggaagaatgactggttcagcttaaaactcagtctcctaagtgtttcagtataccggagaattattttatgtatagttctcattttgtcatacagaacatttgaaaagccacaaagagtaaaaaaatttaacaaaattaataacttttagcacttcaaggatgacattcttgaagtgtgtttttaacagtgagtgtgtagaatgaataatcaaatgatttctggtacactggaagtctggtgccattgtcttgatttgtatgaagacataagcagttttttttttagcattgcttttgtataaagtgcagatttcatctcagtgaaaaaggcaataacctcttaatatcattatgaaattattttgacctcagggaccctcaaagggtcttggggaaccccagagatctgtgtactatgctttgagaatcacttagctacggaaacattcagtagataaaactggccagtgaaagggatagcagagtcaaggatgacaccatttcccattctaagaaagtgagtgggcacagatgccattgcagagaagtaagggactagagaaagggcgggtctgtggcagaaaagataggttcgtgttggtcatgaggcatctagaagatctatttgagttgcacatcttgggacgtcttgtgcaattgttcattcaagaaagattaatagaacatccactgtgtgctggaaatgagaggaatgtttttcattcccaacctttttaatgcagaagtcattttcttagtgaaattgtaagcttctttagaggatgacctaaattatatatttagaaaaaaaattgtatgaacctaacacaatgcaagacattgacaaaatatcccagtttacaaaaaatgatattctccttcctgacttcccacaatgacatacagtttttcttccaccctttatccaggtcagacagtagacacagtcattctaaacttcatcattaatcacgaaaatgcaaattaatatcacagtgagatattgtatatacccaataaactggtgaaaatttaaaaatctgacattaccaaaagttgaggataaagtgggtcattagggatatgaaacataccctatgactcagtgtatgtacacacaatttatatgcatatatatacacatacttacacatatgtgtgcatgtatatatttatacatatttatacatgtgcatgcatgtatatgtgtgtatatctacatgtctatatgtatatgtatctaagtataaaattgaaggtaagatgaccctggactaatcttccaactagcagagcacaagcactcctgataagatggccttatcagaagtgcttgttctctgctagttggaagattaaattgacaccaccatttagaaaacaatttcacacaatcctgtacaattagacattacactccctataatccagaaaatccacttttagggatataccctgccaaaagcctagcacaagtttaccaagggatctgcacaagaatgatgatagtaatatgttaataatgtcaacttaaatgaccatcgataggaaaataactagtggtatagtcccacactggaatattacactgtggtaaaaaatgaatgaactactgctacatgcagcaacatcttgaaatcttagaaatataagccttaaagataaaagaaaaatgcaaaagactacgtgcagtatgatacattatgttcaaagcaaacataactttaaacatattatagtggataatacctgttggataaaactatacaatgaaacaggactacatttaacacagaattttaacaaggtgttttctcctggtgggtgtgtagacaaaacgatgtgatacaggaagaatatataggtcaaggcaatgatataggtaaccttctatgttttaaattgggaggtagataaattggtttttattataatgacagaatacacacaaatgtgtgatacacatattgctgagtatttttatatttataacaaaataatattaaaatatgataggaggaaaggtttctttggtaagcctttaaaattttgtaactttcatgttttacacatgtattgtaaatatgaatttttctgcatgtctcctaataaattatgagagtttccagggcaaaaatcttatttcagtcatgtttacatcttgccttaaaacaaaagaatttctaggctctattatggaccaaatctatgtttgctaaccaaaaagaattaatcaaaataaataaataaataaaagctgctttctagattgatctatagccaaaataattcactgatgttttcacttatgtacttgccaaaggatattagctatcatttggcatttagtctctctctatatatatatcctcttttttattattttatttttgagacagagtctctgtcacccaggctgaagtgcagtggcacaatcatacctcactgtagttttgacctcccgaactcaagtgatcctcccacctcagcctcccgagtagatgggactacagttgcacaccaccacgcctggctgatttttttctatttttttgtagaaatggggtctgactttgttgcctaggctagtctcaaattcctgggttcaagcaatcctcccacctctacctcctccaagtttacttatttttaacaggagaaagattactgaaccaattttgactaagtttatggggtgagttcgtctcaaccaaatactacagaggattgaaatctatattaagatagtcactgcaattattttcatgttaagaccagatatcagaacatttttaaaacgaatatgtggtgttctgtcagtaattagccattgaatatgtcaagttaatcacctaattatgtcttgctgtagaaagacatacatgagaaacttacaagcctgttttgtacaacgttgtgtcttaaacactgtgtgtgatccatctgtcctctgaaattacttggagtcacctcccatcacccgtcagtgttctttcaggaatcatacagattaatagagtcctcacttccgtgctgtgctctgaacctttttaactttaatttagtcctgacagtggggaacaaggacaagtatatgccctccaagaacccgagagctctctacattttgtctagctgaggtaataaccatgtttattggcctaggcaatgtcttttaggtcccttttcccattaactttgtagttgtgaacagttgtcttgaggttaggaggaaaggtgatttaaggaaaaagaaggagcagagggatggaatgtgtacatagccctttctttctgaattatgtctccttgtttggcattccttcctctgggtgttttgtttcattggctgtggttgagcccagcctttattgatccccctgtcccaccagcactgtgtgatgtaaatgcaaatgtctggagtcatcggggatgcttcataaagtgtggagcagacctagagaaaggttatgaaaatgtacaatgcttttccatcgttgtagcttcatgcagacattatatatcatgaaatgaccatatgtttgagtaaccatttatatggaagatgagagagtttgaaagttcatttttttgatacaaagtattttctactcagtcgcagccttttctatctcagtatatcatcatttatcttgctttgaatgaacttgagtacatatagttgtgtgtatatgtatatatatacacacacatgcaaacacatgcatacacacacacctatatatacatctgtatagatgtatgtatatgtacatgtacacacaatatatatgcatacatatatacatgcatactcctgtatgtgcatatgcatgtatacatgcatgtatatatttatacatatgcatgtatatctatatgtgtatatctatatgtgtatgtttataagtataaaatgtacgtataaaattgcggataagatggacctagtatgcgactataccacttgtgtttcttttccatattgaaaattgtcaatctttccccatttctgtagaaaaaatgaatttacactcaaaaaagttgattagccatgttaatagtaataatgttcaatatctggaaattagctgagtacatcgatatacaaattagtcaatacaaaagtagtatatgaaaaagccactaaataacatggcctctttgtttattgataaaaaattccaaaagggaagtggagaaaatggagaaaggcaattgaatgccaagtaataatcgttataaccactgaggggtggctgagagtggatagtattgattggcaaaagaaagctttcttgggattctgaggatatcagtatcattaatgcacaaccactgagaaggattttaaaaggtgaggcatagacatcactgttagaaataacagcagggcattttttcaggaagctctggccatttggtcagtcaagagctattaatttcagtgaattctgcctgcataatatgtgcagcccctagagaggccaccttcaattctaaacctcaacattcatttgctgtcttaccaccttagtagatttctttttgggtttttttttttttttgccaaaatcttcactgcatgattttgcaggctcacatgcttcttgtttgccattttaaatcacagtccccatcaaatgcccattatctttaataaggtgaagcaagaggctgggtgcttggctcacatctgtaatcccaacactctgggaggcctagcaggaggattgcttgagctcgggagttcaagaccagcctgaacaacatagtgagaccctgtttctaccaaaaataattaaaatatacagatatagtggtgcacatgggtggtcccatctacttggatggctgaggtaggaggatcgcttgagtcttggaggtcaaggctgcagtgagccatgatcacaccactgcactccatactgtgtgacagagcaagactatgtctcaaaaaaaaaaaaaaaagatgcaagaacttgaatcaagaatataaagctctgcgtctgcaccacaagagacaagagtaattggtagagtttgtgttatcctttaaagagtgcttgtgactagcagatgctgagagaaaaaccaacatatttttcttgttcctcaagctactcattattatcttgataatatttctaatatttatttttttaaactgacatgctttaaagtaaatatactgaaaaaaaccttattcactgactgaactaagtattccatttagaagtgtggaattggggctttttttttttttcctcaacatgtaatgagtcagtgtggaatattgattattcatctgaatatttaaatcttgttttgtttttggttttgtttgcatgtgggttttcttggctcagaaaaataaataattgcatgtaaaaaccatttattctttaatttcagaagtatttattcagcatttcttctattcaaatctctgatggtattacatagcacacaggaattcaaatgcagcagagcatctaaaacataaccaaacagatgtgtggggcatgtgttatgctaataggaaaggctatgcacagcatcactttaaccataaacacgctccattaagattatagacatagacaggtaggtattaggttggtgcaaaagtaattgcaattacttttgaaccaacttataggtaggtagatagacagactagattcattcattcatttattcattcatttttctgaagaagtagcaaaagagagactgcaaaactttctaaaatcctctagaggcaaagccaacacattatagcacctgtacttcccatgctgcatcacacaccaaatgtcttttcttgctggagtggccccatgtctttctgctggaattcagtttagactctcttagtctgttctctctatccattatcctgaccaacatataaaggtgtataagccaagctgcccaataattatgctgtaaaacagtggttttgagtactttctttctttgtgtttttgatgaatgcacaataaaatctacatttttgtcattttgccttggaatacaagtaaccatctcacacacacacacacgtagacacacacacaactttcaggcccaggcactctcccattctcaatcaacagtcttgcctcaagggcatatcattcaatctcatggatggaaacatacctgctgtccactcccaaattcacgtcactgtttcttccatatgccccttttgagtttaaggctgtctgtctgacatttccacttacatgtttctcatgcaccctgatttctcaactgcaactgaattcttaattttcatatacctccaaaacggctgttcctcaatctttcctttttagtaaattcgttagctatcaacttagttgcccaaactggatgtcaaggagtctctctgggtaccccttaggttctcatcttctatgcaatctatcaccaccacgtcctgttgatttaatgtccaaaatacatctaaaatccacccacttctctccattttcactttttctcaaggctcaaggacttactcttgcttaacttggctcactgctcctcagggcgcagctataatgttgccttatgtatcagctatctcttgtcacaataatgttgtgtagcaacaacaaaacctcactggcataaaacacaacagtaggcatttgtcacatttgagtgggtggggttcaccttgatgactctactgaccttggctgagctcactcacatgtctggggatcatcgagctgctggctgacttaggatggcttcagctaagaagactgggatgactcagttctgctccatgtgtctcatcctcccataggctagctagggaatgttctcgtgggaatgacagaggcacaacagcacaagtagagatatcaagtacgagtatttgttcaatgctctggtgtgttacatcttctaatattccattggcggaaacaaatcacatttcttagcttgtgatcaaggggcagagaattagactttgcttcctgaatggagatctgttagttccataataaggacggggatatagagaggatgatgaattaggatgattaaagccataaatccaccacgctaggtcagaaaggcctttctccccaaattagagtctcacctctctcccatttatactctctcacagcaccctttctatgactccatagccatttgtttggaagtggtttttttttattattattatactttaagttttagggtacatgtgcacaatgtgcaggtttgttacatacgtatacatgtgccatgttggtgtgctgcacccattaactcgtcatttagcattaggtatgttatttttaaagaactatgtactacccaaacttgtaagcctcatgagagcccagagaaaggagctcccttttgtttattcactcacagagcctagcacaatgcctggtacattgttaagtgttcagtaaatgtggagtggaagacaggaatggattggcagtggaattctcaaggtgcagatgatatatcctcactatagccccaggctagagtgctgcttacacctgcaggtaaagataaggacttcagctaataaattggccctcctactacaaggcctctggtttcattgagccttttgggaaatgtaccagttcccgaggctgtgattgtgatgtacttctcaccctggaccagagtcagggcaggagtcagttctacaatgctgcattacggagagccttgcctgcctatttctgctggttacaattccattattacaggacccagtcaaagcagctggagaaactctactgtatccctgaaaattcagctgtcctttgaggagtgtaacctaagacaatgtgtactctggtaatgccatgttctgcaatatcttccatgccaaggttggcatttttgttagtaatactttcttatagtgcaaagaaaagaagctgcttttaaagagctgaatttggcacctcataatttaatagtcaaatcatttgctgtctattttcaagggttttcaggggaatttaagaaccaggaaggactgaaagatccataatactttctttttctagcaaattattaatgcaaacagcattagtacaattgaatacaattgcaaggaatcaaggggattataaatccaatgagagaaaaggcagccagaatgctaagagagccaccacccactgctccaccatgacccgccattccacgtcccatgctatcctccacacactagacacatgcaactcctgctgccactgggttgtgatccccattgtccttctggtcatgctgtttctaccgtctggaataccctcccccacctttcctgacagcccaggctctactcaacatctaggcactaggtataaatttaaaatgtgcaaatgctttgacccagtacatttgctttgaaggatttatcctcgggaaataattggagttgtgccttgagtttgcacggcaatatgccaggacatttgcagtatttacgtcatctccaggagttaggatctggtggtcaagaatgtggctttggcatcagactgccttgattcaagtcttgccttcaccatttgctggttctgtgactttggacaaatcatttaatccttttgcctcaactgcttcatacctaagatagaattgatatcggcaactaactcctaggtttactgggaagagtaaaagtgtcagtaaatgtgaaatactttgaacagtgcatggtgctcagtaagaactcagtacatgtaagcacctatgctttcaaatggactctcattcgttgagaatttttcttcattttcttgctgtagttgctattagtggaacggttagaaccttctctttgtattctttgcaagctttaacctactgttttagatatatttgatcttcagtgaacagttgttagtatgtcaagaaaagtaatgaaggttcttaaactaaacttaattttttatggaggaacacaaggcaatttgctaattcggggatctacttctctttcatgatagcatctgcagatgtcatgacagtttttcaagaccctggcaacttgataatgtggcccaaatagggggccaatttcattctgctatgagtccaatttaaacaggctcgattgcgtcaaaattagacttttaattatactttatctaatgtcaggaatcagtgttgtgctttagctatttaaaactttggctttcaattagaaatttgatagcaatgcattgaatgcatctcttcatcatgttttcagaatttaaatatctaacttttttcttctttgattaaagaggattccaatcattgctgcttgtatacaatgtaagttacatacgctaatgcctcttcagttttttaatttttttaattttattttttaacataccccttcatttatctatatacaaattgtgtcagaagacaaaattatttctgtgtttttcaaataaaaaatagggtcccttttatttttcaaggaatgatcttctttattaaatattatattataccacaatataacatctagacattgggagggatctttgaagatggtggaagacagtcttgatataataagattgaagatgaaaataggctaatagaattgcaaccgattatactgggtgtacccactgctatgctgtgaggtagggatcaatgacaaagctttgtgtacttccagagattggaaatatctatacaaagagaggtaaggagtagcctttccttgtaaaagtagaattgattccatattatatatcctctgtatgtccccgaaatagaaggtctgctcccatgagcagcttctcagaacataagaagagcatctgggctgaaaaaatgtttcttgtttcctccttgttacctattctttgtatagatccggggtttcaacgtaaaggtcatgattttatctcctcagtcatttgttgctgggcacaatttgcctttatggcaagtgttgttgctagttcttaaaactaccagaagagatacttaccctcctgagcagacagaagctcaggagtgccacaaagatgaatatagattttaaaagaaatttaggtaagaaactagggaagtgataaatcatggccccctgttaaacagaaaactcattaactggaatactgcgttctagttaagtgacattttactatccttttttgtacatagagcattacttctttaataaaaggattacagaagcacaatataaagagggtaatttaaaaatctctaaacagtgaaaatactactttttacgctttgaaatggctttttatgtccagtccgagtgacacttttcttccttagtaaaatcagcaggcacttccaggtggctgaaatccaccctgtgcattgttgctgagaacatttatagcacattgttcagattagaatagctgagaacgacagggggctcttcaaatgtgcctcatcgagtcccaaattggagatgtgtttttgtcatttcaaagttttggcagtagggtctaggattcaaagcaaacaccagctcctgcagaacacaagccttaattaatttccagcaggaaatgagtgattgccaataagccatgaattaaaatggaatggttcaccaaaaaccaggtcctcatctcaaatgaatagcatttcttgctgttttcttgaaagatcatctcagactaagaagtgagcaagctcctatgacagctctctgtctgtaagggggtagttggtatggacaaacaccaaacagtaagtcctggcccagtaaaaaatggggaccaaatctgatggactcaagggcattttgtcagtatctctatcatgtagcctgcaatttttatggagaatctgtctatttttctggcttcattatttatcatgttgtcattaagattcagtcttgagaaggtccttaaaggtcagctgttttcatcattcagtcagtgcttacagtacactggggctacttctgccaaaggggtgtccagttgctgcttgaactcctcttgtggccagaaactacccccttctaagagaagcctgtttcatctctgagcagctcagccagttttcattttttcttaaaattgagcaaaaacgaatcccctgttgcttaaatccattgagcctggtttatccctgagggccaaacacaatgaatcaaaaaccttcttctgcttgatagctctttaataaaaggggaaggcaggtctcacactccccctgaggggcctcttctgtggacaaacatctctgagcttttcctatcttctttgagagtgctttgtgtgtgtgtgtgtgggtgtgtccacttgctcttatgtaaattctaattactattgtaataataaatagccaatacatacagaatgcttccagtgggccaggcagtgttctaagtgctcccataatcctcacaacaactgtatgaactggttactaggattatcccattttacagagaaaaaatgaggcacagagagattaagaaacttgctcaccaggatctgaatccactattccacactcttaaccccagcactataaagtttctcatgtcctcatttgtctatttcagccatacctgtcctggagacaagagccattgctagttttctatggggaactgacattgctatcatctactccacactggctatatgctaggaactatagattagttggtctgattaatcctttgaacagtcagcaatcattgtttttgaggatgtgttgttgttattgttgtttggtccagcacttccccatactatccccattaatcattaattatgttgttaattaagaacacctgtacttaactcgtggccatttattccttttctagaactatttattgtctatattttagagaaccttaaatatgaaaatggttaatccagaattttttgcttgggccaagcaagcaaaatgcattgctgctttatgaagaagaccttcttttggtaagaagacagtttttcatattttcatagccagcaattaaaaccacatgagacaggaaaaccttcaaattctttctgagcaaaatactcttcctagtgagaaatgtgctcaaagtggttaaagataatgggaagcagcagaattaggatttgaactcgtgtgcttctgggccaaaaccatggagttcccattttgcaaacacaccttggggtctgtaaccaggtgcggctccctgcaggtgccaaccacctgtggtaaaggcatgatgagtccacttcctgtaaggctcagccctgctagtcgcgactagcgccctctagtggtccaagagaaagggtaaggtgagttccggtttatgatttgacttgaggcattcggaggctaaacatccacaaggttagttccctgaacccctataaaccttgctatttatatctcttcctcaactctgaggccctcaccctacatcggctgcagtacagattcagcctttagcgacggaattatgtactgaaacactcatttctgtgccgctgcagtggttagctttgatttttatagagatgcacatgagaaaacagtctgagcctggagagtgacttgtgggctgctaaggtaaattgaacccatgtgtgtggtatcctcatgattgggagcagcagcagatggtgggctaggatgcctccagaaatgggcttcggaagcataaaataaggacttgttctcttacatctgcctctgttggggtgtttaaagaattgttgggattaatgcatttttcatttgaagtttaaacactctcagaggatgtttagccgatggactattctcattatagaatgaattgcttcactgggttgcactttgcaaagattggctgcagggagtaagtgatttgttggaaaagaaggagcaaaaaagggtggaaagagcaaagactcagtgtctcagacaagtcttcaacttttcctctccatccaaaatgaattcattatgactgagaggttccagttggactcctggagacatttagaagtgccccagaaatgccacctgcaggtcagtggtcatgtcaaactagaatcttctgcacaagtcaaatataagaaggaaacttgtttcatttgagtcagatttacttaagttttggattgactcctagatcggcttctcactttgggcaagctccttaatgtctgcaatccttgttattttcatctgtaaagtggagcttgtgatgcttactttgtgagatgtctttggaatcaagcgaagtaatgtctgtaatgcgaatagcctagtgcaggcatacaacagatgccccatctaatgggattatattaaaattattgttgttttaatattggttatgaaaatattgcaaagtgaatgaagaactctccttttacccaatttttttgttcaattttgtacgtgaacagtttaaggaatcttttaacggaatttttaaaaacacttggaggcggtgactctttaaaagctaaaccatgaaatgttaccatcagaaaagagctgctgctgccatttacaagcattaaccaaatcctcaagaattaagctagaactgagcacattcttaacaaggtggtttcgagttttcagatacatctttatttcttcagctcatttgcaaatacttatctctgatttaaatcattcaaatgacttcaggaacacaatggaagcagagcagaactaagtgtttccaactgtcaggtctggtgagggatgatgtaaaacgggacatttagctggcatcctgcatagtctttaaatagaattaacaaaagcttccacgtttcaatggctaaaggtagtgtttattgtaaaggcagcatgcctggagacctaagagtgggagtaggggggtgggcatgggcacgtgtgggtgcaggcagggcattctgaggggtcagttgaaaggctctgtctctggattcagctttaactggttctaaaataatgaagcagaaatgactttccttctctctctggtgtcagcttcaaatgaattatggatactgaacctacagaggtaatgctgattaaataattgaacaatccattgattaactacagattgtcaattggaataatctgtcgacgacctgactgcccacctttagcatttagacagtattttaatgttaatgaggttttgaactttttgtgcttttggtttggtgggggttttttttgttagtttttgagggtttttggtgggttttttatttttggttcagcacttccccacctaatcccaattaatcattaattatgttgttagttaagaacactgggctgggcacggtggctcacacctgtaatcccagcactttgggaggccgaggtgggtggatcacctgaggtcaggtgttcgagaccagcctggtccaacatggtaaaaccctgtctctactaaaaatacaaaaattagccgggcatagtggcacgcgcctgtaatcccagctactcgggaggctgaagcaggagaattgcttgaacctgggaggcagatgttgacagtgagctaagatagtgtcactgcactccagcctgggcaacagagcaagactccatctcaaaacaaacaaacaaacaaacaaaacaaaaacacctatacttgacttgtggctgtttattccttttctagagctatttgttgtctgcattatagagaactttaaatatcaaagtagttattcctgaactttttacttgagtcaaataaacaaaatgcattgctgctttgtgctttatgcagaagaccttctcctggtaaggagacagtttttcatattatagccagcaattaaaaccacatgagataggaagaccttattctaattctttctgagcaaaatacttgcccttaatttattatttaataaacacatatatagcacttaccatctgccaaattatttatattcttttaaatattaaccaatttaatcttcatagggactttctgagtaaagaactatgaatgttcagccgggcgcagtggctcatgcctgtaatcccagcacttcgggaggccaaggtgagcggatcacctgaggtcaggagttcgagaccagcctggccaacatggtgaaaccctctctctaataaaaacacaaaaattagctgggcacggtggcaggtgcctgtaatcccagctactcgggaggctgaggtaggagaatcacttgagcctgggaggcaaaggttgcagtgagccgagaccgtgccactgcgctgcagtctgggcaacagagcgagattccgtatatcaaaaaaaaaaaaaaaaaaaaaaaggacaactatgaatgttcctgttttacagatgagaaaactgaaatacatggaggctacataacttgtcagagatcactagtaagtggaagaggtgggatttggacccaggtagcgtccatagcttaatcagtgctctctcagtactttttggtcataactcttaaataagtgtaataataataaaaaataataataatgtctgccattcatagcattgtacttcttctgcctttgtagtgtagttcattttgaatcccagatagggactcatagatttttttctttttaatatttaaaaaatctcagatttgttgacttaaaatccatatagttttttttttaaatgtggacctagaactgagtattattgggggaaaaaaaacattgtaaattagtaagtagtgtggttcatgggatcatcaactgttagcgctgggaggaatagtatttttctgacccattttattttgggaatgaagaatctgaggtgggagaatctctggttttatacaacagtaggttgcccatggctttctttctgaggagactgggggagacacttggataagagaaggacttctgtgaacaagggggtatgcttttctaaaaatgatttgattaatccttgaaaatatccttctacgaggcacagagggaaatcctccctacccccgaataatgcacaagaccttactggtctacaaaggtcctgcagatagaactaaggacaagagaattcctatgccgctgtaatggcctacataggaaaagcattcttcttgttgttgaataagaaaacataacatcctccagatttctaccagtgtttttcttatgactggaaatagtaagtagaacaatgtcatacttggacaactatattcaaactggctaatagttttgttaattgggactacaaatgagaaatagaagtcccatgatgacctagtccattgaagtgtcaagtttaagtctcctagttcagaatcaaagggagcagctatagggtgagaagcaatcgcgtccataattccgttgacagcagttttcttcgggctttgattcatagctcatctgctccctgctgattgccctgagctcagcaatgccatgctggtttccatggtgctgatttgcataccaaaccaggacttgtatttttgtgtttgcctcacacatttccagtgctaagtgttcttctaagaaagggattagcacgctagccaattaagggagtttgccagaaataaagcacccagggaatttttcttcaggttatatattgctactgctatgcctaagtactgatatggttgattggttttcttaggtcagcaatgagtcttaaagataaaatttctactgtgtaatctttagtgttttcttttttttttcaactatcttttaatcagtttcaaacatttcagtgattaaaagagagatttgttgtggttttgttgtggagcagaaatggatttcaaggagtttaccttcagagcttttgtttttgttacggtgggtctctctagtggaaaaaaaatttccccatccctttggaaatattttctttaaaggaaatcatgtttttaaaacaaattatcgaaatcagctttctaatcaatttgaatcatctgaacaaaagctggaaaatgtttagttgtaaatttcaccaatgaatactacttagcaacacaaagttgaatgaagttcaactgttagtcccaagcttatggatcaatctcaaaacatgatgctgagtgaaagaagccttttaccaagagtatatactgttttattgcatttagatgaatttataggacaaaccaaattaatctatggtgaaaaaagaaacagcagttgcctctgggtgctgggacagggatggcctggaaaggggtatttgggggctgtctagggtgatgaaaatggtccattaatcatcatttatcttttgtttgttttgtttaatttccatttttattttagattcaggggttacatgtgcaggttggttacaaggatatattgtgtgatgctgatcccgtcacccagatagtttttcagtccttgaccccctcccactctccctccttttggagcccccgtgtctatcgtttccatcttgatgtctgtgtttacccaagattaactcccacttataagtgagaacatgtgatattggttttctggctttgtgttaatttgcttaggattaaggcctctagctgcatccacgttgctgtagaggacatgatttgttattttttgtggctgctgcatagtattctatggtgtatatgcacccccactgatgggcacctgggttgatgccatgtcttttctgttgtgattagtgctacagttttatactactctcaccagcaatgagtaagctttcccttttttctacagcttcaccaacatctgttattttttggctttttaagaataaaaaatggtctatattttgttaggagtttaggttatgtgtgtgcattcatcaaaacttgtaaatgcccacttgggatgtattcatttcactgtatataaattttacctgaatgtaaaaaacaatctgtaaaaataatgttcttcattgtaaaatctagagtgatcgttatcaaagacttagaaaaactagaaactgagaaaaggtggtatgatttgtggcagttcaattggcagaatttagaaatcatgaatagatatgtttattctgctatttcaaatacttatgtgaatctctagagccatgtgggaagatatctgcttcctgaagctctgcattcatttatagttttatgtggtcagggaggatttgattgagttggaaagtggatcatttgtacttcactttgatccatcttcctttttagaaacgagagaaaaggcatctgtgattgtgcctctgattgggtggcatccaaaatcttgtttctcagggtgagcttagggttcatctctattaaacgtatcatttgtcagacattggcatgtctagtgattcggaaagcccttggagtagcacagaaatgctatcataactccggagtgatcttttgcccttaccagtactttggcttttttaagttgccacttgaacttgggtaagaggccaaggaggtggtggctgaggcagtcaaatcttgtggaatgtggctgtcaattgatgccctaaagttaaggttggtctgtattccacaattgacaaaaacacatatacagttgtgggcccagaattggagtgatgagaagaccttgcataatgtctacacaggaggagagcaagcctttaaactccaactgccttgtgaatgttcttctcttttgatgtcccctcttccctctcactgctcaacctctaagtccatgctgcttgcatatacagataacggtgagttgcagatgatattataggtggcctatccagatccatgtcacctggcctgtgcttttagagccagctgctgtgaggattagttgggaagactcacagctgccttcactctcagagagttatccttgattgctggaagttatctagccagggttggttatagatctacccacccaccaatgacatcccctctccccgcctcctcacgtccgcttctcaagcgcgcatacaattcttctaccccgcaaaagcctacaggactatcccattcccacagttaggaatgactccatggtacttttcatggtccagagctctctgtgggatcaggccaaaaactgcactttatttatcttcttcatgaagatggtgaagaatctcaacagaccttcaaagagatcaaggcttgcatctaagacaggatcaatgattgcctctaagaagaaattacacctggatatttgggtacctgtaattaggtgttggctatgttaatgttttgcctgctgtgaagctactgcatgcggtgcttgggtagtgccactcttcttacatgaggcagaaccaagaggaatgaccctcccacatagtaatgaaggggaaaaaacaaggcaaagcatgtttatttttaacattttgctcttcttaaaagggcatcgtttacacccattccatctgtagaactttcaacacaagggacacatactgaagtaatataaactctgaccttgagttattagaatatgccagagactttgtagttcctgagagccacaagcctccatcttttctctatagaaaaaaaaaaaggcttaaatcattggtcagctctcctgtgcttgaaattgtcaccgtttgaagagtggctgtccttttcaaaatatttggcattatagagtcacagaaaaagtgttaactattctgtgcatttacttatgttgaaaatgatgtcatgtatatttgtatttaataaaatgtgaaaggaaaggaaaataagttcttttcaaaataaaattttggtgccccggaaggtttctcagcctgcctgcagcatgagttttacttaaagcaaaaagcactagcattttttttaatataatgggatgcaatagaagataactatatcaatcacctatttgtaaaatagtgctgtgtaacaaactatctcaaattaaaataattaaattagctcaggtatttttagtttgtcaacatagactgggctcagctggcagttcttctggttctggctgggctcgcatgtgcctggcagctggctggtgtttgagatgatggagacaatgaagctacatggttctcattctccagcaggccactctgagcatgttctcatggtggtgacagaagagcaaagatgagagcaagcaaggcacttacaccctttcaagcctccacctgtgtcttacttcctaagatcttattgactaaagaatgtcacctagtaaagcataaggtcactgtaggaggtcaatacaagattaatgatcaaatatgtgaatgctgggaggagcaaagaattggacacattgagaaaatctaccttatacaagaatatacatacataggaaattttattaagtgaaacatgaaactcactagctagaaccccaaagctacaatgtacttcacattttctctctgttttctttccagaatcttgctcctactcactgaccttgacctttctcattttgaacacttcatttctgtttcttggaatatctgtttttcttttctatccaaatccaaaatattcctcaaagcccagctcaagtttatactttcctggaagcctaatatctgtgtcattgttcaagtttgtttttatattactttatagtcatgattatttttatctgtataacaatgtcttgttgcttcaatgtagtctaagctccttcaagtaaggaaccatgtcttatacttacttgactctcccgaagtaggcttattgtatagtaagagtttaatagtaagttgattgacaggtagttccattttcaaagttctatgctaatcccttttttctttgtctctgccaacattatcttcctctacatctgagatggcatctcgagagtcatcttcagtccattagtaacagctgtcttggagaattatataaagaacaactctagccataactaggaaagttggaatgagagctaccatagattagtaatgtctgccataaatagaggaaggggataggccattcatatttactaccaaaatagttcttaattttttttcggagttgtatcttatcttctaagctcagtggagaaatagtaatgatattcattgaagggaaatgatagtgatggcaaaatatcagaatatatgtaagaagccatatattcaggaaaaatcacttaataataggcagtattatgcccacagaagggctttcagccaacagacttgacttcaaattctggttctgctgattactatcactgtgactttaggcaagctatataacctttgtctgcctcagtttccctatgtgctaataaatggcaccaaatgagggttgttttgaggacttaatgaattaatatactcaaaacgcttagcatttgtcttggcccatagtaagcactgaataaaatactagctactattttttattaagtagtggtaaaaattacaaataggtaaaacatacctttaaagttaagatacaatgtaactcctccatttgaaatcttagatgagggcagttgatgagaggaaggggaggtgagtgaccctgggcctaacagagagctaggctattcctatgataccaggaacaactttgagcaatgattttgccagctactggcactttatttcagtcatatttaattagagacacagagccactaatcaagattggttaccggatttgaccttatgcaattgtggaagctattaaacagtccctatgagtctgtagtcttcacatctgaggatggagctcaaagccaacagggaaggaaggatggatataaagtgggggagagcaaggcaagctgggctcatgagctagagccagaccttaggagaacagactggaactcaggtcagttcttacttcttccatccttggactaagcagggatcctgtaggagaagctggctccttcgtcatggagctgaacatatgtctgaccgaggaagtaacatatatgtagggacagaaaagggtgaagcaattgcatgcaaaataagtgagccaccaaaaaagtgacaaagggcacctgccctgacctgagtgggaagagaagtggggacactttagtttgtttttccagattttctgcaaaatgtctcttgtggctcatggtaatcataaacagtgggaaatcttgttaaccctagttaagctgacacattttgaagagtcaccatactcctctagtgaccatgtggtacaacagaaagagaaataactggccttcaagtcaaaagatctggaagtgtaaccttggccaaaatcacttaccctttctcacttgtgttcttgtgttcttagttttcttatgtataaaatgagggaggaaggtgggctttttcatccttaaggtcccttccagctcttagtctgtaattttgtcaccttactgcctactttcattaagtttcttgtgtctgccggtcttgcttacatatttcctgctattctgccccaagacagccagccaagccaaaatgagcgtaggcaagggaaagaagcctgagtgtttgcctaaacacttagggctgctgaagtcagatgctgagggcaaagggcaaccgtaagtgatggaattaaatgtttactgtgttaaccgttgaccactcatggatttcagagaaagctgaccatattgattggagttttcactcctgtttttctaatgatatgcaatcttaactaaatctgccagctctcagggggttgaacgctattcagcaacattaatttctttgcctacttccagttaccagcaattataatcttggcagttttactcaccttgaataagcacttgtatgctttattgatatctggcagagctggctccttccatgcaaagacccacttatgtttctgacactgctaactctacaaagcgctcaagctgcagatcaacatttgttggacattctgggggaagatgttatttctgaatatggcaggacagaaagttccaagaaagctcaaagaaattgtgtttatatgctcttagacacatttttttccatcccctcccctcaaaatcagtgaatgagccagtcctgaaagacacttggcacagtttcacagtctcttattgacaatttccttgctgggaattcacctagcctggagagagcgatcttgcctgtaatgactccttctttatagcatacaatcaattagtgcttatccaatatttaagacccagcccctcacgccaattcaggacagttctgttggtcagtctcaacccggagttcccatgagattggccgagacttctatggcaactgtaacacagccaaacttctgcttttaccccaactactcccttccatagttattaatcccagaactattctctaataaatgcctatatacaaacccctatctccgggtttacttttccaaggaatcagtgatataactgccatgacaatgaaagagatcaaaatttgggagacagaaagacgaggggtgggaagttgaatttttttcctcatttataacatgatctggttgggaggattcaaggcagaccagttagtacagatccccagtcccttttggggatcataggactcttgttttatcccctcacggcatttatcaccttctctcataaaaaatttatttatttattatgttttatgttgtttgcctactttctgtctatacccacccccggcccagataccctcaaacaagaaagtaaaacccaccaagatgaagttctttggtttgttcaccagtggatttcaaacacataatagatggcaataaatgctaagtgaatgaatgaatgaatgagtgaatgaatacagtcagggagaagagctgggaggccatgacagtaatgtaggtgagcagggatagaggctgaatgacatcaaagaatggggatgagaagtggatagagtctaaggttttgtggataatagaatgcataaaagtgctttagaaacacataaagttctcacacttgagggtacatcagattcccttggagggcctcttaaaacacagattactgggccctatccccagaatggatgattctggatgtctgtaatcaaagtcccgtttgggtcattatttattttagcaacatccaccatcatagattgtgagccccatggtaggaggggctgtgccactctgatcacacaggctgtctttcatcactagtggagtgtttggcacaagctagtactcagcaagatttgttgagtgagtaatttacacccccccatccccccgacacacacacacaacaccatgcaaatctatgcaatcagggcacttgcaaatccttagtattatcaaaagaaaaatgcaaattctaaggcattcttatgccccagttttgaccagaattgacctgtgaagatgagctcaacatccaatccagattattcttagtgctgttcagagtgggaggatcaacagcctctgctggtgtatgctctcactaatcattatccttatttccagttaataaggtttttgtctattttattcattgtagaaataaagaaaagagttagtgttgaccttgtaaccataaagcttcatagttttaaagtcaattattaaataacccattcatctttcttcttttagtttgtttgaaactctctttttttaaaattattttctcctgggcactactggcaacatttatttttcttccattgagaattcattaagaattatttcttttcttttttttttttggaaatttatctaacatctcaacttctttattggaatacagagaccaacactgaacttggaattcataagtaaaatggcagttacaaccagatattatttctcttaagccttatctctgtgatgcatcctagtattcataactaggtcttaatcaaaaaattattttgtaaatttttagacagtgtatgatgttatatgacttctaggacttaaaagtcttttgacttttaaaagtcagagatatgtattttcctttttgaccttacagtctaccacattcattattaattcctaacctgattttctagtgggagaagggggaggaatgaaactttcaaataatgtaatgcacctgaattaagaccattttgactagtcaaatgcagatatgcagatattttaggccttctgaacctttcatttcatagaaatagaaattgccccccccctttttctttggtagtcatccagcttgtttctctgttgtacaaataaaacagaaattaggacagcgctgagattgttttattcatccctgagttctcagaggttagcacaataccttccacatagaagatgcacggaaaatgtttgttgaatgattaccaataatgaagttttattatcatttttatccaagggcactgtatttcattctgtctatacccactcctgtgtttattttttttgggttgtgtgacaatattatgttcctggaaaagcaactaagaaaaaattgaaaaaataaatgttttcagtgggccaataagatggttacttttgtgcatatttttgtggtctgatgttcaaataatacaatagtcagagaataaaatccttaaaaataatgatttataatctattaagtgtcaaaagtgagagtagtcatcccttcttacttttataaaattgtcactcttttttgtttggtaaaagtgatatctttttaccagcccttccaacagctaattccttccactgccacttaaagtagtctgtgtttagctgtattacatttatacctactcaacttatcttttagtaatgtagtgtgtattatatataggcacccatacacatatgtttaattatgcaatgactgctttcttacagcttctaggacatgggtcttagagtcacaaaacctagtgttgaaatcttacttctattattgcatcagttatttactgccaaataatgttgcataactaattactcccaacctcagtggcttacgataataagcatttatttagctcatgtatctgtaggttggaaatttgagtggggatcacctgggcaattctggtcttctgggctggctcactcatatgtctggcgagtagctgacttctgtgatggggtgactgggtcatgtgtctctcatcatccagaaggctagcccaagattgttcacatggtcgctgggcagggctctgagagagagtggagagcatcaggccctttgagacctaggctcagcatgacacactgtcactctggtgcattcttggcaaagaaaaaaaaaaattgcaaagctagctagaatgaagactccactttttgaaggcaaatggtgttgagtacaagaaggagggggtgacttagggccatctatgtagtccaccagagctattcacaagctgacttggaacagtttattccaaccttggctagataaacaaggagagttcatgcttttctttttcttattgtgaccccatggaggtgcattactctagtgaaataaagattctccttatttaccaccaagacatgggagtgaaccagcatacataatgtcactatccaacactgggaggaaaggagaagcctcttggggtggggggaagggggagggatagcattaggagatatacctaatgctaaatgatgagttaatgggtgcagcacaccaacatggcacatgtatacataagtaacaaaactgcacgttgtacacatgcaccctaaaacttaaagtataataataataaaattttttaaaaaaagaaagaaagtgtttagcacgaggttttgggtgaagaagatgagacatgtgaggtccgggggcatggcattttggctgcctagatatcccaggatttaggggaatgcataactttctcactaagtatatgatgaatgagtaaatatgcttctctatatgttgttattgtgttgttgttaataaagtgtgtttttcacactgtaatctttcagagtaacacagactcatatacatatgaaattgaggactgtgggtatcaactacaaaacatccacgtaatagcagttaatactatttgttacatgccagactcagttctaggagctcccttctggtaacacagttaatttttaggaggtaagtattaggtaatataaacttccctattttggagatgaggaaattaggttcctagacattaattgtgtgtcccgaagtgacacagctaataaatggcaatggcaagatttgccctcaggcaggaaagctccaggctcagaaccctaaacccctattctacagctgtggcttcagttagggtttccatatgtggtcactgttgtaattctggctttcttcctttgaaccaactctcaggaaaaccaaaccatgacttgcatgttgttccatgggtgtttttcatccttctctggctttgtcttgacaaagtcatttggtacatatctaataagactttcctttgccatccattcacgtgtcatcaaggaatgcaaaacagttttaatgcaaaatacttgtaatattaggacagaaagaaagaagaaagaaagaaagaaagggagggagggagagagggagggagggagggagggaaagagagagaaagaaaagaaagaaaaaggaaagaaagaaagagagaagaagaaaagaagaagaggaagaagaggaagaagaagagaagaaaaggaaggaaggaaaagaaagaaagggaaaatagaaaaggaaggaaagaagaaagggaagtaaaacagggagggagataaagaaagaaagagagagaggagaaaaaagtataatggattccaatatttttctgtcatcctcaatgttcggctcatactctgtacttctgtgttagcaaacataattgaaataaaccgtttaggtagtaagctaattctgcagcattcaaaaaagacagcgtgcaatactcacaatttgcaaaactgttctcctttttttgtttgcataggtttatacatgttccctttttatagcacaatgtaaacacatgtgagaaaaactgatttgaaatagattttaaaccaggcagcccttttgctgtttcctaattggtattcatcatacctcttattgttgtgttctaagcatttcgttcatttgtttttcagtcctcagtttcctcatataaacttccatgatctgctgcctaagaatttggtatctgttaatgaaaatcaacttttaaaataagcattcttcctgccctggcaattaggagaacctttgaagacattgggggagtgatatgggtcctgggatgggaacagtaggattctgataacaagccaaagagatcagaaattcctttaagtattttaccggtaccccatagtcctcaaaatcacatacacaaaatatcatgggtacagatcaacaacaaacttagactggctttataacagtgcaaggtctaaaactttgttaccaagtcaccaaaatattcccaaataagtaaaaatcccacattaaatgccaccatcctttgtctcctctctcccccgcattgggttctggaggactttggtcatcatagccgacatgtcagtgtcccctcgatagacattcccttggcatgcagtatatactgctagcatcttgttataagtacctgtggctttctaagagatttctctgggttccacaatgttttcagttacatgctgggcatgctgaaagtatcaaggaattaaagcttctggaagcagccgtccactagttactaagggatttgatagaaaaataccccaggtccatcaggttttagtaggggcggatctgaggcatgttctcctgatctagaattccccagcagaactgagcccccattgccaacaatggttgcctatttattaatattctttattttggcttctttctcttcattgtcttgtattcctgctcacctgtcattgcttcctggggttcctttccccagataatctccctccacttcagctctaattcagtgtgtttctgggaggactttatagaagacatctaccataatattacaaaaattaaattactgaagctattcaaattattttctgatattttcattctgtccttttcttacttctatcaacccatccccatgtgtcttttttccctgcagtccaagattatttagccccatcctacaaggtcaagtattttatacaccagctaaggagtaaagtgtaaaatttttaaaaaaaatcagtaggtagaatattacactggaatcttaatagttcttgctgatagtgcccttaaggttaaaaaaaaaaaactcattaaattccaagagagaagatggttataaaaactgaatgaaaagatagaagttattccacaagcatttcttaaattagtttgttaagagccttagatcatcagacatcaagtagaaaaacacttatccaaatctacagaaagcatttctcagaaagtgaaagaatgcagaaatttacttccaaagttttgaattaaacatgacagaagaaggcatcaatttggaaaactttctcagaactctcccttgcttggtagagtgggcagcttacttcatctgtcagaggaaaggaagtagctgttactgaccagacgacatgtgttgaattgtttgaggctgtaccgcatgtcaagctttgacagaactgacataaaaaatatacctcacattgtgttagaattgaagagaacagctcttgttcattagaaggtgaggctcttcaaagaagcttcctgatgcagcccgatctccagctcacagaatgaaaagggtttcctataaatctcagttaactgattgctttggagacacagtcccaagagggatttgaagccagcataaacttgattatatgcacagcttgcgggatttggtcattctctttctttcggatatgttttgtgttctttctaaaatatagtcagtgatattttaagttgtttataaggtatttataggaaaatttatttataaaatacacaatgttccaattatcaattgctgtataacataacatcccaaacttagtggtataaaacaataaccatcatttgttgttattatctattgtggttctgtgggtcaactagtccaggctagataataatctttccacgtccctcaggaatctgcattcagaggatgcctggggctagagcatctcaaaagcttccttccccactcacatatctgttgtcttgtctagggagacccaaacagctgggcattggtgtctattcctataaactctctccttatggcctctccagcaggatggattcaggatagtagggcttctcattcggaggttcaaggctccaaagattcatgtcctatgagggagcaccaggcaatagctgtgttgcccttcacaatctaggcttctctaggttagaagcaagtcactaaagcagcctatattcaaggaaggggcatcgattttacctcttgatggaagaattgtcaaggaatttgcagactttttttaaccattacatttaatgattacctttcatcatcatagggccttattggtatttgcaagcctagttcacttaacctaataccatgcttagtcattgccaaaaaaaaaaaaaatctggctaatttaatgtatcaacaattataatatagtgatgcttttactaatttttatgctctattcaactatcctttaaaatatacttatctagagggaagagttaagtgagaaaactgaagatttagaagtatgatgttgatttctaaatcaagaaaaacatatgtactattgctttttcactgaattaaactgatttttacagagtgactgctataatcataacactgggctagactactgtgattaatacaggtaagtaaagacggttttaaaattatgaacagaacttagtcctagttcacagtctctaaactggtaggggtgtgtgtgtgtgtgtgtgtgtgtgtgtgtgtgtgtgtgtgaaactacgtgacaaggattatttacacaccattatagaagtcacactaattaaatctaatgaaagacatgtattcagttttgatattttccgtaagagtcaggcaaaagttcccaacaaacttctaaatctataatcaatccaaaggaaattataaacaataggctttgtatagagagagtaggtggatcatattaggcaataatcacatagttgatttcttactataaattatgatttatgtatcataaatagcatacaaatgtttgttaaatgaatgagatcttacaaactattactgggaaaatctttaattggcagctcttctctgatacggggactccaagggtccttggaacctggggactggggacttcctgattattttcaagtagaagtgtttgatttatagttgaaagagaataagaccattaatgttctctcattttttttaaataaaagtgtaagctctgccaaggggcattttctcattggctttcagtgttattttggtctcatgaattcataaacatcagcatctctacctatttccaaagaaaaaaaatttacttatgctcaaatccttgtcacagccactgcttctagggaaacataaactaaggcagggtgattgcagttctgggtatttgaaagaggttcttatggatttttccatgtgggaataacgtctaagtaattttccaagaatgaaaatactaaagtttttgataattaaagatactgacacagtacagacacaaacaggtttttcgggtgcttttcttgtgaagctttgcatttaaactgaagttttattcatgtaataatcatgcccctactattcgcaggagtaggaataatgggagttaacaggtgaggcagaaaagaaaggacatttcagagatgctctgcaataaagaagtgactgaaaactatagcactggtttttcttggttggatgaattaatgcacattctgaaaaacagtgttttagatttcaagttccaggtcttccagaaggagctatcatctgagctaagattgatgcattctagaccattattctggactcttctctgataagcccatgagataattttgttgaggtgtgatcatcccagcgttttagttatgtttcactggaaaatttaaaatattttaataagcaacatttgtttgggagagatacactgtccctgaacttggcctactatgatgggaatcctctgttctgttcaaaggcagttttctcaggcacctatggagtcagagactgatgtgacacttaagtggtacttactatgttccaggtactgagctgagaaatttatcatgtattaattcatttaatcctcacagccagccatttaatcatttcatctattttaaagacaagggtcaggaaggttaagtgacacgtgtaaggccacacacatatgatttgctggaacttggattcaaacctgtctgtccttagagtccatgcttttgtgagactccacctctggctgttcctgaggagttcctagttaagcgggaatgggggtgggcaagccagtgatgacagggttaggtggatactggaatattcaggaagtgccagaaagtacagaggatgaaaggcttgacttcaccttggatatttaaaagctccagaggacaacaccttcatttgaattggaaaggacatagcccattggaaaacttgttgtttccagggaacaaaacattttagactattttgaaaatctgtatgaagctacaagtacttgtatttggttttataatctaggtaacagtaattaaaagttgattcttttaaaagagatttacccttcgaggttgtttaagtaaatattttgctctctgttaagtgttcctacttggaagtgtaaatatctgcaaatgtgtttatgtgagtcctctaacttcagaaagagtcctaacctattttcttcaagctcttcatactaaatattaattctctgggaaattatatagtgatatattgacctctacagaatagattcttcatataaattaaactatgtggtttaattttctgttgttactcatttctttagcttgtgagtgttcacccatgtcctgagtgtaagattgtggggctggaaggtttgcattccagcccagcgcttacagcacagcacaagctgaaggccaaagaataggcgattttcagttgtttttaagctttctaggaatgataggttatgatttcccttggcctgtgatttacctagtttcataaaaagtatattttccttttttatgactgacaaaattgttcctagtgtaagttacctgctttttccgaaaagtttgttggtgacttagtttaactattaacccatgaagtctctgaagcaacaaatgcctattattaatcatgtattttgtctgggaaacccccaatgtcttttacttttttaaaagaaatatgtataagtcaatgccagattgcatcctcactttaattttacttctatgaccctccagaattttctcaaaagtagacctgcttattgggtctgaaacaccacactgaaacagatgctgatacttgctagaatgttgacagggctgctttcacagcgtccaaataaaactgacttaaactagatggaggttttttgttttttgtttgagacagggtcttgctctgtcgctcaggctggagtgctgtggcacaatcatgattcactgtagccccaacttcctgggctcaagcaattatcccacctcagcctcctgagtagctgggactacaggcgtgcgccaccatgcttggctaagttttgtattttttggagagactgagtttcgccattttgcccagactggccttgaacttttgagctcaagttatccacccaccttggactctgaaagtgatgggattacaggtgtgagccactgtgcctagcctgtttgtttttcatattaagttctgaaccagagggcagtttaatgtgaccctactccatttggttgttgaggtgtccaggcttcttttatgttgttccgccatatgctaaagtacttgtatgtctgaacatgggttacagcaccatgtcctcattccagttgtggggagggagaagaaagtgggaggaaatttttcccttgaaggacataatgcagaactttcataaatcacagatgttcacattctattttggccagaactgagacagatgcccatgcttagctgcaagggaagttggaaaatgtagcttaatgcaagagttcaaccaacagactcagaagttgctcttgccaaaacgaagaaaggaaaacctgggtattggaaaacagcctctgccatagaaggcctctaccatagaaggcttgttagcggcctcttccatagaaggcctgttcatcatagctcagttcagaatatcagggtcttcctaaatttatgtcatgataattctaatttctaatgtttaagttaacttttagttcacttgtgccttcaggtagttttctgagggttttctggctgtcaatttatttctcacattgttgaaaattatgttatcttctagttgccaccatagaaaattaattatcttgtagttcatttcactaactacaaatatatattatataatgtgtacatatgtatagttatatatatatatacacacacacaaattagtgttatatacatatacagtaatacacatgcttatatacatatatgcacatatataaacacacacaaatcacacaaatgcaggttgagtattctttatctgaaatgcttggggccagaagtgttttaagattttggattgtttcagagttcagaatatttacattatactggttgagaatctgtaatccaaaaatctgaaatgctccaatgagcatttcttttgagcatcatattggcactcaaaaagtttaggattttagagcatattggattttggattttcagatgagagatgctcaacctgtacatgataacatgactaggggtgttttttttaatattttgttcaccaaatctttttttctctcatttgtcttgctgaatgcctttatcatagcttaaatttgaattttctgcttctgaacagtgcttaaaatggaaagaggaggcagatgctggagttgctggtatctgcagccagcttctcttgtcgctgtgttggcttttcttaatttttaagcatatgacatatgactagttgttttttgttttttggttcattgcctgattttggccctaactattccattttaattttagttatcctgcatcatttctgtaggtgtgttttatttgttatttctgggtgactaataaatatatacatttatatattattatatatgaattatataaactttacaaattaaatgagcatgtatatataaaaaataatagcctactgccactctaatatgcaactttgggtatatgaaagttgattctgttttgagtattcatatgctctgagacagatgcctcaaaataagatacctaacggagtacttgctgctctaggcttctagaggactccctggggtgaggattgttcagaaaggaaacacggaacataagcatgatattatgttatggccaactaattagacatctagtcaattgactaacaatgtgtgtgtgagaccctgtgctgggtacagagtcagggaaaagctatcaatcctgaatagccccagtatcttcagaatcaattactgatgctaacaatatcttccagtgtcaaatgagaatacaagatgcacatgactttcctaactaattactatgactcaattggttagtttgaggaggtcttaaatgacaaaatttaattctgtattcctgtatatatagccagtattttataaaagagaaatttggtgaaatggttctgtatgtgttgctatgaattgaaacaaattccagccacttgaaaagattttttaaagtcttatttgcttttctaccagatgtgcttggaagtgagtgaaagtctctcaactagaactgccaggtctttgagtataggtggcattttgtcttagcctaaaataaatactttttttttttttttttgagatggagtcttgctgtgtcacccagtctggagtgcactcctagcctccagtgatccacctgcctcggcctcccaaagtgttgggatgacaggcgtgagccaccaaacctggccaaagacttgtttttatccaccacatctacagctgtttggttttttctgtttgtttgtttgtttttttgttctcatccctgcattcagacaatcaaaatgttttctcctttcaatttccagaaaattacaatgatccaggttcttcgctgaagctaccatatctttgtttcttgtgcaatgataatgtcactgatggcataatgtcttcctctgctagtggagcctaaagcctgatttccaatgaagcttttcagcattgctctctttctaaaatcctcatctgacgtgggctgtggtttgcttttagagtttgcttcagagtccacctatgcaattctcagagcactgccacagcatgttctgaaatcagagttgggtctgtttagtctagcaacctcatgaggaccccgtcttatgattgcatgaactctcctacacagtagaaatgtgtatttctataggcgttacttaaatgtttgcaaaggagctgtgtttcagttttccctcttgtaattaaatgctgacatattttgcaattgaaaataggagaaaataggtaggtggcaagacggtgttcaagaataattctttcctcgggcaaaaaccactaagatcaagattccatccccctgattcttctgcaaaaaaatgtaggacaaaaccatggggccttaaaatgaatgagaacaataacatcgaatcaataataatagctatcatttataattgcttatcacgtgccgggccttgttcttagtactttacagtgtattaactcatcgtttcattatagacaatgtagagagcagatattactctcattttcctttttagattggaagctgaatcagagagaggttaagcaacttgcaccaagcctcacagctgtaactggtaaaggtgagggtttaacccaggcagtcagattgcatataaacactcaagaagctgcattttatagccgtagaagagccatgctgcattgataaaatgtgctccttagcaggcgctcaaatgttacaccagctcactggcttgagtaatcagtcctcctttcactggttcagttgcatcagacgagtgttcatttttcacacccagcaaccactctcagttcttaattctgatgaatgcatgtcaggctatggagctttcttgtttctgaagaagttgttggctcaggattcctattttcttgatagcattcaagggatcctgcaaagtcagcagagtgttctacaagtctgctttgaggacaaacttattgacatgtaacagattctgaagatggtgtctggacattttcatgccatttgttgctagttgagttgaaggaatgctgttggcacctacaacattagcatctacatcctttgctgtgtcataaaggatagatgtaaaatacaatgaactatgaaggagggaggtaggaagtatgacatcatattctctcagggcataaagcagatttacagtgtacattgcacatttaatatgcacaaagcgcttctggtacatatgaggttaaactatataaaataccattttggtaagtcaaaaacagtggactagcagaaaattcatccacacacatgcacagatatacacagactcatgtgtacacactgcactgtgtaaaggtatttatgttgtcactttagttaataaaacaaatagacaaaggtcaaaattacccagtggaattgggcttaacctccaaagaacaataaaaccttgtatgactgaaattagaaagtggtctgaggacccattcttaaaattctatcagaaaagaatgttttacagacaaagacttgcttttggaatactatgcctgctaccatattctcaaggcaaaattcacacattgaaagaatgagattcaatacgtgtgaagtttttttttttttttctatgttcaaatcgggagaagggcattatccaaagctgacatattgaggtttctttgttttttgttttatgccagtctgctgaaggcaaagccttttctcttggcaggctgatgccttttgcaaggttttgtggttaggggcatgcctgtgctgcagtgatgtgagcagtttatcagcaccatttttctgacagaagttactgaagcatggtgtctgagtccaccaaaccattacatcttcagttacaaggcacttcactaaaagagtggctttggaatattttgatcctaaacaaagagcttgttgttaaagtggtgttattttgttttattaaagaaatgagggcaaatgctcatagaaggtggaaactcactttcagtttgggggaaatatcccttaaactagaagaggtatatggaagaacttgacaccttactaacaggtattctgtggattttttgtgtttgcttcatatggcttaatatcacttcactctgcagaattatggaatgtaaggtaatacacatcaaagcagcataggtaagacaattggatcgagaattagcaaatgtaggatttaggcttatgtgtcccatttaaccatggacttttctggacttttgtctcctcatctgtaaaacaagtgattcaagaccgtgaactggaagatgtgattgggtgccgggtgtctgttcttaagagactctagaatttctggtcgctgaactggcagaggaacacacaaagcatttgaccttgctcccatctttcataatgccttgtgctgcccttggtatttaaatgaacatgattctactgacttgctgtcagcgggacttgcactttgggctgctttccagcagtggggaaggatttgggatgattcatcgacacttgctttcccagatgcctctgcttctgcattctactgtcaaattgagcaaatttgccaaagtcaatgacagattttatttgttccttgcaaacaggctaaggtggaaaaacctaaatagatcccaaaatacatagaatttcaatgtgatgtatattaaccagaaaattctgtaaatgtatagattaagtattagttatcacttgtggcatattatcaataatcaaaatgtactggacactattttaagtgctttccatgttgcatctcatttaaacttcatgaccactctatagtgtggtaactatgattatccctagatgagaaaatggagatgcggaaagactaaatgacttgcctgagattacacgtagccactcagtggcaaagccaaggttagagtagtcagactctagtgacagtgcttataactgctacattgtccctctctttggctaatggtgctccctacctggcttttgaggcaggaactctcaactcatagccagagttatggagtctagccctaggatgtcaacccaagtcagaagaactatttgtgtgcaaactttaccatgtataagatgtgaaaatagcacatacatgattagaatcatacttgcttaacttttaggatcttatttgactaaaatatttatgtagctgctttggaaggtgcatagctgtggcacagatggctagctgatcactaaaaatacacgtgccttttcatggcatagggtaattgctggcaaaagtcttctcaacgagggactacgtgaccatttctcaccaataaaatgtgaggagaagtgatgtgtgtcacttccaggatgacatggttacagagatgcgctttcctcaccatcctttccccagtccctgattgaatggagggaattccagtcatgtgctgaagattatggagccaaagacattggagcctgagttcctcaataatcacctgcaggaaagccatctgaccatgaatacccacattggattttcacatgagtaaggataatcttgcagtgaattaaggcactgagttctgtgttatggcagctaactagtgccaaaagtaaaaagtgttgttgctttcatccaggtggggattccatgaatgtccagctttttacaatgctgagtaagtcattgaacttagcagtgtctcctgttatgttttgataacgaaaatttttatttcatggcctcagagcaatgttttccaactaggggcaatattgtccttatctccaaggaacatttggcaatgttgggagacatttttggtggtcacaacttatgagaggttgctactaacacctagtgggtagaggccagggatactactcagcttcctagaatgcacaggatgtactcttataacctaaaaagcatctggcccaaaatgttgatagtgctgaagatgagaaaccctgtcttaggagcatgtttgcagccacagatgtgagcatctttactgcattcttgtgacatgtagttcaattcaactggtagagaccctgtgtggcccctgctctgcactgggtcttacttactggatatatcattcagggcacatattctttacaacaagactgttttggttctcaattcgcattctgtggtggaataaacattgagtggaatagaaaacattagctttgggcctggcgcggtggctcacgcctataatcccagcactttgggaagcggaggcggacggatcacctgaggtcgggagtttgagaccagcatgaccaacataaagaaaccccatctctactaaaaatacaaaattggccgggtgtggtggtgcatgcctgtaatcccagctacttgggaggctgaggcaggagaattgcttgaacccgggaggtggaggttgcgatgagccgcgatcgcgccattgcactccagcctgggcaacaggagtgaaactccacctcaaaaaaaaaaagaaagaaaagaaaagaaaacattagctttaaagctagatctttctgttaacaactatgattcgaggcaagttaataagcccctgcaagcttcacttccttcacctgtaactgagaataatatcatctgcctcatagatttataagcattaaattgaatggtatacataaaacatttactataatcactagcaaataacaggcattcattataaatattcttttccttccccggacttcataaatgtgacaaaaataacttgttaacaagatttgaaaccatacagtggaataaactagaaataatttactgagtgccataatgtactgatccatatttttatatattcttagtttattggtcaagtaaataactggtttccagagaaaaataaaacactcaagttaatattcaactctaattcatgccattccagttttaattccagtcacttcttgacaaagaattggtgaaccttttgacagccgtgacttagagaaatgttgctatcctgaaacaggtccaaattctttcttctgtggtcattctggttctatgtggtcttttgttcttttatatcctaggctagtctatgacccagacctacctctgccccatgcttttccatgcatagctgcttatttccttgtagcaaggtcaacatgccattgcagaacattctcaggtgctcttggcaattagtcaaagttcagacatcgagtttcagactcttcataaaatttcctataaccatacctatttctgtaccaaattctattgacacagattaatgcaatgctaagtcttaatgaatgaagctctattcatcaatacttgaactacaaatgtcttttcctattgcctggggagtgtttgctttgctccaatgctataataaatgttttcaaagtggccctggaagttgatggaaaaaataatatttttataccagtgcttgtaattttttggtgacatagtatacatagtaaaaatatatatgcagaccatttggtgctggaggtgacaagctgggactttgtactcctgatgtctcacccagccagggcaaagggtcaatatctaggcagagctgtcacaaccattcacgacatgctgacttgttgaggaactctattctagactgccttggtgatgaaccataaaaatgacaattttaacacaaagtcctagacacctccctctaacccacaacctcctaaatagttcacattaaagtcttgtcctttatttttatgttttgtgttgttatatgaattgtcactttatctttaggaacttgattcatgtttcatgattttccctgttggctacacttgagggtctctgtgtatacatgagtagatctggtccccacccgtagttgctctcctcctgccttggagattgcttggtgctcctgcaatgtcttccttcaagcatgatgcacattataattattctgttctgcttcaggaatgcatatcaagttctatgcaattaatgccattacaaggcaaatacagagctcttcttggcatctccaggacatctgtaacgctgcagaagcaaagcattgtagtaatttatgtgacttaggaacttcttttttctatgactgttaaaatggcatttttaaatgaagaagttattagccaagaaaaaaggacttctggagaatagctgactgcctacaataacgctggtcagggaggatttgggttctggcgctgcttctagaggcacgttgatcacagcagggagggattcagaagggtgaggcaaggctggtagagcagcaggatccagtgggaacatttggagagtctttagcctggagaaaagtagtccaaggggatgcgggaagctatttttagctctctgaggaagaattcctaaaactgatcttgaattctgcggtcaacagaatgaagactaaagggtaaaaaggtagttacagaaagaaatgcaaacaacacatttaaaaattggttactagtgtcaacagttaggtgttatcctctcagaagattatctgtgtaaaccgaaacctacacctatatacgtacatgtttttaattatgcgtatatatttaagaatagttttacaaaaatgggattatggcccatgtattttccttaaactgggaatcaaatttggatttcatataataaagacattctatgaattgggagtatctaggattctcagtgggatagtattaccagtggaacagactgcctcatgagtagcaggcttgccatgagtacaatagcataggccagcaggtctccacatttagtattcatgcacatctcctggggatcttgttaaaatgcaggttctgattcaggaggtctgggctggggtgtgagatttcaaacaagataccaggtgatcgtagtcctaggactacactttgaggaataggtgtctagcttaacatccctagggatgctagaaatagattcctgtcttgggatgggataaaataaccctaaatttccatataacttgaagtttttatttcatcttgattttaactttattattttctatggaaaagaatgttgattatataggtgtttcatttactgtctcaccattattcatcattttttttcttttctatttctctcttttctccagtatagcctacaacactgtgatgataactatgattataatctttccttttttaatgttcaaaacaaatattatagctcttctactggttgcttatatctttatttagaaaaacatgtatttacatattttaggatcatttctatatgtctaattcagttcccatagtaatatgaagattatatttaaattatgcccctagtaatgctaatagaaggaaccagaatgaaaaataaaaatagataataatgactaagaccaattaaacacaacttatgtgataaacattgctttaaggggtttgtttatatgcattaaattatttaatccaaagtgtagacttatggaataggcattatttttatcccattttattgataaagaatgtgaggtataggaaaattaaataattggtgaaagtcacccagtttgtgtggtagaattggaacttgaacccaggcagtctagcttccaagttgaggatctcactgttatagccatattggaacaattcattaggatgatgcaaaataagatgtcaccttatatcaaaatgtgagtttttatttttgtaccattatggtaccatctttgttgataatttagtcttttaaatagacatttagcctttgagagcatccatgctgcattttgtaatttctaacttatttattgaattgccttagacatatggaaaatgttggactatcctatttaaatttcatgaaataggccttaaaatcgcacttgtaagatacatctgaaacttttataaattcataatgataatttggtgacccttgctaaactagaggacactgggatttcaatgttggtttgaacaatttagaaacccttttgcaaagttacaccagggttttaagcattctctcttaaaagacaagtggaaataagtgatttcttttccaaagcggtttatcttcttggtaagttaactatgtttaagatttagtattcactccttaaaatgtttttctataaggaaaatgaaaaggattgattaaatgagtaagagtgaggtcctggcatctaaagttgtagagttgtccatggcaaggacatgtgctcatttcagcacattatgaccattgctggagacaaggatgaacagagagggatgaatgatgcccagaaaggtgcctgtaaccaagactgtggttctcaggaagccagagacgtccaggattcagagatgtgaaggcagtggcggtacttccggactgattcacagttctaggaattagcaggggctgtctgtttctatttcccaaataccttaatttattaaattttaataatatgtaatatattctcatacttccaaaaatataaagggcaggattttaacaatgagaggcatgttaattattcacggagttttgcacattcataaggaaagcttagaaagccctatttctctgtgggaatatattccgccagtggaacccagcattataattattttgttaacattaatgggaggaatgtcttttcatcgatacccttttcttgaagaaagcattaaagtgttctggtaccaagataattgttaaatagaaagggcacctctgatgggtattctctgtttcattgattctttttccatcttgtgatgttgatgatggtcaagtctaaggagcagagctagaacaaagatgaacttaaaagtcatcaataaagaggtattttttacccagctgtcagaacaagaaaagttttttgtacaatttttaatcttgtatattaacggttcttctttaagatataatttatatagagtagaatgcacaaatctcaaatataacactcagtgaattttgacaaatgtatacacctgtgtaaacacagcgtagattaagatagaacatttcatggtcccagaaaattctcttgtgccctcttccagtcaatacctctctctcctacccctgcacgcacataaaatacccagtgatgactattatcttatcatccagcttagtttactgataattacctttcatttaggtggaatcacatggtgtgtttttgtgtttggcttctttcgtgcaatgtaattttttttgagattcatccgtgttgttccatgttgcattcctcttttttattgctgtgaagtgtttctttgtatgactttaccacaatttgtttatctactgtccagttgatggacatttacattctttccagttgtaagctatgatgagtacagctgccataaacaattttgtacaggtcttctcatggacatacattttcatttctcttgggcaattaactaggaagggacttactgagtcatggagcaggtgtccattttgctttattagaaacctcagttttctgaagttctgtgtcactttatatctcaccaggagtgtgggagagaacaaagatggtcttgatcacagtggtatgctgtcacttgctcctcatgtgggcacttccacagtcttatatatcactgagctggaaagaggaggagagaatgataggctggggacaggaggcaatggaattatggagatagtgtattggagaggtaattgatcctgcccctgccagcaagaccagctcatttactcccagaactgctcctcagcccagcgatgcctgacaaccttccattaaaagttacaccatgcagactggctgtgttacagaattaattccgggactggctttcagcccacttgcaccttgacctcacctctgcctgttttctctcacgcccagttcatgtgtattcatacagcttcacaaaaactctcttctgttgttggtgatttttttggttgatcctcatcactgaaacttcatagtcatgagctgtctcttacaagatacataactttgggccagttacttaacaaccccaagtttctgttttcttgtctataaaatggggatcagaatgctatattaaaaagttaatggggccaggcactgtggctcatgcctgtaatctcagtgctttggggggccaagatgggaggatcgcttgaggtcgggagttcaaggctgcagtgatcacaccactgcacttcagcctgggcaacaaagtaagaccctgtctcttcacaaaaataaataaacaacttttaaaaagttaattcaatcattaatgcctataaagggctcagcacatagcatgtgctcagtaaacactactgtaactcccagcacaacccctcctgttgtacttcctacatatgattggttttccaactctctaattccccttaattgataattctagtgaaataccctcctgggaacggacctaggaattcctgcctaggcctctgcctttccaaggctcatcctcaaaccgttactctgagacaattgtaatgaaacaagcaccatttatacggcaaactttaaagctcctgctagcttgagctggggctctttggatttcctgtttcatattttccaggatgaggattcgattttaaggattacatgctaaaaatagacctctattatgcattttcaaggattttaatatattgttaaattctagtttttttttgtttttgtttttgtttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcggcctcccaaagtgctgggattacaggcgtgagccaccgcgcccggccaaattctagttttaacacatagagtacctcccctttaaaaatgaattgttaccaccggccgaatacctaaacactatcattctgtgctcctgatgttcctgtgatctcatggagtctagggtgcctttcccagtctcaacagagaggacttcatgagccctgggtacagaaaggtcattggttttattttaaacagtgtcagctacctgctgcccactttgttccaagctcttccttggccctgctattttcaggcaagatgcccatgaaccagtacagctcttcacactcatcccttctgcctcttgctccagaatcatgcttgggtatcacaagcctacatgtggaccaacctcctttcccttgttccaccatgcccccctcccatatacacatcacaaagcttctcttccccatgccttcactcacattacccctctctggttagtacttcctcatcaccaacatgaaatcaacaggtactactcattccatgactttgctgctctcctgtacagccaaactccttagaaagtcttcattaacttctctaaaggaagactttgtagagagtcttcactgtgcttcccctcctcccagtctcaccccaacacactccattataactgttgtccgctccactctgctgaaaagttgccaatgtccaacatcttgtcattccttttcatgaaacttgaccccttaggctcactttatatgcctgatgggcctacttcttttttgaaaggtgctcttctcctaacttctgggacaccggatttgctgttttttcttcctggattcttttctctcagatcttcatggggatgtttcttctcatcatggatataacccctttgcagaggccctcccagtcccaagcgatcctaatcaaagcagcttccttcaacctttggcctgactttctacctcctttatatttttaatagcactaattatatctgaccttctcatttatttatgtagatgttaacatttcatgtggaagtttgtaacaattgcacatttgtcaataatgatccctgacattcattaatgacctgctatgtgctaattctgtcctaaattagctcgtctaatattcaaaataatgttatgaagtaggaactactatcatcattttttgtatgtgtaaactgaggttcaaagaggctagataacttgccttgattccaaagctgtaagtaacataatgagaattcagacccatctattttgatgctaagatctgtgatataaatcattgacagaaaaaaaaaaacagtgaattaagctgtgtccccatgctttctaggggcacaaagagagatttggtgagacagaacatctttaaaggtaccacctggagagaactaacattttgtttgctctggagtgttgagaatttaaaggtttggctttgtgatggctcaagcagtaaatagatcacacacagtgaggaattcatctcattttgcatcgagtgtgcaaagcagtcataaatgatgaagaactgcattgtgggtcttgtgtaagtcttagagtaagactataaatttctaaaacttgaagtttgtaaacaaaatatacattagtttactcattaatgaatttataatctaagatgaactgaaactagatcctagttaaagcaaaataaggaagatgcactggtctatattttctttcctttgactttccacttaatcattaaagccatggccttcatggattattggcaagggaaagcagattgtaacacattttgcagatagagagagcaggtgtttcccacctgttcagttccatctccaggatgaactttgccttcattacatgaatccagagcatactctcccaacttggtagtgctcctgtgaactgttgatctgttactggcaagcctgaatagcccggcgcaagagccagtctgcctagaaaccctgaactgagtctaacctgttctcagcaaatcccatctctgcctctctggtgggtcctcacggcacccttgtctgctgcctattacttcccaaagaaagagacaaaaaaatccttggaagtgttacactaatgactttacatataaaacctctctcagaaatgtctgcatttttctggaagaggatgagtagaaaggtcaataggtagccccacagaatgaaaagtattattcagctacagtagatgctgggggccctcaaatcccaacagtccaataaatcccatccacatggatatccaaggaatagttttatacaattggattataagtcaagtatttgagggagaagctgttcactaatcgcccaaaacattcctccagtctgcacctccttctcattcccacagcgactctcccttttaggatattgttgttcatctcctagtccacttttcaaacttaatgtgtgtaccaagcatgtggggctctaggtaaaatacagatcctggctcagcaggtatgagatggggcctgagattctacatttctggccagcttccaggagatgccagtgccattggtccaccaaatcacactttgtatagcaagatcctagcccagaactttccaaggcagaggaggcctcaaaatcccctgtaggcatgtgaaaacacagatctctaggccctatggcaagatattctaattgagtaggtctaggatggtgccccagaatttgtatctttaacaagttatcaggtgatgctgctgctgatggtctgggaaccccactttgagatccaccatcctagattattgtagtagcccgtgacttctctctgtcacctgtacttcattgtttcactgtcaccagaattatcctttaaaattctaaaaataattactttgtacatgttttaaaaactgctaacgattctcaatggatcatttagtatacttccaggcttcttggcatgctgtaacacacagttaggtataagcagccctaagaagtttttcagaggcctgcccctctggttatctcaatagctgctatgagatatagcccacccagttcacatgcctgtatttatcagtgatttagagaattctttatttcaggaacttgtgcagaccacaaaagcatttattgaaaatgaataaacatatactatagagtgatgtgtgcaaactttttagtaacctgtaataagacaataccaagtacaaagccatcatgctttgtaggatatcaggattggctgacgtactcgttgacatcaggattccactgtcaacctccatgtccaatgtcttgagaaagtggctagtgtccagccagagagaggctgttctgtcctgctctgacctaaccttcacattggtctgccctatttttgttaattgtcttctgtgggatctcatgccatttcttttccaggcagctagatgcaaggattatttgttgttgctgatgtttgttttgttgggggatcttagtcctaattctttttctttgaatctgtaaatacttcaagtgcagtccataaagaagcttgacttgcctccagaatgcactgccagatgctagcttccagctttactaaccaacccgagagatggattttgtgggtttgtttggtctcgcagtttgtgccaactgggcaccgtgtccttagtccaccctcttctttgcacacaagtacaaaagggaacattttattctgctgctttgggtgggaacagtcactttatttatggggtctgagctaaaatttgatttctctattgcatggtgcactggctttatccatgtacatccacatcctttattattttcccatttcatgcgcaagttctaggcttctcatggtgttccaccctttgtggcttcagccttcctttccagcttcacctcccagtactgcagcccacctgctccagcgattccctgaaaaagtcacgtcccctgtagtatatctgctcccggtgctcaccccaacaggattaagcccacacttgtaggcctaaccagatcctaaactcaatcttgttgagcccaatgaaaatcaggtggtgtaactcacaaaggcaattgacttgaactcctctaggttttgcttttgtctggttttcaaaggaaagtgcatgagggagcagggaagtgtttgctgcaagcaaatgtttgaacgttcaggacagttaaaagaagaaaagatataagcattggtgaaagtgagcacaatagatgcaaatttggcacgctgaaaggaatttttgccccttaatgatctgtgttttctttatgcagcataacccgaggcaattaaaggcaggaaactactctaaccaactggcaattatgttttagtacatttggtacaatgcatactcgctctccatattttcagaatttttgaaaagtaaagaagcttcaaaactgtcaaagttggctcttctttcactcttcacgaagccttagtaggaaaaaggaaagagctgggctgtttgctctgggtccttttatgtgctgacatggatgcatttgaaggatttgaaatgtgcttcagtttgaaacttgggttccttttactgtttattcttttttgtgttttcacccattggtacccttgattgatagtgtttaagtcaggggacaagccgggggtttagaacattgatgtcctcagcgaatgaccctaagcttaaaagggagcccaaactcatcaggcctcgtgtttaaaaatagtttatttttgatgatgttcatgtgaatgagccatagtcctactcctcagggctgtggaatggaaagccttgagtagcaaatgatcgtagttgcctggccaaaccctctttctggtccaggcactgtcctccagcagtcacaggtgctgccctgggcattgtaggatgttcagcagcactcctgcacttgaccccttagatgccagcagcatcccaccagggtgacatccaaaatattcctagactttgccaaatgcccgggactggagaaagggcaaggtggaggcaatgggaggcaaaattgcccccagttgagaatgattgatctctagggatcctgaagatgtgctgggtgaaagccaattctcttcctaagctgatccaggcacaaaggagagcagaggcatctgcaaaatgaaaactacattcttttaatgatatcactctttcctcttgacccaattttggccagtttttagaaaatcacatcttcctcaagcatctaaactggcagaagagagaagatgccacagtttctgctttgaagggtccagtgaggtttggtatggtcctcacataaagtaaagaggccaaggatatttgtgttttacgttaggtcttggcaaggtaaaaattataagagaagttttatagtgtaccagatttctatcgtgtttttaaaaagaaaataacttattgaatataattgccagacaaggtgaagatagtaaaagtattcaggttgtcaccccaaactgcaaagctgactaaactaatttcaaccttttcctgctaacaaacttcacccttctgtgttttctctccctccatttttgcctgcctgtacaactcaatcctttgtatttactcatgatgaaaggcctacatgcaataaagaaaattaagcaaacctgattttcaaggcttgagtaatttaaaaactatgattttgacattttaagaatgttatgttgaccttgttcttgatcagtcatgagaattaaatgcaggagctttgcaccaaagcaaggcccctagcttaataaagatttaatttatactgcttcctaacattctctttctttttagtctacacagctcacattgtaccttttctcaaagtaatcatgagttataatttaaactgttaaatacacactgccttaatcttgtattttgttgttacattaatcaaggcagtgacaagcaaaattctgttcgaggactcttaacctgccttgcaagaaaagtaatgttcactttttaaatgagccattaaataaatccattgactttttgagtgaaaagcctctccctgtcccaagagctcaaattgcattcaacagttgcttttggaatcccaaagagagcagcaaatagtaggagttatgtctctggaaggcttcttgagttccaaaaggcgatttccttcctctccagaaggaaatcaaagaggaaataaacaggaatcatctgaaagataagaagtaaatgcataactcagtggaaagctagctagctagacagatagaaggaggatacaggctttctagagaaattgggattttaaagcatttatggagtggagaagaaatgactgcaaacaaagccaagtgctaaatatagaaactatggaaataaatagcccatattcccaggatagccttagctttgatgttaagcagcaaagcagatccagagggttcctgtataaagctataaacagaaaagaattaagaatatgctgattgagagaaacaaatgtggtttaccttgggaattacctctgtattgtgctatttatggaataaaagacaataatgtcatagcaagcactttgtataattaaagttctagagtttatagtggaaaaaatatgcagtccattgtcttgaaatgtttatttcatattttgttgtaagggagctttacaaaggtaagtgccttattctgacagtgctagctaactaataaagtaatcaagaacatgaactctgataagcagacctgaaaccaaaccagaaggcagaaaagggaaagaacagactccaattggagctaggtgatatgtctaaaataaatttcatgtgtgcctttcttttatatttccttggatccattttaatggaaatttccattagtggggcaacctatgtaagtaattgatagatatacttaatttatttgctgataagttgagaatatagccatattaatggaattggaattgtcaaaaaatattgttggagttgtccatgaaaatactcagtatttcttttagggctacttataatgttactataacaaccaatgaatggacttaggcctgaaagataaaatgaaacataaagatgatgaattttttaagttaaattttttattgaattccatgaagaaatagctctgaaatctcaggattgctctagtttcaagtggttagaagacaaaaagagcctgaggcaggagaatggcatgaacccgggaggtggagcttgcagtgagccgagatcgtgccactgcactccagcctgggtgacagagcgagactccatctcaaaaaaaagaaaaaaaagaaaaagagcctggcttcttaagaaaccaggtagtaagatggtaaatcatgtaactggagaaaatgattgggagtattttggggaaagatatggttgtgaacactgcaagtttctgttggggaagaggtgtttgtagtcatgactacaaagatgaccctctggaaaagtctaggaagcaggtcataggacaattccagaaagaaggagaattattcaatcagtgactccactgtctttcagcaaatgcttgcctgattactacagaacatgcaacttttgctgatacaaacatgcacgaaggaaggtacttcctctagatagagggaccttgtgagtaattgaccttgtggctattctccccttatacttcccaaagtcccttgcagctagatgtgcctctgagctaaattctggcaaagaggtgtcaacaaaaacctgtgggaatttggggatcttttcttaaaggtggggacatggggtgcttcttccttccctctttgctgcaggctgaaatgtagccaatatgaattgtgttggagcagccctctctatcatgagggagatgctgcatactggggattgagaggttgtcagagagaaaaagctgagacccaaacaattgtgtgatgcaggcctaatggcctggtctcctacctccaggcttctttcacatggaagaaataagtctgtatcctttctaagctgctgctgttttggcctttttagaaacttacagctgagcttaaacttaactcatacacatttactgtggttataagtagaactaaaaatatacttaactcatatttagcagttggttttatttcctcagttcatactgaaactagagcaatgtctttgcttaaaaacagaaatcaaaatcaatcaaacataattgattgaatacagattgcaaagaagtataaaatggaattttggccctcaagtggctttcttcaacatgaagaaacaagacttttaaaaaggtatatgcatatatttgtatatatatatgtatgtatatacacacatacatatatatacacacacacataaatatatacatatctacatatacacacccatgtactacacacatatacatataacaaaacaatattaaaaactccattgtgtaatagttcaatagaatcagtggtgcacagacaataaaatccttgggaattcagaggaaacaactgaaagagatgggagtttgggcagagaacctggttgtgaagattaaaaggaaagattagacaggtgacaagaagaggaaataggacacaatgaatgtattgtcagtaaaatgaaagagttttaggttgatatctcagtatgacatatttacagtcacaattcaatataaagggtcttttgctagcgttcatgtattttatctggtcttaatgaaatgtataagtgaccatgatagacctcactgttccacaggtagtgttttcaggaaaattgtgcaattagtgtctgaatttattctatgaagagtccttacagtttgtctccaacttgcagttctgtggtcaaaggagctgtctgaataattgcagtatagtaattgtgtctacagaggacataagcaaagcattttgcttaagcaaaaacattttgttttgttttggttttttgtttgtttgtttatttttgctggcagcattgctagtcaagactgaaaaattagggcatttaaaatagtggagtaagaatggtggttgttgcaggggagctgagtaagatagagcaatgtgacaagcaggtcttataagactaggtagaagatcaatactctgagaaggagatatggaggggtcagaatggtctgtggaaaaagtactgaatgtggtccagttgaagaggaagagaatcaatatattaaaaaagacccaaatgaaaaaaagaaataaagctgtctttatttgcagatagcataattttctatggagggacaccaaagagtctattaaaaaaaactttctagaacaaataagtgagtaaagcaagatgcaatatcaatgtacaaacgtctattgtttttctatgttccagaaatgaacaattggaacttgaaatttcttttcttcaacttttattttatctggggttcatgcactggatgtgcaggtttgttacacaggtaaatgtgtgctatggtggtttgctgcacagatcaatccatcacctaggtattaagccaagcatccattagctattttttctgatgctctccctcgcctgacccccaccctggataggccccagagtgtggtgtttgccccacagtgtgtccatgtgtactcatcattcagcttccactcataagacagaacatgtggtgtttggttttctgttcctgggttagtttacggaggataaaagctccatctccatccatgtccctgtaaaggacatgatcttgttcctttttatggctgcatagtattccattgtgtatatgtgccacattttcttcatctagcctatcattgatgggcatttgggttgattccatttctttgccattgtaaatagtgctgcagtgaatataggtgtgcatgtatctttgtaacagaatgatttatattcctttgggtgtatacccagtaatgggattgctgagtcaaatggtttttctgcctctagatctttgaggaatcaccacaatgtcttccacaatggttgaaataattgacattaccaccaacagtataaaaatgtggaacttgaaattttaaaaattactgttaaaaatatcaccaaaaaatgaaatacttaggggtaaatttgacaaaatatatcaaggagctgtatgtggaataccagaaaactctgataaaataagttgaagaaagtctaatgagattgggtgatatttcatgttcatggatggaaagatttaacattgtaaagatattaatttttttcacattgaaccacggattcaatgtaatcccagtcacaatcccagcaaactttttttatatgttggcataattgttgcaaaatttatatggtaatgcaaagaactgagattagctaatacaaaactaaaatggaagaataaagttagagaactcatatgatttaagacttactataaagctacaataatcaagaaagcatggtgttggcaaattagatacatagatcaatggaaaataatagcaagcccccatatagacccagataagtatagtaaactgacttttttatgaaagtgcaagaataattcaataaagaaaggatagtcttttcaaaaaatagtgctggagcaattgggtgtccatatgcaaaaatatgaacttagagttcatactttacaaaaaaaattaactcaaaatgagtcatagacatatatgtaaaatgcaaaccaattaaacttctagtagaaaaatagaataaattttgtacaatcttggatttgtggatgagtttttagatacaacaccaaaagcataatccatgaaagaaaattttgataaactataatttgcttaaatttaaaacttttgctatgcagaagacagtattaaaagaatgaaaggaaaagacatagactgggagaaagtatatggaaatcacattgtgataaaagaatagtattctgaatatatagagaacccttaaaacccgacaagaagaaaataaataatgtaaattaatatttggcaaaacatatgaacagatatctcaccaaagaaaacatacaaacataacaaatacccatatgaaaagatgctcaacatcatttgtcataaaggaaatgcaattgaaaaccccaatgaaatatactacacactattaaaatagctaaaattataaaaattgatgatactaagtgttggcaaggatgcacagcaacagtatctcttattcattactaatggggttgcaaaatgggtataatgaaatataatacagtttagcagtttcttataaaactaaacatactcttaccacatgatctagcaattgtgctcctaggtatttacctaacagatttgaatatttatgtcccacaaaaacctgcatgcaaatatttatagaagccttattcttaataacccaaaactggaagccaccacgatatccttcaataggtggacagacaaactgtgatatatacaatggaatattattgagtgataaaaaggaattagctttcaaaccatgcaaagacatgtatgaaccttaaatgcataatgctaagtgatataagtcagtctgaaaaggctgcatcttgtataattccatttatataatattctaaaaaaggcaatgccatagagagggttttcagattagtggttactaggggctgtagaggagattgaaaaggtgaagcacagtgaatctttttaggatagggaaatttcttttgtatggtgctgtaatggtagttactatgcacgtatgaggtactatgcatttattaatatactgtgtactttgaaatgtacaaatgtactatgcatttataaaaatctatagaattttgcagcacaaaaataaactttaatatattcaaatattagaaaattatttaaaacatcaagagaatcccaggatggaaagcagattgtgacaaataatatctatattataaatatagacaacaaccttactgaaggcaataagggaggaagttgctaactgaagtaactggaaatgaatggaatctgtgaaactgaaagcaaaaagaatggttgttaacaactgttaacagttctgagaccagtattcttatatactggaattgaataattagttggatggctgacggtggaagcaaggtttctcactgttggagcaggtagttatagagcaaaggaaaggtgctagaatgatccatgtagacataggctagaattgtgacatcagtgtgaactcatttttagcttaatatacatgcagatggatgaatatagaaagttctgtgtgtatatacatgggtttgtatacatacctgtatttccaaactgggttcttgaagaggacctacaaacaataacactttggtatcaatgagcataaccagccccctgaacttggtttctagtgccgttcttcaataaaaggaactagggctcttggagaaatggctgattctagagctggggaagggaatttacaagattaggctggagcatctaacaatgccaggaagcaagaaagtttctcaaaggaacatatggaaccaactaaaagacttctcaatggtcaaagctggaacaatttaagcaacaaaataaagatgtgatattagattgcaactcaaagtataaaataagtatccataggccacattattataaatcagtcattgaatgaataaataattgggaagaatacacaattctcccatataggataccaaataatttatgtaggagcataactgccttctcttaagtgtgggattcacatagcaacttcctgcaaaaaaagcacaatatggaaagaggggataaagagtaattgtgatgcagaaactgacaaacactgcctcagtcagctgaccaaggataatctcatcagtattaagtcatgttgatagtaggtacctttgacatgatgtgatgaaaatggcattttacctctgtggtctctctcccgaaacccacaacttcagcctaatcatgagaaaaacatcctgtacccatattaagggatattctagaaaatacctgactagtactcctcaaaactgttaaggtcatcaaaagcaaggaatgccaaagagacaccctaagatgacaggtggactaaatgcagtatggtgtcgtgaatgggctcttggcacaggaaaaggacagtaggtcaaaactaaggaatatcaatgaagtatgggccttagttaatattaaagtatcaatattggtatattagttgtatcaaatgtatcatactaatgtaagatattaaccatagggagaactgcctgtgacatacatggaaattctctgtacaaattttctgtaaatctaaaattattctagaatagaaggctatttaaaaaaaaaaaaaagaccaaagctaaacatataatcgtggtggcctggggctggaagtgaaggttagagaatggagagttattgcttaacatgtacagaatttctatttgagaagatgtaaaaggttcctgagatttatggtggtgatggttacacaacaatgtgaatgtacctaatgccactgagttgtatacttaaaaatgattaaaattgtaatttgtatcgtgtattttatcaaagtaaaacaagtatttcaagaaaaaaactcaaagacacagaaaactagagaagagaaacatcagaaggactaaaaacaaaatctaaaagtggaccaacaacaaagcaatgggataggaaggaaaactgcgtaagattcacagggcaaaacacttccattactagaacaccaggaaagaaaacacctgtttagaaatcacagcaaataaattagtactcacggttttctctttacttcgtaatttttaaattgtacacaccctcttccaaaaaccttacaacacaaggcaagaaatacaaaacaaactttttgtttattagtaaattaaatactgtattgaatgtggaaaaacagaacaaaaagtggaggctctgatacactttggccccgaatactggccctctgagcggaggagagttggggaaatcagatgttatattaatggactggcatttagaagccaggcattgaactctgtttattttatatattattttaaccctcacaacagcattatatgctagtactattatttctcactacagagctaacatttgagatcatggttttctgtcaatgacttgaatttagtaacagtgaaaattccatacacataggaatatagcagaattttttcagtaaggctgtaacgtttaagtgaacttagctgatcctacatatattagagaacgcttgctataaattcatgggattctgtctaccaagtcagagaagtggtttaaatgtgttgatgtatctggcgtattagagtctacagtcatgaaatggaaccctagttgtacaactcattagctatgtgctgtcaaattacttaacatgtagagatctcagttttaccatctattaaatggggataaaacaggttctttgcttataacattctttttccttttctaatatcccatgtgcttgtgactttctatgatcagagatagtggtatttgtcttaaaaaaaaaaagaaagaaagaaaaggtcatttaagccccatattatttggagatcataggtacaataaaaaataaatgccagagtttcaatagcttaacacattaaaaagtattcctcatttacttagaagcctagtgtgggtgtttttgatataaggtgattttcttctacctggtgatttagggacttagactctgtccaatctaacagctccagtatctcctagggtctctctgtcctctttaaaaaggacacaggagaaagaaaaagacctgaaatgaccctcgtctcttccattaaccttccatttgtgagaactattcatatgaccctccttaaatgcaagcaaagggtgatgtgaaatgtggctgtattcaggcagcaatttccctgtaattctttgaactgtgtaaggcaaagtgcaaagtttggtggcgaatgagcaacctttgccttaagctctgtgcgagcccagtattgctgaactgtgctaacccactcacctgtatggagagaagagtagcaccattatagtaaggactcctgcagtaatcaccaagtataatgggggcacttaaccctcagcttttttgcaccttaaatggtttaataataattgcaacaaaaagtatttataaagcattcgggaatgcttataagggattaaagtaatattaaagaaatcactagagtctcagcattaaatgatttttaatgcaacaaaatctcatcatactgtattttttcttcttagctttaaaaatagacctgcagaatagatatggtataaagtgagactccatagtgtccagaattcttttctttgtatttgtactgaaattctctctctcttttccagtgtatcaacttttagttatatattttgttcaaaaataacatctgatcatcataaacatcaattatttaaataggataacatgcttcttctgagtgctttaaagtaaacttgagtgtttataagtaagggaattattaagaagaaaccctggtatatccacaagataaatgttaccagtctctaagagtgcgtctcagtggttctcaaacttaaaagtatatcagaatcacctgtaggatttgttataatgcagattgctaggtcccaacctctggagttttcagttcagaaagtctgggatgtgggccaggaatttgtgtttctagcgagtaaccagatgatgtgatgctgctggtccagggaccatactttgaaaaccactgatttttctataaaatgatgctgaagaaggtaaggaggaaggtatcaaatctacgcggtttctctgaggttggactacttgatgtgtcccagcttttatgtttaaaaaaaaataatgccgaaagacatacagtgcttaagactcaggttaatttaattccataatcatacggcataatagcaccaattttggtacatagagtcttctgtacttaattttgactgacccacatagagcaaatgtgatttatctgacttgaaattgaaaacccaaataagctaggttgtgaaacacagtaggtttttacgatggggcctataaggagacctatgaattattagagggatagcagtggttaggctaaaggtatacagagaatacgttgcaaagatattaaggaaaataagaaaattatggaagactttaaggaaaagcactaaatatgagttcagggcctgagctaagtggattttcaaaaaaatttcctgggtatttactttcttaatacagaggaagtaatttggaggaagatttatttttaggttttactttcatctgagcaagaagaaatatattgtgcaataatgaaaaagcgatctatcttcttgggtgctcaaaacctatgttaaggatttatgaattatttattaagaaaaattatacacccagggatggtgaccctggtcaatatttaagcttcaaaaaagataatgaaattcagtttttctaaactgtagaggataaagtgttttatcataacattacaaattgtggaatgaatgaataaaagtcacagtgggttcttttttgaaagtctggggctacccggaatcagcatataggacccaacttcaaaaggtgaacaatgatattaaccaataatgtgtttctttgaggaaatgatctgaagcaaaaagatacctcacagaccagggaggtaatattcaagcaactaaagaagctaaggactatttcatatgactatcttgcccttggtgagaaatcctaatacagtgattttttttctccactatatttacaaaggaagcataaaaataagaatgttggctgggtgtggtggcttacacctgtaatcccagcactctgggggggccgagcgaggaggatcccttgagcccaggagttcaagatcagcctgagcaacatagtgagaccttgtctttacaaaataaaaaaggaaaaaaagaaagaaaaaagaaaaaaatgagaatgtctggatttgaaggaagaaaaggattcaaagaaattctgccctgcgttctgctgatggcagttttatttgagaactcttgcactgtcaaatgtttcttagttcatcgcccaatttaatatttcagaaaagtcatccaaggactgttttcttttgtggttttctttctggcagcattctatggcttctctgttcttggagtgttcttctgccttgacaaggtaaagttcatgcctaagcatgtgcagaaactcaaggtcaagtgcaccactgagcaccttcagagtgaatttttaggggataatgttgtcacaactgtcttcatcatcaaacagcaagccttcatgataggcctgccagggaggtggccctgccagcctgctgcctcttgtccctttcccagtttacactgttatttctccatcttgccctgacttttgcccaataacagcaagcctttgggttgaacctagcatacctgctttccttgtactccagggccataagcttgcagagctaccgtggtggcatggcccatggtttgtcctgccccaacttttttgtttttgagacagagtctcactctgtcgcccaggctggagtgcaatggcatgatctcggctcattgcaacctccgcctcccgggttcgagcgattcttccacgtcagcctcccgagtagctgggattccaggcaccctccaacatgcccggctaattatttttgtatttttgtacagatggggtttcaccatgttggccaggctagtcttgaactcctgacctcaggtgatccacccaccttggcctccccaagtgctgggattacaggcgtgagccaccgagcccggcgtgtcctaccctgccccatcttgcttccttcctcctctccctttattccttccttccgttctctttagaaatatttttgatatgtaacagaaaaatatagaacataataggaaaaagtccctcttaaatgttttcgcttttattttttgcattatcccaataacctgtttcatttatgtactttgtcttcagggtgcaattgtatgcaatatgtttggattctctgccacttgcactaacattctcttgccttaatgctgtctcttcttatctactcattttctgtttctcatcctttaacttttttaaagattctgtgcttctcaccaacatattgcaataaactgcactgtgcttccacctttcaggctttttaatgaagggagtaaatttaagaattaacttgtttctcatgaaggtcaagtcaaggatgtgttggaagaagacagatgtcttctattagttgttcttctgtattttgtttcaacctactgttctgaagcagcaatagtagtaaacataaggccttgtaaaagagtttttacacaattttttttttaaatctgtccccatcccacttttggtctgacagtgattgctttttacttactccctctctgttcataaagaggtagtaatactaaattaatagtgtttgtgaaaattcctagaaaaaatgttattcacataggatctttttaaaaattatccttattcatttttaagtgaggttttaatgaaatgataaaatgaattatgtttatcaactttggagtagagctttatatattctgttatggatagtttttttattattttaatgaaaggaaagtcagagtagggggtagaaaatagaataaacctttaccaagaagaaagtaaaataaagagaatatgaacatatttctttttagctatgggtatgacaaaaatgaactctgatttggagattaggtaaactgatgtttttcatagcttttatttatttatttttagtaaggaatatttcttttttaaaatcaggcactgtctctcacgtgatgatgagaaaaagcttttgggaaaaccatttgcacgttagattacagggtatttatgcatatgttttcccagtagtactcactatattttaaaacctgattaagatgacataagataaaatgtggcgtattgtgactgagaacccctagtctcgaatgctcatatttagtgggtataatgatgaaaactattttcgaggacatttttgaaagattccaaaaacatacagaaatatatctaaagccaaaaaagtaagtaatataaaaatatgagtttaaaaatagtaatatgtgattcagaataatttcaagtttaacgttattttctaagttgattatttgcaaatgatagctatttggatcctgttctctgaacaaacccagatgcaaggggttgtatacaagtgatttattaaggaagctacttccaggagacatcagtaagagagtggaggaagcaagacatggatggagaagagttaagtaagggtgagctttcaggtgaagtcccaacctcaacctaagctactgaaagctgcagagcacaaattacacctcgagttgcttctcctgcatctgtcagacatgaactatcagctctctggggagatctagcatctcaggcacttcctgctctctacacatctgagtgaagtagctccaagaagccaaaggtagtcaaaggctgcaagtgtcacttgtttggaataaagctgatagacgctgggggatgggtgtctagccagtaagggagcctagcagggaaccaggctagtatcaatagaggttcctgcaggagctttaggcaaacttcctgagtaattggaaaatggctctacattgattttttttcaatcattcatagttcttaatatgaacagctagcttcgttttgtgtacatacattagtgttgagattgatcaacagtcgaatgaaaaggagagttcctttctggtaaaatttacgcacttaggcaaaacctttgggctgatttattgattgactcagtgaatgttcttctcaggaaaattcattaagcatgatgttcccttttagacatatccagctcctacccccacaaattagcatcggaaaagatttggttgaattccgtctgtcttgccagaaagccaaaagcaatgttaagaagcaaatcttctttgaaagggaggggaaaaaagaccacacttgtcaacttaaaatatctcattttggaaaatagattaactcattacatattcacaatgtcttatgagaggaaaaggtcatcaaaatgcaaacctttggcagaaaaaaaattgtgatacattttggaataaataactggagaaaatgagactatccagatggatataaccaatcagctactaaggtaaagcaaggataaatgccgtctatctatacttcagaaaatatggaagtcaccagatatgccatactgtgtgatgagagagaaaagaaaatacgttggttgagaaaatacgttggttactcactcaaatgtatcatgcacagggctgaatcaaaacatgtggaaatcagccgagcatttttagaacctctccttgacacagtctggcctctagggcccaatgtggaaattgctgctttaatctacagtgatattagagctactgataagcacagtagtctgaagaagacttctcagttttattagtagttttctcattgctcttagaattctgatgcagctactttataactggatgtaggaagcctgtccaagtgtcagaatgccctacccgttctagacctaattagccttctctgtgggcagccattgtcttcatttaatatctagggcagagattctcaaacttcagattgcatctgaatcactgggaggtgaatcacccagcacagattgtcgggccaccccagagtttctaatttagtaggcctagagttgaaccagagaatttgcatttttcacttgttcccaaatgatgatgatgccataggtcaaaggaccacacttggagaaccactggtgtggagaaatgaaggcatttaagtcctataagcagataagtgatggattcaaatattatattaaggtaagattgagggagtagtttgcactgccagttaaaaaaacttggctggctgttcagccacagtgaaataggtgtaaaccagagataacattttagatgattcaaaggggaaatctggctacatttatatcatctggagttttcaagtggaaacagcttgtttgcctgatgaatctatatcattccatatttcttatcaaaagaccttttatgaaaatcagattctatgctcacccaaaatattcaggaagatagtttttagcacttatgaaactatttgcaaaatgatggatgctgtttctagttaatctgattagtctgaaatgaggaatttagcttatcacaggcagtaatagaaaattgtaacaatgccatctttatcatcatagttgtgattttttttaactctgagttctgaatacatgcaacatcattcattcttcatccataaagatgtggagaattcctctgtgagaagcctgtaatatataagaactggaaaaataaaacacgtgctataaagagccaatatatttctgaaattattcatctttaaatatatatagattatccatggtgattatggaactttttctcaggtttttaatgtcaacctaataagttgacatctcgttaaaatgaaggcagttactagcatgttaaatctgacctgtttttcattcatcatttgaaagaaattacaaaaatatatctcttaatataatgtttcctagaatccagaagcaagtgtggcagtttcttccctcagagtcatagatgcatgcaactataccataaatactgttacaattaagttttattcattttacctcttaataaagccgtggtgctatacatataattttatgtttagctgcatttaactttcaactttggaagtgttttactcttagatgagcgtgtaggagtttctaaggttgctgaagaaggaagtaagaatgagaatatttggctattgcacaaccagccaccaaactatctcacctggcaatctgcaaggaataaattaactgcatatctgctgatatagttcacattgccttgtgcagacacagcctctgaaaactagtgttatatttatttatcatgattattttttcatatacgtgaaaaaagacttaagtggttttctttcatttatgttacacaatactcctgctaccttatcaatatccaaaatttttagaaaaaagtaagtttggggatatgtggattactttttctattatgtacatagggtcaatgatcctgggcaattaacatattttctctgggacttagtttcctcatctgtgttctctttctgttcccagttactatgattctattatagtaattgtttctgtttgggcacattcaataatggtgacagcattgcagtcatttttatgcagggtgggtggagtgccaagatacgtaaattcattttcattcctttttaattagttgcattagaacttggaaacaatggggttagtgtattagttatctattgcttcataacagactaccacaacttaatggcttaaaacaacaaacatttattatctcacagtttcagtgggtcagggtctcacctgcttagggtatcctaaggctgaaatcaagatgtctcctgggctgtgttctcatctggagctcaaattcctcttccaagctcatttaggttgttgccagaattcagttccttgtggtggtagaactgatgctcttatctcctggaggtcttcttctccatagtcagtacacagcacagccagcagattagtgtctctgctgcttcaagtctcttgcttctaaaccctcttttgaatggcctacccaagatatctctcttttggctaactttatgttgtctgattgggaaccttaattacacctcaaaattcactcactcttgctgtattacataacataatggtgggagtgatagcccagcacctttgccatattgtattggttagaagacagctgcaggtccctctcacactcagagggaggggattacacaaaggcatggaaaccaggagacccacatgagtgtggccatcttagagttctgcccaccaaaggtaggcaaaaatgcagagatttgtgaggaaattgtgcagttgaccaacagtagtcaatagtagtcataactatctctgttagttttctcatctgcaaaacagagaaatatgataattaggtgacagtattattgcaaagactaatgagataatacatgcaaattttgttttacaattcttggtatgctggttctccattataaatacatacgattattattgctgttattattaaggatattatttgactttgccacctttagtgtgggaacctttaatctcatcaataataatttctcagtttttattttatttgtaccgagcagactctttagattaaaaagtgcattaagagagattgtctgggtttttttggttcggtatcttcctgtatactgaccttggctcccggaagaatgcatgaactccagaccttggtggattccttatctccctaggacaggcaatgggacaatgaaggaagcaaggaaataaattaaaaatgaaaagttatcttccacattatctgccgcattcatatacttgccaataacattgggccaaatactttggaagtaggtccagggataacattcagactggagaatggaaccgataatatccgcaggcattggatcacccactttttccccaatttatgctatgatatttatgagagcatgagagcatggaaggtaattccaactgctgtattaatgaactttcagtgtccctaggttgcttgcaaaaataaggcatcttgttggttttctgggtaaagatgagtctgacttgtattttatgtactgtgttcctgttaggtccaaagtctgaaatacctaacatcttcagcagggtgtcattcattcataaaccaggatgaaatacagcctctgtgctgaactttatgtcaaacactatacaaatcaggataaaagtccaaggtctttttgtcgagggattcacaccaagtggtgaaaccccatgtcaattgacagttacaatacaacctgtaacacatgaacgttttcattgcttgtcccatttcaaaggttgatcctatttttcatttacctataacacataaaagtgaaaattagtttctctagaagttttctctattacttaggttttaagtttttatgaagtagctatagagttccaggttttcagatctttttctttttctttgtttatttacattccttgtgtttcttctagatgctttacctaacaacttttaacttttctgctaggatctttcccctttcacttagaatgggaaatcttgcaagcataagaatttctatatattcagtactcgctgcttgctaagtggagatcttaatttaatatttcagttggtttagcagcagccgaacgagggagatgttgctggcatctgcacctgtgtttgacagatgaggatacaaggcatgcatgagcatctgtagcaacttgtttaatgctacattgataacaagtgataatttgagggaagaacttacattttctgcctcctacttctatgaaatttgcactatattaaatctaagtgtgtttaaataaagaaagccagatgtgtcatctttctcttttctctgccttggttcttattgatgacctatacctctcatttccattggtgtttcttactgtgggtctccactgaaagttgtggaaataaagatgaaaatcatgcctaggaaacaaaggaaaagagagaccaggtggcagacggtgcagagatttctttgagaggtacattgcacagatttttcaccccctcagaagtggaataaagttaaggaacaaagaattgagtctaagtccatctgcttcttgttaaatgaaaactatttgttaaaatactctaaaatcatttttttaaaaaaattgtgcattttaaggaggtttggcagtcagtaaaatatattaatgtattctacttttggtaaatcaaaatagaccaacttaatgactataccacacatgtatgtggagatatacataatcacaatgcacacacccagccattaatatcttctctgtgaaatgtttatgactgtaattgctgttctgattatatactgtgtgaacctgaaacacattattatattgggtgactaatggaattcaataacaatgcacagaaattgggattctggaaagagttgagttttaaactgtatttcctcctcagtttgaagtggatttcatgtctcatctaccacacagtatgcttatggctgatggattgaaatctctctgctaaatagtaaacaaccaagacaattcagtcttctcttagcttgcctgctttctcgtcactcattcaaaatatttttgttaaatacccaaaacccattaattagtaataatgggttttgagtattttgttaaatacccaatacctcagtttgtttaagagtttaagagtttctgttttccagctttgtggaattcattatttctttacgactttctttgaaagagagatcacagggtatatatgtggaaaacttgggtttgagtgaagaccctaaaattaattattcatgtattcagtcaataactttaccacactaacaatgcacagaaattgggattctggaaagagctgagttttaaattgtatttcttcctgagtttgataattaacatcttcagcagggtgtcgttcattcacaaaccaggatgaaatacagcctgtgtgctgaactttatgttaaacactgtacaaacagagataaaagtccaaggtcttttgtcgagggattcacaccaagtggtgaaaccccatgtcaatagacagttacaatattattgtaatattactgttaattcacttttatccatgctgttaattcatttttatccatactgacaaaaagagagggcatatccatcaatgcatcagtggatgcatctgaggtcctaagagtgtgatctccaagctttgcagggtgtcattaatggccttggaaataaagggttcttttagtacatgcctcgtttaatgattccggtaggttcttttagtacatgcctcctttaatgattccggtaggttatgtgactttaggcacttcaattcctttctcattgttggatggacttcaaggttagagagaacaaattttaatttctttattccacttttctaaagatgtatctaatgttatgaagtataatgcaaaggttctatgggagaacatctgtgacaaacaaaacgatttcaattgttgcttgagtttctgaacacctaggacatttgcttggatagaatatgatttaatcctaaagagaaattattaaaatagcagtcgatggcatttgtcattcaatagttttttcttcagctaactctcaccactaggcacacttttacattcagtaagtgtaatatttttatttgaaagttcccaatataaagaaatgatagttatagattcttcatattaacaaaagtaatgtattgctttatcaatgatattcacatgaaaggccttataacaacatgagtgagtatataattagtgcttctcaaagtgtggtcattggaccagcaacgtcagcatcacctggaggtttatttgagatgcagattctcaggcctgcctcagactcacggaatcagaaagtctgacaggtgacacggagcaaatctgtattttactaagcttttcaggtgactgtaatgcaggctacagttggagagccactgatacggaaggtatgatcatacccatttaatagatgaaaaaattgatgctcagtgtggtaaagttattgactaaatacatgaataattaattttaaggtcctcactcaaacccaagttttctgcaatatacactctgtagtctctctctcaaagaaaggagtaaagaaataatgaattccacaaagctggaaaacagaaactcttaaactgaggaagggcagaaagggaccatttcactgctttattgtaatgagttgttaaaactattgtcacgagaaaattaacctagaaaaagttttaatgatacaagaaacacttttgtggtcatgcattgggttcctcattttctttttagtggcagagagaaagggatgcagttaaactccagaggggtggctgtggtatgttaatagaagtgggagacactatttgaatcatcgctttgtagccaaatgagttcatggacggcatttccacccaggtcttccccacgccacattacccttgatgacagtgccctgcggtggttttcatgcacacagttggcgttaactacccttccgtggcttggggaatgaatcctggaagtggaatacagagttcattatctgtaatgcaaaagtctatataatgatgcctgctaagatctagttctttgttaattcaatttgggctttgcgtatataatcaaacaagttatgtttaagtctattgtttcttcaattgggaggaatttccttaaatagaaaatattacgggccgggcacggtggctcatgcctgcaatcccagcactttgggagcccgaggcgagtggatcacttgaggtctggagtttgagaccagcctggccaacatagcaaaatgccgtatgtactaaaaatacaaaaattagcagagcattgtggtgtgtgcctgtaatttcagctactcgagggctgaggcacgagaatcacttgaacccgggaggtagaagttgcagtgagttgagattgcaccactgcactttagcctgggtgatggagtgagactctgtctctcaaaaaaaaaaaaaaaaaaaaaagaaaaagaaaaaataaaagaaaatattactattgattaggtaaaaatactgtgtgtgagagatatatttttatcctatatagatgtaaaacatcatgcaacatatatggaaaattacatcaaatgtaaatgttagtgttttataaataattataaagagaacacccatgtaatgaccactaaatcccaaagtgattgttgctaatgctccatatacctctgtgacatatcctaagtgggttgtagttttctgcacacaattcctgcttctgtgagtttctacccgcaatttcctctctctgaaaccaccacccaccctcccaccccgatcacacagttataaggctggcaaactctgtctcatccttgtgtactggctgaaatcatgccatagctctctgtagccaatgtctgtagggcactttgaaatatttcctttagcatataatatttgacttgcttgtgaactcatcgaaactgggatcttatctttgtatgttttagtttctcagtactagtgtatacctgatacattgtaggcattcaataaataatgctccagtgaattaattactggcattttcacttggataaacccctcaaaccaacatctccagaatgcactatcattttgcccaaacttctgagtctcagtgtaggaaaggtggaaactgcagcgtgttttatgacttccctctttccttcagtcagttcctccattgccatctctctcctctttcttccaattacttaccttcattttgtctctcatctttcacctctcagatctccacttatttcccatcttctagattaaacttcttcaagcttgattcccttactgtttctcctcttccagcaaatattttggttgtcattgctgtagagatgaagaaacctggacatatgcttgacttactcatgtctggtttttccaccgtttcttcacagagggttctataatgtgcattttctgaagtgaagcattgaacatggttgagaccattgttttctaacactcataaggtaacctccaatattgtggatggtgtggccttcggggaactgtggcaccagtcactctgtattgcaaattccttgctgggttgccacctgtcacaccccaggggtttgggagaatttccacagggtcagacacagcatgaaatgggctaaggaaccctctaaaatggggaaaatgaaacttacaaggtcagagtgagcaagagcagagacccactgtttcctgtccacccttcatctcacagagaggtgtgtcaggagttctgttggaccttctgtgtgggtttgcattcgaggagtgagacttcacctttaatttggcctttactacaaggcaatcttaggtgcagaaaaataatcagaccagtttgcaccagacatttggaactggcagcagctgtttgaagaagttgactaagagcaaaaggtgctggttcttagggagcttggcctttaagaagttacagccactcctatccagaggttctattggcagctgaattaggatgcagtgcctccttccgggagaaggggattcgatgctccatccaacttgctcattgcccaggaatcatagttaggacatctggagtcactttaagacaactgctcactgcaccacagtcctacctggctggtggtagagtccactgtctaatgcagcaacctgtgtgtgtcacaaacctcatggctcagtctccttagccagacatttagggtttccattctttggccatattcctttctgatgtcatctctcatgacttcttgtcacatgttctgtggcctagccaatggaatattgaatgtcctcccacgtgaatccgcttccatccttctacaataccactgtacctgcacctttgcagttcttccctcctggatgcttctctatccttctccctacctcctttccccgcaatgttctctgtctctaagtgtctaaaggccacgaacacctcaaggttcagccaaaacctctggccctttctcatctaggcatttgctcatattttcccctccaactgggaggaacccctccccaacttctttttttccaagcttaatgatttctcataaacttttctctgagcccctaggaaaaaaactgtgttttctttgctgccccccaaccatagtagtcaactttaaaattggcattaacacattcccccttgtcttacacatatacatttctttacactcctatttgatgacaggtccatccaggaaagcaatcatatcttctatgccttattccctagagtaacttgtgtattacaggtgttcaatgatgggtaatgattaagtgaaaagatcagggcatgaggtatgtgtgcaaaaggctgggggctgtcagaggcagattcgtatctctgccttggccagataagctgggtatgtatgtgagccgatgggagcatcccactccgtcctcctccctaatctttctctctaccgacataccctcataccctcacctacgctcagtgactcccaggattatattcaaaagtaagaacaagaagacctgattcatcatgatttaggaatggcttgtaggatagactggggacataaccacacactttttgctttcaaaatgtataactgagcagttagcagttagctgtcttttgtttccaacctaattcaattgagaagtgatataagaggaaagaaatatcccaactgcagagaagtcttcagtcaagtctcaagataatttttttaagtgatgtcaatgacataaaacaaagaggaaaggtctgtgtcgttgcttaacgatttcacgtttttgccttccaggagacagagctactggatctcagccttgtcaaagatgccagatgtgggagacacgccaaagctcccaaggtaggaggttgagtgttgtgcatgcaccagatgctgccttgattgtttggctgtgtcacaatatcaattaattgccccaattaaaagtttctatgttatagatgttgtaaaacacaatagccagtatgccctaaacactttcacttttattaaaagacggaaacaatgaacaaatatgtgggctcttggacagaggggcttgctttatgtcctctaattttgcctttgtttgaaaaaaaaagacaacgacaacaatgcccaagttactgggtaattctaaatgattaaaaagtacttgaaattatttgaaaaaatctttgaacctcgtaaacatatgggaactaaccgttagacatgatgaatagaactcccatatagctgaaatgctctgcaattgaaatgattccatccacaatgccaaaaggtgtatagtcttaattctgcaaatgttactagtaaagatcagcatactttgggatgaattgtgtgcagtgtcatttgttttggtttgaaaaacttactgaagaaatattcaaagaagtgtttgcagtctgtttattttttgaagataatttttaaatattggatgaagaacataattttttaagcttagatgatctggtaggatatagtagcaggatatgttgtcttgccatcaaagttaaaagctattcttcattttatttaaaatttagtactttacatacttcatttctggcagagagggtattggcaaacatagaagtacagttgccatttaggagctcaatgcgtctttccatacttgatataaaactagctattttctatttgagtgtcttcccacaacttttgttttatcttttaaaagtcaaaattctttctctgacattaaaatgatctgttgctttggagatgcaagaaaaaaaaatcacctggaataattattcttcagaggcgtaaaaaggcagtaggtgccagcatattctatgacacagcaaacacacggctgctgggttttttaattttttaatttttattttatttgctgaaagggttaaaatgatctatggtaaaatgtaaaaaacaaagatttttgaaagaaaaattagaactgtattcaagaaggcttctataagtgtttcatatgaaactaatctgttatttacatttatctccttagtaacatggaatttcaatagtttagcctctcagttttgtatcagacttactataattaatgctttgttgatgattcaaaattgctcacagtttttagtataggaaagaatattttttcttcttcccccaacaacatttcagccaaatttcatataagcctgttagttccaagaactatattgataatgcagctatgaaatttatctttgaacctaagtttattggcctaacttgcaatttcaatatcgatattagttttaaagacagttgccgacactgcatcagagccctgtttgtccccaggcattgggagtcaaagtgaattctgctgccacatggagggtttctttcaggcttgaatctgtctcttttattgcggtacacagcttgcttatcagttaagtgtttcgtttatggatgtggtttgataaatgtctactgaacagtgacaaatgaacagcagtagggcctgtactgtgctcagctgataaaccactgttagatcctcaaatgcttctcgtgaggatggatttttaacacttagaatactctgactttgtcagcttttctccatcagctctttcttggagggactgattacttcctctttgaattatctatgctcctggcttcctttttttccctcctatttattgctgatgttcaagaacctcactctcctctaatattttcaaagcctggttctattaaacattacctgtgtggctttcctgagactccagcttcttccttgttggctaaatggtgaagataatgataataataagtacttgaaatggttgctataaggattaaatgaaataattcattaggaaacctttagcacaggagttctcaaatttaattgctcatggaattacctgggaaactttcaaaaatgctgatgtgtgttttccgcctccagaaatgctggtaccataagaatcaaattgatacaggtgtggtgtgggcatgatggatttgaaaaacaaatttgcagcaaaatttgagcaccactgccttaacttactcttggtgtacaataagtacttactaaatattagccaatattgttggtagtaacattgttgcttttgttatcactaaaaaattcaagtcagaattgtagaaagccacttttcatttcactcacttaatttggaaatgtttatgtcagcaaaagggatcagaggaggggcttatctcaaagggggttgtggattgacaggcaagaaagaagttgctattactatcagtttaaaatcttcaaatttccagagaaaacctcagctcaaattggacaaataaaaatataatttattgaaaatgactggaatgtattgaaaatttcagcggaattgccaggttcaggtgaagtttcattccactgctcagttaatgtcaccaaggactaggtgcctctttttttcatcagtatgccatgcaaggttctggtaggggttctgatatggcttggctgtgtccccacccaaaatctcatcttgaattgtaattcccatcatccccatgtgtcgagggagagaccaggtggaggtaattgaatcatgggggcagttcccatgctgttctcgtgaaagtgagtgagttctcacgagatctgatggttttataagtgtttggtagttcctcctgagttcactctctcctgcttccttgtgaagaagatgcctgcctccccgtcgtcttccagcatgattgtaagtttcctgaggcctccccagccatgcaaaactgtgagtcagttaaacctctttgttttgtaaactaccatcttgggaagttctttatagcagtgtgagaacggactattaccgggtccttttccatcttcaggttccccttggatgctaccctctgcacaccacccttggcagctcctggcctccccacctaacagtgtcatatggggtggcccaaaagagagactagctgcctatcagagaattgtatcaggattacagtataactaccttgtagaagaaggtgtagggcctgcaagaggaaaactagaccattgagttggttagaacaaaagcagcaacaggacttagagtagattaaaagtataaagataccaggataaagtgaagaaagcttggaaactggggacagaaaggcaatgtaacaaaaggacagattgagtgcaagactttctgcgggggcttatagaccataaaggaaggaagaacatttgtgaagcagatatttatcaaaatacccaggcaccccacaaatatttatctctatattcatattatttttgttttttacagcatctcattacataaaaattcaagatctggttgaaaatgaactgttttttgtgcctgctgtgatttgaaataacatttacaggaaatggaaaagcttccatgtgttaccctgtttatgaatttaaatgtcaacccccaacacaatacatgaaattccagatcttcttttctgtatataacctttgttcaagttgccagttttaaaatttcacattagagagaacttgggagatctttatccaaatgtaataaccaaaagaaaaacactgtatcctttgaaatctaaaaggtgcttactttttttcttgctctctctctccctccttccggccctcccaggtttgtagagcacacgtaagggcaagatgctgtggtatatatatcttgtctgtgctatgtacatgtactttctgggtcgtcacttcaaaaagatctttgcttttaaaaaaagtgtttatcactgcggcctctgatctattagtagttcctgacccatcagatccattcagtggctcatgtgcagctttcataaaataaaataaacttgataagagtggaaaataatcttgtcttgtacagaaaaagttgttttttgaaacttttttcatgtatgtgactgtatgttctgagtcacagcataaagtgtaatttttactgtgggcaatacatatcggagaagttttaaaaaggatgctgaacaagatcatttcttcagcctcatgattctcagcatgtattgagtgcttaggggtatggaaaagtggggaaagtggagatgtgggttcaagtgccagctttgccattaacaggcgtaaggaagttgtgctgtctgctggcatctctacttcctcatctatgaaatggggcatgggatacatggttttaggtatgtaagttccgttagcccttgattccagcttttaaattgagaagttaaacacccatgactttccaccttacagattgtaaaactgatgttgaataagtttacataacctgaaacttcttacctccttcatcatgcaaaccaagtgaaccaaaaaaaaaaaaaaaaaaaaaggtcacactctagccaaggtaaggtactatgccaacaaaaaggattaaagacttgtgtcaagcttctttatgtgtggcttctcaaaagcattctaggattgcttttggacaccacagggagcgacctcagggtcacagaggctctcccaactttagtacatgaaaactgtgtgctgccaacttccagctctcaagaatgcacgcagcaatgtcattgaaaaatatttttatagttacacaaaataaactgcttgtcatgctgatctgacaactagtttattctattggtaaagggcagttatttcagatatgtagtattaattttaatgtagattctttgtaaatatctaggccgcaattaaattctaggttgtatgtagtatcaccagaatcacataaggtagattagagtaaaatcaaattttaaaaattgattaggcttttctttcctaatctctacataaacatgatagcttttttacttcattctttattgattcattgattgattgatattcaatgacagaagtcattgagtgactctttctgccaggtactgttacaggtgctggaaaacagcaatgaacaaaaagacaaacagctatgctgtcatatagcattttatttaagagtgagaaagtggtggtagttttaaactgggtcttaaaaaagaaaagaaatcagccgggcgcagtggctcacgcctgtaatcccagcactttgggtggctgaggcgggcggatcacgaggtcaggagatcgagaccatcctggctaacacagtgaaaccccgtctctactaaaaatacaaaaaattagctgggcatggtggcaggcgcctgtagtcccagctactcaggaggctgaggcaggagaatggcatgaacctgggaggcagagattgcagtgagccaagatcacaccactgccctccagcctgggcgacagagcgagactccatctcaaaaaaaaaaaagaaaaagaaagagaaagagaaatccctgatttgctgtgttggctgacttcctttgggcaactatttccatggaggcaaatttcaagctaccaacctgatgtcattgaatgaagagttggaaggcaatacacaccatgtccagtagacctatcagcaggttccagcacctcatggggtaggggaaacagataacagataagtcccactgagaagcataaagcgggatcggagacctgagaaaatgagtgctgggaaggggtctgctgctttacagagccatagtggggaaaggtgtcttgataggaggcagttatatgagtagagacatgaacttagtgagggagagcattcctctttgccggggatacagcaagagcaaagcatatttcaggaatagaggaaggccaatgtggctactgtagagttcagaccttttaggccatgaaaatgacttgggcttttcttctgatggaagagggaaggcttctgaaagttctgagcacagaagtgatgggatctgagcttttgaaagttccactggtggctgttgggagtaaactacaaaagagagaagcaagcagaccaactaaatggctgctgcagatatcctggggtgatgatgataactttgcctgaggtggtagctagagaggtggtgaacaaagtgacataatctgaatatgttttaagatagagacacagggtttgataatgtattggatgtgaagtatgagcaaaagaaaagattctagaacaactattagtgttttggcccagaaaattgggagaattgggttgccatgtcctcagataagaaggaaggaagagcatatttaaacagaaaaaaatccagaatttggttctggatatttaaatgttgagatgcctgctagacttttacctgataatgtcaggacagttagacacaagtctggggttcagggaagatgttggccctggagatacaaatgtgggcatttgaggctcaaatcctgggtgaggtctcttaaggaatgtaggtgtaaaagaaagaggtttgagatctgagacatgggattgccagcatttagactttgaggagacttggaggaaacagcaaaagagactgagaatggtatatacgtaaaagaatagaaggcaggaacttgaacagacacttgtgtaccaacgtccatcgatggatgagtggatatacaaaatgtcgcatacacttacaatggaatattgtttagccctaaaacagaatgaaattttgacacatgctacaacctgagggaaccttgaagacattatgctgagtgaaataagccagacataaaaggacaaatatagtatgactctgttcttatatgaggtacaggcataccgcagcagcattgcagatttggttccggaacaacacaatacagtgaatattgaaaaaacataagtaatacacattttttggtttcccactgcatgtaaaagttatgattacactatactgtagtccattacatgtacaatagctttatgtcttaaaaatcagttatttttagacataattttacaattaaattaaataaaaaatattttattggtaaaacatgctaatgatcatctgagtcttcagcaagtcacagagggtcttgcctcgatatcaaaggctgctggccattcagggtagtgattgctgaagattagggtagtggtgacaatttcttaaaataagacaacagtgaagtttgcaacatcagttgactcttcattgcatgaaagatttttctgtaacatgaaatcctgtttgatattttacccacagtagaacagtagaactactttcaaaattggaatccatcctctcaaaccctgcttctgttttagcaactaagtttatataatattctaaatcttttgttgtcgtttcaacactgttcagtgtatcttcaccaggagtagattccatttcaagaaacgactttctttgctcattcataaaagtaaccccttgtctgttcaagttttatttatttatttttacttcttattttgttttatgtttttaattttactttaatttctcggatacatgtgcagaacatgcaggtttgttacataggtatacgcatgccatggtggtttgctatgtctattgactcgtcctgtaagttccctcctctcacctcccccaccccccaacaggccctggtttgtgacattcccctccctgtgtccacatgttctcattgttcaactcccacttatgagtgagaacatgcagtgtttgattttctgttcctgtgttagtttgctgaggataatggcttccaacttcatccatgtccctgcaaaagacattatctcattactttttatggctgcatagtattccatggtttatatgtaccacattttctttatccagtctatcattgatgggtgtttgggttggttccctaactttgctattgtaagtagtgctgcaataaacatatgtgtgcatgcgtctttataatagaatgacttatattcctctggctgtatacccagtaatggaattgctgggtcaaatggtgtttctggttctagatccatgaggaatcaccatactgtcttccacaatggttgatccaatttacattcccaccaacagtataaaagcattcctatttctccacagcctcaccagcatctattgtttcttcactttttaataatcacgattctgactggcatgagatggaatcttactgtggttttgatttgcatttctctaatgatcagtgatgttgagctttttttcatatgtttcttggctgcataaatgtcttcttttggaaagtgtctgttcatatcctttgcccactttttgatggtggtatttgttttgttttgttttttttcttgtaaatttgtttaagttccttgtaaattctggatattagacctttgtcagatcggttgattgcaaacattttctcccattctgtaggttgcctgttcactctgatgatagtttcttttgctgtacagaagctctttagtttagttagatcccatttgtcaagcttggcttttgttgcaattgcttttggcatatttgtcatgaagtctttgcacatacctatgtcctgaatggcattgcctagattttcttccagggatttttatggttttgggttttacatttaagtctttaatccatcttgagttaatttttgtataaggtaggaggaagggatcaagtttcagtttcctgcacatggctagccagttttcccagcaccatttatttaataggagatcctttccccattgtttgtttttgtcaggtttgttgaagatcagatggttgtaggtgtgtggtgttctattccattggttctgtatgtctgttttggtaccagtaccacctgtttcggttactgtagtattgtagtatagtttgaagtcagctagtgtgatgcctccagctttgttctttttgctcaggattgtcttggctatacaaggtcttctttgatcccatatgaaatttaaagtagttttttctaattctgtgaagaatgtcaatggtagtttcatgggtatagtattgaatctataaattattttgggcagtacggacattttcatgatattgattcttcctatccatgatgatggaatctttttccatttgtttgggtcttctcttatttccttgagcagtggtttgtagttcttgacaagatccttcacatccctcgttagctgtattcctaggtattttatgctctttgtagcagttgtgaatgggagttcattcatgatttggctctctgcttgtctattgttggtgtaaaggaatgcttgtgatatttgcacattggttttgtatcctgagacttggctaaagttgcttatcagcttaaggaatattggggttgagatgatgtggttttctaaatatagaatcatgttgctgcagacagagacaagttgacttctctcttcctatttgaataccctttatttctttctcttgcctgattgccctggtcagaacttccaatactaggttgaataggagtggtgagagaggccatccttgtcttgtattggttttcacagagaatgcttccagttttttcccattcaatataatattggctatggctttgtcataaatagctcttattattttgagatatgctctatcaatgcctagtttattgagagtttttagcatgaagtgatgttgaattttatcaaaggccttttctgcatctattgagataatcacatggtttttatcttggttctgtttatgtgatggattacatatattgatttgcatatgttgaaccagccttgcataccagggatgaagctgtcttgatcgtagtggataagttttttgatgtgctgctggatttagtttgcagtattttatcgaggatttttgcatcgatgttcatcagggatattggcctgaagttttttttgttgttgttgtgtctctgccaggttttggtaacaggatgatgctggcttcatgaaatgagttagggaggagtccccccttttcatttgtttggaatagtttcagaaggaatggtaccagctcctctttgtacctctggtagaattcagctatgaatccatctcatgctgtgctttttttggttggtaggctattaattactgcctcaatttcagaacttgttattggtctattcatggatttgacttcttcctggtttagtcttgggaggttgtatgtgtccaggaatttattcatttcttctagattttctagtttattcgcatagaggtgtttatagtattctctgatggtagtttgtatttctatggggtcagtggtgatatcccctttatcattttttagtgtgtccatttgattcttctctcttttcttctttattagtctagccagcagtctatctattttgttaattttttcgggaaaaaaagaagaagctcctggattcattgattttttttggagggtttttcatgtctctatctccttcaggtctgccctgatcttagttatgtcttgtcttctgctagcttttggattagtttggccttgcttctataactcttttaattgtgatgttagggtatcagtttgagatctttctagctttctgatgtgggtacttagtgctataaagttccctcttaacactgctctagctgtgtcccagagattctgatacacgttgtctctttgttctcattggtttcaaagaacttcttgatttctgccttaatttcattatttacccaggagtcattcaggagcaggttgttcaatttccatgtaattgtgtggttttgagtgagtttctttttctttttttttttttttttgagatggagtcttgctctgtcgcccaggctgaagtgcagtggtgtgatctcggctctctgcaagctccgcctcccgggttcacgccattctcctccctcagcctcctgagtagctgggactacaggtgcccaccaccacacctggctaatttttttgtatttttagtagagacggggtttcaccatgttagccaggatggtctcgatctcctgacctcgtaatccacccatcttggcctctcaaagtgtctttttttttttttgagacacagtctcactctgccacccaggctggagtacagtggggcacaatctcagttcactcttgtgctccacctcccgggttcacaccattctcctgcctcagcctcctgagtagctgtgactacaggcacctgccaccatgcctggctaatttttgtatttttagtagagacggggtttcaccatgttagccaggatggtctcgatctcctgacctcatgaccagcccacctcggcctcccaaagtgctgggattacaggcatgagccaccacacctggccttgagtgagtttcttaatcctgagttctaatttgattgcactgtggtctgacagactgttatgatttcagtacttttgcatttgctgaggagtgttttacttccaattatgtagttgattttagagtaaatgccatgtgatactgagaagaatgtatattctgttgatttgggttggagagttctgtagatatctgttaggtcccgttgatccagagctgagttcaagtcctgaatatacttgtaaattttctgtctcattgatctgtctaatattgacagtgggatgttaaagtctccaacaagtattgtatgggaatctctgcgtctctttgtaggtctctaagaacatgttttatgaacctggatgctcctgtattgggtgcatatatatttaggatatttagctcttcttgttgaattgatccctttaccattatgtaatgccctttttttgtctttgttggtttaaagtctgttttgtcagagactaggaatgcaacccctgcttttcttttttcttttggcttccatttgcttggtaaattttcctccatcactttattttgagcctatatgtgtctttgcatgtgagatgggtctcctgaatacggcataccgatgggtcttgactctatccaatttgccagtctgtgtcttttaattgtaacatttatcccatttatatttaaggttagtatggttacatgggaatttgatcctgtcatcattatgctatctggttattttgcacactagttgatgcagtttcttcatagtgtcattcgtctttatattttggtgtgtttttgcaatggctggttttcctttccatatttagtgcttccttcaggagctcttgcaagtcaagcctggactaaatccctcagcatttgcttgtctggaaaggcttttatttctccttcgcttatgaagcttagtttggctggatatgaaattctgggttgaaaagtgttttctttaagaatgttgaatattggcccccaatctcttctggcttatagggtttctactgagaggtctgctgttggtctgatgcgcttccctttgtaggtgacctggcctttctctctggctgctcttaacattttttcctacattttgaccttgaagaatctgaaaattatgtgtcttggggttgatcttcttgtggggtatcttagcggtgttctctgtatttcctgaatttgcatgttggcctatcttgctaggttggggaagttctcctggatgatatcctgaagtgtgttttccagcttcttttcattctccttgtccctgtcacgtactccattcaatcgtaggttcagtctttctacatagtcccatatctcttggaggctttgtttgttccttttcattattttttctctaatcttgtctgcatgccttatttcagcaaggtggtcttcaaactctgatatcctttcttctgcttgattgatttggctattgatacttgtgcatgcttcacaaagttcttgtgctgtatttttcagctccatcaggtcatttatgttcctctctaaactggttttctagttagcagctcctctaaccttttatcaaggttcttagcttctttgcattggattagaacatgctcctttagctcagtggagttttttattatccatcttctgaagcctacttctgtcagttcgtccatctcatcctctgtccagttctgcacccttgctggagaggcattgaggtcctttggaggagaagaggcactctgcattttgggttttcagtgtttttttgttgattctttctcgtctttatgagtttgtctagttttgatctttgaggctgctgacccttggatggagtatttgtggggattttttgttgttgatactgttgttgttgctttctgtttgtttgtttttctttcagtggtcaggtccctcttctatagggctgctgcagtttgctgggggttcacttcaggccctattcatctggtttgctctcgcaccaggagatgtcactcaaggaggctgtaggacagcaaagatgggtgcctgctccttcttctggcatctctgacctcaaggggcaccaacctgatgcgagtaggatcgctcctgtatagggtgtctgacaaccacgttggagggtcttacccagctgggtggcacagggaacaggacccatttaatgaagcactttgactgtcacttggtggaggggatgtgcttcgctggggagaaacccactcttctgggctgcctggattcctcagaactaccaggatgaaaggctaagtctactggtccacagaaactgcggccactcctctccctggggctcaggcccaggaagatcagggttctttccctgagcctctggctggagttggagttcctgcaaggagtccccaccaagtgagaaaggatgagtcagggtcaggcctgaagaggcactctggctgcagtctgccacagctggtgtgttgggctgtgggggaacctcttgggaccaagctgcccagccttcctggccccaggagaggaaaagcatggcctggagctgtagagatggatgctgtccttccccacccagggagcttagcgtgacaggcagttacaagtcccagtgctggctgctgcccctcctccaaggagttcaaatggcttagacagcaggcagccacagctgtggtgctggtggcccctccccctgggaacttggcaggcttaagcagattcgagctgagaggctgttgagaatctgcacagctctggggttgggaccctaggccccagtggcgtgggttcacgagtgggatcttccgatccatgggttgcacagttctgtggaaaaagcatggtttccccggctgggtagcacgctcactcgctgcctcccttggctggggggtgagggctcccctctcccatgtggctctcaggtggaccaccacaccacactgctcttccttcctctccatggatcatgccagctgcctcgtcagttccgatgagagaacctggatatcttgattgctggtggaggattcacacactattatgattctttttgatggagcctctctgatggctgctgctcctagttggccatcttggccctgcctccccgttcaagttttattataagattgcagcaaagcagtcacacctttaggttctaataataattattgtcctctagcaatttctaccacaactacagtgactttctccactgaagtcaaagtcgtccatgaggattggaatcagcttcttccaaactcctcttaatgttgatattttgaccttctcccatgaatcttgaatgttcttaatggcatctagaatggtgaattaaggttttaaatttacttagcccacatccatctgaaaaatccctatctatagcagtgtagccctacctaaagtatttcttgaataataagatttgaaagtcaaatttattgatccatgggctacagaatggatgcgttagctggtataaaacaacattaatctccttgtatatcaccatcagagctcttttgtggccaggtgcattgtcaatgagcattaatattttgaaaggaatcctttctcagcattaggtctcaacagtaagcttaaggtatttagtacaccatgctgtaaacagatatgctgttatcagattttgttgtgctgtttatagagctcacgtgaaataggtttagcataattcttcagggccctaggatttccagaacagtcaatgagcattggcttccacttaaagttaccaactgccttaatgcctaacaagagagtcagcctgtcctttgaagctttgaagtcaggcattgacttctctcaagatatgaaggtactagatggcatcatcttccaacagaaggctgttttgtctacatggaaaatctgttgtttggtgtagccaccttcatcaatgatctcagctagatcttctgggtaatttgctgtagcttctccatcagcacttcctgcttcaccttgcacttgtatgttatggagaaggcttctttctttaaacctcatgaaccaaccactgctagcttcatacttttcttttgcagctttctagcctctctcagttgtcacaggactgaagagagttagggccttgctgtgggttagattttggcttaagggaacattggggctggtttgatcttctatccagatggctcaaactttctccctatcagcaatacgtttgctttgctttcttatcatttgtgtgttcactggagtagcaattttaatttccttcaaggacttttcctttgcattcacaactgggcggctgactgcttggcacaagtggtctagcttttggcctatcttggcttttgacacgccttcctcactcagcttaatcttttctagcttttgacttaaagtgaaaggtgcatgattcttcctttcacttgtacacttagaggccattgtaaggttattaactggcctaatttcaatattgttgtgtctcagagaaaagggtggccccaggagagggagaaagataagggaacagctggccaatggagcagtcagtacccacacaacatttattcattaaattcaacatcttatataggtgcagttcctgatgctccaaaacaattacaatggtaatatcaaagatcactgatcacagatcaccataacagatatattaattattcaaatgttgtgaaaattaccaaaatgtgacacagatacatgaagcatacacatgctttgtaaaaatggcaccaacagacttgctggactcaggaatgccacaaaccttcaatttgtaaaaacaaacaacaaaaaacccccacaatatctgcaaagcacaatgaagcaaagtgcaataaaatgaggtgtgcttgtagctattgtagtcaaatccttagagatagaaagttgcatggtggttgctgggcctgggggaggagaaaatggggagttattgtttagtgggtacagagttttagtttgagaagatgagaaagttctagagatggatggtggtgatggttgcacaacagtgtgaatctacttaatgccactgaactgtacacttaaaaatggtaaattatatattatgtatgttttaccactttttttaaaaaaaaaaaaaaaaaaaagaagaaactgagaaggagcaaccagtgaggagggagaagaaccagaacagtgtatttcctggatgcctaaaaaatatttcatggaggaaatcaaatggtgaattcaggtcaaatgatgaatttccttctagcttttctttttttatggagacttcactttggcacacttgtaactttactgacaatacccttttgtatatgcttttttttcccttatatcatgaccgtttcctgctaatattcaaattaggccgtttatttaagggttgtcaaatctcaaatagctcatcatagaatctggatgccaatatataaatctcataatgagctgttatttggatgttatacaacagtggtttcaatgaatcatccatgaggcctggagttgaaatgaatgctttatttattgtctcccattgctgattataagctgtttccctgactttgtacagatttcaccattatgtgaagccacagtcataaaatttggtatagatatttgaggtttaggaaagaagaagaaaactctttacacaacaaagtaaaggtttctccttttttctcctgattgctaaggagatcaacctttgacccttattcttggttccaactatttcttaatttacctaacatgcttcagtagtttttttggtttgttttttggtttgttttgtcattttgttactataaatgtgtttttatttacatctttactaaatggagcaaaatagggctaacaacttattgaatgatctgtgtgtgtgcgtgcatgtgtgtgtgtgatggttttgacagctattcacatttatctttagatgtaaattatatggcatagttccttttttatgttcattaaattccatagatgtcagtggtttccttggaaacaaaaacctttatataactagtcagagatttggtagcagaaatatcaggatgctggcaggggttcaggggtggttaaggaatggttcccttggcagatgtttgcatttaaaactcttctgacttttctccctgccccttaccatcatggccattcaatagtgcacaagataagatttttaaagctactattaaaatgtagaatattttctttaatggctaaaagctttttactttaaaaaaaaatcgcagatatgttaagtcttttctggggtggtataatttcccaaatttgagaagaggttggtgtatctcctatcaacagttaaatctgcatgtttaggcaatgcctacatttttcagtatatatggtgtccatttgtaaaatacagtgaactgcatatgtgtgtggttgaatcaagattctatgtcatttataatggccagcatctgtcctattaccttattgccaaagggttctaaaggacctggagaggttgtagagaaggtaagggaaaggtcacggttctgctcaagggtaatagtaggtgaaaggcctggcagccaagaacattctcacggaggcccagagtggacctgttgttgaagacagaattagtaccatgagttaatgaaacccaggtcttttcagaagattgtgactcatttttatcattgcccctgtctggtgtaatttcaacgtaaatccaatttgttctacatgcaatggtacatagttgcatttgggaaacatttctcaattttaattcttttaaacgcaataatgcgccatcttgtggacatatccgatattaaattcttaaattaattctacatagtgaactgctctctaagccagggttttcaatcatgggttctaatatagagatatgagaagcacttggggagcttttaaaatcctgatgtgcaggccacaccccaatcaattaaattgaaatgtctgctgtggggctccaacactgatattttctttaaagttcccaagagattccagtgttcaaccaagtttcaaaaccattcgtctaagtaaaaagagtaccagcttaaatggatgatttctcttttgaaaatagagattttacacagaaaagcattgagaattttcctacaaaatatgcttgtcaaaaggaccacttttcagtcaagttttccttaaacttgaccactatacttaatgtagagaagtacaccacggtacttgtatcagtcttctctggttaccacagcaaagtaccacaggctaagtggcttaaagcttaaacaacagaagtttattctctcacaattctgggagcgggaagtctgagacaaaagtgccagcagggttattttctttggaggcctttctcctcggcttacagatggctgccttccccgcatcttcacgtggtcctccctctgtttctattcctaatttcctcttctaataaggaacaagttgtattgcattagggcccaccctcatgaatgcatttaacttaattacctctttaaagcactattgctaaatactattaccttctaaattactgggggttaatacttcaacatataaatgttgaggggacacaagtcagcccttaacagtgttccctcattacattacaaagcctagcttaggatttgcttctttataaggagtagcagtgtatgattattttgctgttggtttaatatagaaaagtagatttttttctttataatcaatacaatggtcaatgtggataaaactgcatagtcagaatcatttcagaaatacacaattgcttttgcagagtggctttagtacagaatatgttgatttggcattatcagcactaatttctgcatgccccagggcacccagtatgtgtctttgtgtattgcaagtgcctataagagtatagttattaaggtcacaagctcttgggtcagaaagccaagccacaacaccaataacaagctgtataatcctgcaagttatatcatgtctctgagacttagtttcttcatctgaattacaggaataatcgccatgtttatatcatctagttgcggtaaggactaaatgacaaaatgcacgtaaggcacctaacacaattgtcacatccattgtttgtctaaatgcattttgccatcattattaagtaaataaaatatataacttacatgtatgtgatgtagtgggaaaaagcaagttaaataggcataatttacctatttaccatagaattccatgcactaatatagattgtcactataatctatatttatatatatagattgtcactataatctatgtataagagatttatacttttgtagctgtggcatttaaacctactgattaaaatctaacttctatgtattagctatagaaaaatgaacttgaggcatatttctctttgcagccaaacacctacccccagagaactatcacagcaatattgttgtactaagacttacagttcttatttagaaaactgtctagatttgccaacagttaaatagattttccaaccatcaaaataattttagagcaatttactttcagttaagaacatgcgggtatctttttctgcactatgaagtcattgaagcaaaatccaaagcactgttttgaaatggaataacaaggttaggggtcagagagacccagattcaaactccagtgcacttattagctgagagaacccaggaaggtttattggtttccctgtgaatgataatacttgctgtattgatttgtcttgctagttggattttaactggtaacaagacataaatcataatgtttgatactacttacttccctatgggccttaagttcacttttcagtgtattcttcttaatgttctgtgagactggtaaataatgaagtatatatatatatatgtgtgtgtatatatatatatatatatatatatatatatatatatatacacacacatatatatatattacttgaacttcctcaattttggagattaggtcataaactaatgtggcatgtaatttgatacatgttccagcaggggaaaatactgggatgtaatttaacgaaagaaacattttgaaatgggaatattctctgaaaatatggagtatatcattacaattccttttcagctttaggactcataataaactgggcactgtccagtttatgagcagcgagttcctatagtttgaaagtttgcgtcccctccaatattcatgttgaaacttaatcgccgatgcaatagtatttaaagttgtggccttttgaaggtgattaggcaatgagaactcctccctcatgaatgtgattaaggtccttataaaagagatttcactcaaggttcagtcttttttgcccttcctccttggcccatctgaggacacagcattcgaaatgccaccttgaaacagagagcatccctcaccagacacggaacctgtctacgccttgattttgagcctcccagccttcacatctgtggaaaataaatttctgtaaatatttcccacctgacagatctttgcttataaattggccggtctgtttgttatagtagcacacatagactaagatactagtttttaatttgggtactgcagctgatggaataacctgggtagagtcataccatcttttaggaatctcaccttcctcataaaaaatgaaagagacaagcaggatgatccctggggactaaaggtaatatttgtatccatcatggagctattgggagaactaaatgatatacatctctcaaatggatttgccagccataatgtgtgatatagtaatatcaatttgtgagtaagttgggtagagtggaaggaacttaggaatgtataccagtttattctgagaaatttgtgttttgtcttctttgaatgggaaatggctgaaaattcttaaattccttcaatgtaccataaaaaagtgaaatcctatatcactgcctttggatgtgatacatgacccatagtaggtattttcgtagatgaaagaattcctatctatggcatttatcttatgtgaaaagtggcaattaagatagtaacatatttgccacttaacagatatttgttaatgatgaaataaagttttccggaactcctgaaattaatgtccatagagatttcaagaagatggaataacctaactaattagacagtatgtttgttggtgtttaaaggtgagacaagaccactgagattaaaagatcagaaaattctcctcacacacctaatacattttctctatgccacctggtacttctgtactcaaatgctgcttgatttttatatttatacccaagaattactgatttcaggtaagaacagagggcttgagagaagaatttgctcatcactgcctgccatgaatgggcatagctctgtgaacagttattgtatttttttttcctcaggtatatagaatactttatcaaaaccaaaactcactgtttctccaagtgagttccttggaatactaatagatgctataaaaatgtcatctaggtgtggtggctcacatctgtaataccagcactttggaaggccgaagcaggaggattgcttgaggccaggagtttgagacccaaagccctatctcttaaaaaaaatataggtggatgcagtggtgcatgcctgcctatactcccagctactcagtataggctgaggcgggaggatttcttgagtccagagttcaaggctgcagtgaactgtgattgcaccactgcactccggcctgggtgactggtcaaataagtttgggaaatgctaagggttcctttattgcaggatttctcacagcttttgatgtgttggacatgggttagtgtcacttctttcttttttctttaactatgggtctcttggtcacaagcatctcataggattaatataaatgttctaaaagccatttattatgaagttaaccacacttaataaactagaacaccagtttatgagtgatgcttgtcttcacagtagtgcagatcctattaaagatgtttagagaacaggttcttaggtgatctaaaccagaaaggcctttttcatatatcttgataatattaatataatgttgaattttgtcttgtattatattatgatgttttgaattttaaagtttactatttgcattcttcccacctaattaatttttttaatttgagaccttatgacagaaaaccatcagcattgcccacatattactcaaaacacaagaatttcatttattcccatagcacctggaatctatgctggcatttagacaagcctaatgcctagtgtaccactagagtgagattctctgtccactcttaactatttctagagcctatttttctatggtttcacatcttatgacttatataaaattggtactacttggcctttgtggaaggattttaagtcaaggtaaaccttgaattgaggttagattaaaagtggtagaacttacttagggagcaataacttttaatagtcatagtttcttttcggttcctggtgtgtgtgtgcagaaagaaagaagtctgatgattctctggttcatgggagttgacttttatgccctgaaagtgaggctttgcttctgtatcctcacactggggaacagcagtggttaagaggctccaccagtattactcatgtggtcacaatcaagttgcttaacttcatgtcttgctttcttcatccataaaatgaagttaatagtactatttctcagggttattgtgaggactaaaggccataacatatatttcataataggggatctgtaagttgtagttactgttatccttaaaactataggccattagtgcatatgtttaataggcttgaagctgtgccattatttgacaagttaaactcttggttgcatcatccatattctcaatgtttttctttaggtatttgcatttgccatctatagtatataggcttctatctggcaaagttttcacttttaatggtatctttaacaatatttttcaaaagctttgagcatcactcatatttcaaaaatagtaaggtcatgttaaacttttaaattaaatcgtttcttcctagactatttcaagatttgtaatacctggttaaaattgtttagcaaacacaatttttctttctatgaatgttaattaaaaattaaatttgactctctttagttgaaattagtcattttgtatctgtgcatgaattacattttccttgattcttatagtaccttagtataaataaatttagtaagagtttaaaaagaagtttccttggttgaggtacatacaaacaatatgggaaattgaacacctattgactttattatttttgccatagataaatctctactgtcgaaagcagtagttaatgagacatttattttattttatgggtctctgaaacatgcttctctattaatcaatttgcttgcaattttgtttgaagattaaagattctttagaaggcattgtctacatattattacttatggataccagatgaaaatctaaataaaattaatttaagatctcttatattagttctgtcctacacatataccaaagaatgtggaatggctgaataaggaaaattaaattttaagtttacacaattttaaagtcaataatgctttcaaataaattatctatacataatattgaaaaggaatagctcttagaatatctaaaataaaaatagatgattgagtgggatatttcacatgagttggtggtttataaaactttgagaaagtatgttaaagaataaattgtgtaagtaatagcgaactagactcagtatttaattttatgcttagctgctcaaaatttcatggtttgagttgagaattcttaagtcaaataatttatttgaaggatactgtagagcatttgaaatactgtgaaggtgtgactagaaatctgtttttcccattttaaaaaaaaaacaaattgttattctagactataaaatatagaaagtcataatagatggatactcttctctgtaaatatattttcccctgatacttaactgtaccatgttattctaaattattcctggtaaatgcttacaactcttccaagtgtctggaaactcatcaagcttcttttaatcatgtccctcaaatattcggcttgtaatttactaatattcatgccctgtttagattgtaaacagagaaactacaaagttgtaacagaaaagtaatatattgagctgaatcatgccttacttttgtaagttgagcttgtttctctggcaacaagatgttagataataaatcatatatctaaaaccatataactacagaagtggggagctgaaagttcagaagtatcatctgactgtgttgatggcatctttacctcaattaataaggtgtggcaacgttcactcaaggacagaaattcaatctgtggtggatccaaggggattcaaaatatttcttttaatccaaccaaaacatattgctttaatggcattagttggtattagttgcatgtggcaaaaatttcatgcactattaatcctagcactacactgcaacactagaattatgtgtccttggccttaaataaattattcggttgtatgattgagaagagaaaaaccaattattttagaggccagtcctgaattattgccttaataaaggttcaatttcaaaaaaatgggaagttgctcagtccagttgaaaaacaaggtgggaagagtaacagcaagtgagtctttaattttgtcaacatctgatgctactgttaacacaaaaagttgctttgaaaaaaattcaactaaataagttgccttcgtggtttagtaattccagatatacacaatcgtctgtttattttcccaaagatcaaactgtgttcatctatatatttgcatacgtaacatattaaagttttctcatctaacatgacactgtaagcatggccatgattctaaatatttttaatatttatcagttgtatagctgaataataatgcattgattggaaatcatattaactacttactatttacttttgagtagacaatttctgttttatttttgctattataggtaaatctgaagcagatatctcttcttcatttggcgtttttattctttggtaatgcctcaaattgtaatcctagcagtgagattacagatccaaatagatctaattcaatccattatcacaggtttcttcctcatttcctcttctttcatgtatatctgtttttgtatagtggcaattttgattccttactgcattaatgtattcacttctttgtcatagtctacacaaaataattctagaataaaaatactgttgctactaatacaagtccactagagaaaatccaacgtttctttgcaattatctttattccttattgtatgcttcactaagaatatatactccaagattattaaaattattttctatagagttatattattaatttgctatacacttagatttatatatttatagttacgttcagttttagagattaaaatgctctattgcttttatcaattttacatttggaaagtataaaatattcctttgcctcagcattcaaaattatataaagaagaatgctcagggaagtcactctcatccatatccttccaccctattcctacccaccttctggttttccttaccatgtttctgtttacaaaaataaggaaacacacacacaaacccatacctagctacccagtcctctcatctcatttaataaaaagtccatctttccccagtgaattgagacaccagttttttcaaaatatatgtaaattgcctcagtctttcttacacaaaatgtaacattctatctatgtgcttttataggttgcctgttttacttaatataacgtcaatacctcttcatatgggtcatgggaatctttttcattcttttgtacagctgcatattgctccactatatggaggttctgtagttttttcagtcttctgtgaatgagcatttaggttgtttccattattttttattatgcataaggctacaattttttttttaaatgccttcctttacatatgcaaaagttcagtttcaggataaattcctagatttgtttgttttgctaacatcttcatagactttttctttgtttagattttaccattttctaccccccttgcagtgtattacagaatctttattcacacagtctcaccacaaagtgtattgttaagcttgttatttttgccactttgacaggaaatgtgatcaatacattttaacttacctttttcttacctatgcatgaaactaagcctcctttcacatgtttaaggaccatgcatgtatatacatacatatatttctaaaacatatataaatatgtatttatacacacatatatgtcttaataaatatatgtcatatgttttaatatgtcataatatatgtcttaatatacataaatatgtcttagtcactttggacttctataacaaattataaatatgtcttagtcactttgggcttctgtaacaaattaccatagactggtggctgaaataaaaacattacccacagttctggaggctgggtagtccaagggcaaggtgccagcaaatctcatgtctgctgagggcccacttcttggtttgcagttggctgcattctcattgagtcctcacataggggaaagcagagagagggagagttgactctctagtctctttttccaaagacactaatcccattttgagggctccaccctcatggcctaatcacttcccaaagtccctacctccaacgccctatcacgttggggtttaagcgtccatatatgaattttgaagggagacaaacattcacttaatagcacaatgctcatttgcataatttgcactttttttttttcatctggtatttcgtcctttttttctccccttggtttttttgagctctttatatatcaggagaattagctctctatcgtaccctagaggtgcaaaaatgttctcccggtttattttttcccttttgattttgcttttggtgtttttttgttgctgttgttgatgttgtttctgccttgtaagtttttgtttttatttttatctagtcaatttatcaatattttatcttattgcttttggcatttgagtcacagttagtaagtctttattcatgcctagtttataaagaaaattcacctatagcttctttttttttttctagtatgacttcgtgattttccatttagatcttggagcatcttggaggttttttttgtttgtttgtcatgaggtatgaacccaattttatttttctaacttaccgttcttttgtcccaacactatttttttcagaccatcttttgccctatcctggtatctaggtgttccaataacatttatttaaaagtccaattgtatatctctttttatttgcaatccagttgtgccaacaccacttatttaaaagtctatcttttgtactacttatcaaaaagtccaacttttgtctaggtgagttaaaatacttacctttttcatatataatgtttccttccatgtgtacctggatctatttctggaatattttttactatttcattgttcagtgtgtctattaatgcttactgaaatactttaaattcaagttctataagggaaaagtggattcttattctagaataacaaaacaattagaaattggcattttttaccaacccattatatcaaatattactctcaatactattctctgctttccaacaaccacctcccaagaaaaaactatttttccctaagacaatttttgtttgtttcatatattttatgtaggtagagaatgccattttctagttttcaaaactttattttttttactttattttttcaaattcctagaaaatgacaaaatcattactagttaaacaattagcaatatcttgtagatttacccacaaagtcccgaaaataaaaataagaaaaaaaaccttttggttattctgccttataaactttcatttttagaaatccatgccatcatataagttgtttgttctataatttctgagctcattttatgtaaaaataactcctgtgcattattcatgttgacaggccctttaaatagccataaagcctgtgggaacagattaatgctgcatctgccctgtgctttttaagtctatcatttttatggaatggaaatcttgcataatgtcagaagttttctgacattgtcaactgcttgtggtggcatagggaagtaccttagctgcactatgtgggtgacaatgtcatatttcctgattggatttttatctgaggagggtgagaactgtcagtttcacttcctcttagaaagatattttaagttgaataagttttcctttaagtgacttgtcacaggtggcaactgtctgagcctgtgtattctattctttgtgccagaattttcttaccactgattaccaggcacataatcactcttgccatttatgacctttgggaaatgaaaattaaaatgttattagtccatgtgggtagcagtggaattggtctgatgtaatgtttttaaattgtttttattttttgaaataaatgatttttacatctactaaaaagtaaattacaactattaaaggttatcttattaaaaagtatttccccttctccatttcttctgttcccttcccctgaggcaaggattcatagtactgcagtttcttgttttcgtttcccagaaaacctgtaaatgatgacatgctatcaaatgctatttaaacttagcaatttgttgcagaaattatgccgtgtcagcacaaatacaagtcctcattctttttctagaggttgtagagtattatttcattttatagatgtgccataatttatgtacttagtcatttgttaataggcattttattgtttccggttttttgctgcctcaaacaatgctttgatgtgtatatatatgtatatataaaatatcatctttgggcacaatacaggtatattcgaatttcctgttggtgaaattgctaagtccaaatatatgtgcatttttaattatgaaatgcattgccaaatggctcagcgaagagattatataaattaatcaattacacttccaccaacaacaatcaagattacctgtttcttcatactcttgccaacaccatgtttgattgaatttttttgatctttgaaatgttatagatgaaaaattgggagctctttattacttaaatttgaatttcttctactgtgagtggagaggaaacttttcatattgtgttgtttgtatttctaaccatatcctttgcccattttccaatatatagttcttctcactgtttcgtaagatattttgatatattaagagctatcatatactggaaatatgatctccagcttttaattttaatttgaccttgtagaattattgccttccagaattatgttttgtagtcaaatttattagtccctttttaaaaactgtacttccaaacagagcaccgcttggaataactattctaaaataataaagattattttgtgatttcttccagtgtttttatgattttaatttttatggttgtatctttgagctatctggaccttattttatgacagtgacaaaggaatctttattagtcaggattaaagtagtccatgataacaaacaactcccaaatgtcagtggaataacacatcaaaaatacatctcttgctcaaaccatctgctgaaggtctgcaaaaacattccaagatagctatcctcagtgatctagggatgtttctgtcttgagctcaaccatctcagcaagaggccttgcatttgctgtggcaggagaaaacagctagagaatcaaagaggattcctcaatgcctcagcctagaagtgacatgcatcccttctgcttattgaccatgtccaagtcacatggcccagcccaattcaaggaggctgggacatacagattccagtatgcccaggggtgaaaggagaaccagtgattagtgagctcataatgtttaccataatatctattttatgttactctagatggctgccaggtcatctaacattacttattgcataacctatttttttctcattgatttggaatgctatcttggttatacactgaaagcttctgtatctttccattttcccctgagatcattgacttttctatatatttttagactagtaataaaatgttttaattattgtggctttacaatatatattacttggtatagtcctgctttatcaagttttatttacatttatattaattttcatttgaatttcagaatcaatttatattgttctcctaaaaaccatgtgtattttttattggtatttctttaagtgatgagattaatgttataacactttatgtctttagcatactacttttatgcaagcagaaaatatgtcttcatttatattcaggttgtcttttgtattccttagtaatgttttaaggtctttatcatatagatcttacagttaaagttaagcttccgctgagtgttacatcactttgatgttttaagtggagcttttatttacatttctaaccaccttttattaaataaaaggaaactaatttttgacataatattatgtatccatgtacttcaccgaatcttttaaaaaatagtttccaggccgggcgtggtggctcatgtctgtaatcccagcactttgggaggccgaggcaggcggatcacaaggtcgggagatggagaccagcctggctaacatggtgaaatcccgtccctactaaaaatacaaaaaaaaaaaaaaaaattagccaggcgtggtggtgggcgcctgtagtcctagctactcgggaggctgaggcaggagaatggagtgaacctgggaggcggagcttgcagtcagccgagatcgtgccactgcactccagcctgggcaacagagcaagactccatctcaaaaaaataaaaaaaaaatttaaaaaaagttttcatttgatttttttcattttaactcatactctctgtaacaattacagtgtcacctccttatttctaaattttatatctatttttgtctttgaatttaagtttatgtattttgatgacttggtaaaattctcatccctttgcagttgggcaaaaattaatcagtgttgtatatgatatcattttattagattctaaactctttgtgagttagaactatttaattaaataaaaatagttgacatctcttataggaaaatcactgtgtgaagtcccaaatgatataaaaaaagaaataaaacatagttcttatgctcatgattcttacctttgaaaccctccctcctcagccccacaaagccaggcacagtggctcatgactgtaatcctaaggctttgaggggctgaggatgggaggattacttgagcccaggagttcaaggcttccatgagctatgatcgcaccacagcactcctgtctgggtcaatgaagcaagactgtgtctcaaaaaccaaccaaacaaaaaacaacagggagtgtccaaaggctgtaatacaaggtcaaatgtagtaaatgatgtaattgggaatcgtaagaagtgtttggaaatattagattttaatttgcccagtggtgccgtaggttggaatggagggaatgcaggaagatgggcaaggcttcacagagaaggaagcatttaagtgatatgttgatgttcagaaacaagatagcatgtgagcagggtgtagtgacacgtacctgtagtcccagctacttggaagcctgaagcaggaggatcacttgagcccaggaagttgaggcttcagtgagctctgatagtgccactgcaagacagattgtggattgcagaaatggccattgcattcctcaggggaaaatctatactcatttttaaagcttaatttttttcagcatctagaataggtgcacccatgaacattcagtatcttcaggagactaaccatatgggaatggtttactagtaactcatttgtacttgagtatccattatattggaaactaggaccatttctttctcattaattgagagtcatgatttgtctataatgtcctttatgatgcagaatttatctgatactttgagttaaatcaggcttgctttttggctcataagtatttatgtatagacagaaattgtggcttttatctatttttattaagtaaaattgtgactgattttatagcaattaagatgaatttttctttgcagacaaattttattgaaggaatattgacaatcaactttcattgaaagcaatgggttttgtgatttcatggaataaatgctctgttctaagagttaactgacctatgtttttgtttcagggttttggctaaatagctgcacatctgtagcacaaagccatttttcctcagtttcctattgtgtagaaaaaacatttgggatcacaaaattcctaggttccttccattctgaaaatttttacactaattccaactttgccttgaatgtctaatgatttgcatttctctatgtaaagcacatctcctggcaccgaactgaaaatgagattagaaaacacctagtagagaggataaaaggtacaagtcctaagcttattttgcattccccttcttccttttttctcccctgagaagcaggatgtcaagctccttggaaaactaatatttcaaaggaaatatcaatttgcaactgaagtatgggattgaatgatttcattgtctcaaaatgatatggtggtgagggtaacattctataatttaaatattcaaagttttgaaaatgtacagattcttttagtaattcttccccagaaatactagtatttactagtagtattttttaaaagcaagtcttctttgcaagatataatcagtattgaatccataaaacagaatattttggaagtatggctttaacaccatggcataattatagctgattatgaccagagttttgaattcaagtaacattaacacaccacaattattgaagttgtatgtatccagattagcaaaatgagcaatatttttctctcaacccttaattcctacatgttagtcctatttcctctgatattttcaggagtcctctttgctttcagtaggtattcaaatgatgactctttcagttctccatatagaagacagaaattagtcttattctcaagctctaacaaaccttcccaaaacccagtgacataaaacaataaacatttgttattgctaatgagtttgcaggtcagctgagtggttctgggttcatgtatgtgtctgtggtcagctgtgggttgatgaagtggctctgctgatttgggctggggtctctcacatgtttcgaggtcatctggctctagactagtctagagttgtccctactcatctccgcgtgttttgttcagctctcccttaaaatcagcactcttctggtttctccaccctggggatatcctcacagtgaaagcagaacagtaagagacagagtggaaacacacaaggcctcttgaggcctagacttggaacaggcactccatcaattacgccacatgctttcgcccaaagcaagtctcaaggtcaagccagttttcccccgatttagcagtagggaaatagaaggagctacagtcatgttgcaaaaggatgtggatacagggaaggtgaagaattgtggccacttttgcaatcaatctaccccactttccttctgagaagctggttgtttccagtgaaatcaaagccagctgaaacctggacaatcaagtagccaaaaaccttccctgttagacttcagcatattgaatttggcttgtaccaatttacagagccagttgttaaacacagctattaaactacataaacttcaatctaaatacattatattgaaaaaagatgatcatgttaatactgtcacttcctactttttattattatccatgttctcaaagttatttataatcattatatccaaatggtaggaatgctatataatgatgctactgacatctctgcccaaatctgtgctcagtgacaccatgttgatagattgaaattggccatgagagtatttacacaagataaattgacaaacactactaattagggctttttttcttcctttttttttttgatagctgcttgttaacatttaccagcccatcattgcctgtatgtgtgatggaggatttgaaggcccaagtcaagtcattcctgcattttatagcatgagttacagatttactttattgacttttatgtgttctatggctttgatggaagaaggaaaatatgtggatagagtaattgaagaaacgaaattgcttaaagctacattttaaaatcagtaatgaccatagtgataaaagctgtttctctctttctttagtaaactttactggatgtaatgaaaacaaatttattcaacttactagtgtcagtgtacaagaataaccttaaggaaaaatggaagaacatgcaggtaatgttttaaattacagcttcagtcattaaaatatggcatatgcattcaggcaaaaattgtcttgtgttaagtgttttcaacacataataatttcaagatgaaattattgtgaattgaaaagcaacaaaaggaaagtgaggttcactatcttctatctccttgctaatggaggccagaacttatttagttttgtgagtcagatgagttgaaatttgccttccagtattccaaggcagcaaaaggtcattccatctacataagagcctgtcgagcagagagcccttttcataaagaaaattcattgaagaagcactagaaaatgaatataatgcaaagagtaaggctgttcaaattctattattcagttttaccagtattacagtaaattcccagaaaaaacaagaattatagtgattttatgtgagggatcaacttacctgggctctttctggctttttaaaatccgtttattgggggtattttaatgaattgttagaatgtggtattggacagtgggaacttataatgaatatttgagatgtggtgtttcagagtaggaaaaatgagactgctaagtaagtaaagaatcaggattctatttataagcccctgacaatccaaagaagattgttttaactttcagtgtaacttctgaggctacacagcccattgcctcctgatattttaactgttacacataaccaagggaggaaagctagaatgaatcatgtgatactaaaatgagacatgcatagcttaatttaacaaatggataaatttgaaaataaaattttttttaatgtgagcaaataagaaatctttcatacagaatagtcccaagtaacttatgtggttaatgcacccttgataggctggaaaaaaactccccagcctttaaatcacagataacgagtatcttccaaagagtacaatatggaaaaagggaaaaagagtaactttctcagtggagaaacctgacaaacactctgtattagtccattttcacattgctgataaagacacacccaaaacttggaacaaaaagaggtttaattggacttacagttctacatggctggggaggcctcagaattatgcaggaggcaaaaggaacttcttacatggtggcggcaagagaaaaatgaggaagaagcaaaagcggaaacccctgataaactcgtcagatctcttaagacttattcgctatcacgagaatagcatgggaaagacaggcccccatgattcagtgatcttcccttgggtcccttccacaatatgtgggaattctgagagatacaaatcaggttgagatttgggtggggacacagccaaaccaaatcacactccctcagccggtgatcaggtcaacattttcagtattaagtcatgttgctggtttgtaaccttggtgtgatgtaataatgacattatctgctggtcttcttccccagaaccgaaaattccagtctaatcatgagaaaatcatcagacaaatccagattaagggatattttgcaaaatacctgagcaggattccttaaaacagtcaaggttttcaaaaacaaggaaagtctgagaaaactcgtggtataggggaacgtaagaaggcatgatgagtaaatgcaatgtggtatcctaaatgggatcctggaacaaggaaaggacactaggtcaaaactaaggaaatatgaatagaatatggacattagttttttaaaaatatcaatattggttgattgactgtgacaaatatatcatactaatgtaagatattaacaacagcagaaacagtttcccctgttgtagaaggtatagataggagtattctgtctattctctttgcaacttttctgtaaatctatttatagacatctaaaatagttgctgtagtagggcatggtggtgtgaacctatagtcccagctaatcatgaagctgaggtgggaagattaccgggggccaggagttcaaggctgcagtacatgaggatcacacctgtgaatagccactgcaccactccagcagcctgggcaagaccccttcttaaaaaaaggaaaaaagaaagaaaaggaaagaaagaaagaaaaaggaaaaatgaaataggtactgtaaaactgttctgaattggaagttttttttaaaaaaaaaaatcagattatggcgacataaatattagacatcccttagcaaattctctgatattttaaatcagatgcatgggacatactgtaaatttgtagatagctgaatgcaacacatatttaatacaatgattcttaactctggatagctttacacctttaagcatattagcatttttgtctgagtagctgaaatcacactgtaaaaaaagtcaactgtgttagggtctatttctagctgtgccactgcccagctgtggcatctgaaacaaattacttcatctcacattcggcagcctttctgcccacgccacaaatatagtgctgtgtgttcaggacacttaagaagtcatgtaacagtaataatttttttttattgctaatagctatgtaatcttatcaaggtctatttgaataaagggctctacaatccaaaatatagttgatttactatcaaataaatttaattttcagtattttacatggtattcaacattgtaatttaaacatttcgtttagaaacaagtagcatttctgtgggttagagactgatttggagagaccacatccacattcacttaccatgtgttcccaactaaattagctgaagatgcaaaaacccagtggacataaagtcagggctaagggagagaaagtgtgtattatctaggctttacctgggtaaggaaagggcttttctgtgatggcatgcaactgcctatgacattctttctacaagtagggtcttgatggaattaaagaccataactcgaacttgctatgctacaagccttttctatgggggactatattcccattccacataaacaacattagcaatcaggggtctgcagatattttcttgaatgaaatttgacatctctgaggaccgacaaggatactgctcatatggaatgtatattatttttattattattattattattgttattattaattttgagatggagtttcgctcttgtggctcaggctgaagtgcaatggcatggtcttggctcactgcaacctctgcctcccaggttcaagtaattctccttcctcagcctcccaactaactgggattacaggcgcccaccaccacgcctggctaatttttgtatttttagtagagatcgggtttcaccatgttggccaggctggtcccaaactcctgacctcaggtgatccacccacctcagcctcccaaagtgctgagattacaggcatgagccactgcacccagctggattgtatattctgttaagagtggggatcaataataggagacaataaacaagcaaataaataatattatttaagaaattgatatgaactatgaagaaaactaaagcagagtcacaggaaagaagatgctgggggatgaggtccccccattgaatctgatttaatacacttttatttgggtggtgcagataatgagttgagtctgaggaaaatgatcataaatccattttcctgatagctaaaaaaaaattagaactaataaaaactgtaattttttataaataaattcacactgtgtatgctttttttctctctgggttggttcactcaacattatatgcatatattgttgggtgttactgtagattgtccattttctttgctgtgtagagttttattgtatgaatataccaaatgtatttatccattatacaattgacagtcttttgtatagttctcggtttggtgctatgacaaagagtgttgctttcaacatcctaacacatgagtctgacacaaacacctatgggtggaattgctgagtcctagagtgtgcttatattcaatagagcaaagtattttctcaaagtagttgccctaatctacattcctattaagagtacaagagagatcttgttctccacatcctcaccaaaagttgattagtgatccttttattcatttatgtctttctagtgagtgttccatggtaacacctaataaacgatccttttattattaaattaaatttatataatttatttttattgaatttgatgtgcgtattatgcccagttataagtcctgatgcatgaaccacacttgacacgtgagcctctactcataggcccatgcaacctgcttttttttatttttaagttaatttgtaatttttaattgtaatgggttgaatagcagtccccaaaaagatatgtccatgtcctaattctcagaacctatgaatgacaccttatttggaaaaaggctccttgcagatataattaagtatcttgagaggaaaagatcatcctgaattacccaggtgtgtcctaaatccagtgacaagtgtccttgtaagagacatactaggaagatttgacacagacagaggaggaggaggcaatgtgaagatggaggcagaggttagagcaatgccaaggaatgcctggaaccaccagaggctgaaagaggcagggacctgaatctcccgtagcagcgtgacactgatgacactttaattgtggacttttgatctccaaaactttgagagtcaatgtctgttcttttaaaccaccaagtatgtggcaatttgttatggcagcctcaggaatctaatacattgaaagagacaatttatcacatcatctaaaactgcaccagtgtgctaaccagcagccaaatttaaaatgtagctggtccacactggatgtactgtaagtgcaaaatacacagtgaattttgaagtcttagtatgaaaaaagggatgcaaaatatatcatgaatacctttgcatgttattaataggttgaaatgataatatattggaaatattgagttaaatacatcttagtgttaaaattaatttcacccatgcctctttacctttttaaaaaatgtgactactggaacattttaaaatatatgtataactcacatattctattagatagtgctacctaaacaagagtgggaacatttagaggtctgtctataagaattacagcctaactgttgtcagtacatcataaattcattcttttagtctttgttcacccaatgaaagagtagacttttattgggcttctgttttcaagttctgttgcacagattggggtataaatatagagatcctgcattccatttgtgtaaactattggggtctatacagagaccccaatagcagaagagcatgtggatctgctacctgacaaacagaggcattttcctgcataaccctttcaaataggagacaatttcctggccgggcacggtggctcactcctgaagtcccagcgctttgggaggccaaggccagtggatcacctgtggtcaggagtttgagaccagcctgaccaacatgatgaaaccccatctctactaaatacaaaaaattagccaggtgtggtggcgcatgcctgtaattccagcttcttgagagactgaggcaggagaatcgcttgagcccaggaggcagaggttgcagtgagctgagattgcaccattgcactccaacctgggcaacaacagcaaagactccgtctcagaaaaaagaaaaaaaaagaagacaatttcctcagtaaagaaattgacgcttataaataataaaattatggatcagcttaccctagttattgcatgtggaggaatacattgtaaggtattattagttattgctacagtaaagctgcataacaaaacccatcaagcacaatagtttacaacaacatgcatttattttattgttcaggtacatatatgctggtgagttatgctgtgtgctggctgagtttggatccagatagccaggatccagttagccaaaaccagtcacatggtctaaccccaaatcagtgggcagagatgtacacaaccccctacttgaccccactgtggggttccagagggtgggactgaggatttgagaacaattatcacatccactacacaagaaaacatcattttcctcttctatctgactgtcatttcaatagcaggttcacattcattgattatctaagatgtgatcaaattatgcagtaagagaagcaggaagtcagagatgagtaactagctaggccctgtcttagaggattttatggtctaatagaggacacaggtccattatttgacctccttgtgcttcctcatccataaagcagatagcactactgcttgctttacatggttatcctgaagattcatatgaagggcaactcatcaagattataagattataaagatatagctgttgtctgtatctgtctatctagttgtccatctagttatttggtttggccttgatttttaaaaactagctgcagctatattgatatgtgctttggaaataaaacaacatggaggaaacacagcatgttaacgatgcctatatttgggttttggcataatgaagaatttgtttttctttttatatgtttcagtatttcctaaaatttctttcatgatcatctgtgaccaaaaaaaaaaaaaaaccaatatacattttaaaagataatttacccagcgaattggtttaactggggaattctagctccaaaatttgttttatttgctaaagactttgaccaaattgtgtagataattatgcaaacattaatgtttactttgttttcatagctaccaccttggaattttctagaaaatgttttatttttaatatacatttatggatttgatttctaataatttgcattatttttattttaatattacatatgtttaaactataaacaaggaagtcagacatgtttttcttgcctcagccttactgttatttagaattgtcaagtattaatgtttccctttcgttgacaaagatggggtgtgctgccacaggaaacccttgttatatggaggctcttccagctttatttaaattgtgaacatttgtacttaataacacgaacaatgagcagtctggatttttctttttcaagttgtcagtgcaagtaaaggcattttaaaatccgaatctgcttccaccagcagttttgataattaaagtacacaaaatgtatcaaacatttgagataggccaagtattccgttgaatttgttacagatcttgaagtggactcaatcactacttgctacttttcagagaacctttccaggtatactagctaggtatgaatatcagaaggctattaccactgtttgaccacaaaggtaaagaacatccaatagacaactaaattctagatctttctttatttgcggtatgggaaattttttaacatattctgaatcttttattttttgcaactttcactgtctcagattagactttaaaactcaagagctagaataattggtctagcaccatctctggtgtcttctatggatgcgttgcctacagtatattctgtcatcatctgtggttttctaaactgaattgcatttaatttcaatcaagcaattcatgctgtatttgaacttcaggcatatctttattttccagaaagcctgtttatcatatggccactcctgacttcctgaaactctaacagattaactgagaagaaaacaagtattatatttctaaggcattttcagctagtggaaaagataaatgactatatgagtcaataaaaaagtataattttcattgaaaggtagattggaagagcactatcaagacaaaaaaaaaagaatctgtttttaatgaaaatgaagagatctgttttctcaatcgtcatactaaaaaatgagtggtgtctgcacatatttttatttgggataataaaattgaacaagattattgctaagccagcatactaaggaaagaggacatataagccatatcaaatttaatgtaattgccccacactatcttctacaagaaacaaaaacaaaaaacaaacaaacaaaaacttggaaataagatttgtgaagtgcacattgtcttgatgacccatggaatttcaaccagctcttttaaaagaagtttacctataagatgccttagacacaccctccctttctgaatcctgtatgaatgcgtaagagaagaaaaaatgccacaaacagcatgggatgttggaaagaattggggaatgtgagaaatagaaaggaaagattaaaacaatcaaaaatcaaagaaatgtaaagtattacttgagaacatttctctgatgtttaatctaatattctatccaaagctttctgcactgctagaaatgttctgtatctgtgttgtctgtatagtagccattagccacatgtagctgtggagcattggaaatgtgacttttgtaactgaggaaatgaatttctagttttatttcattttaagtgtaaatagccacatgtggctagtggctgccttatgggaaagcacatgttcacagctctacctctcaaagtatgtttgggagtttattagaaatatagcatcttggctcccacccagacctactgactcagaatatgcattttaacaagatctccaggcaagtggtttgctcctgaaagttccagaggccctgccctagagcaatgttcacttgctaattaaccacccattcagaaacactgagaattctttattgttatcatgggtgagtgaatattagcagtgtgttcattttatccacagaggagtccttgatgcaatagggtgagtcataatagtgcttgaactgcttactttaaatcttttcccaaatgtgaacaaaacttaccctgctgattgatctgttgattttcccattcatgaaacaaacagagtccttacatggcaggtggaagggcattaaggtttactcagcatctctagttgcagctggatgtgtaccttatttctctgtagtaaaagaagtcttgacacctgaattaaaaaattatcattaaaaagtttaaaggaaggaaacattataagtgttcgaactagaaaatgatgttgacaatttattgcatttggcccctttccataggtcttaatttggaatcctgcaaaagctgactctgagaaaagcacttgtatacaggtggattatttgaaagtgatcccaggtaccatagtgagtggagtagggggagtgaagcagagaaaggagaaaggtcattaaagtgtacttggatgagtgggccactgatacgaacaactggggttcaacccctcttggggccatctgagaggctgggcatgtaagggaggaagacatcagcatgtgtgggaactgtgcacctaagctgcaggagtcaccttagatggtggacatggtgtaggacaccaacagggtcttgtacaccataataggaattgcttatgtaatgggatcctacccttcatgtggggcagaaaaatatcaatgtctgctggggaatgaaaaccaagatccagggcaacaccatgaatctggtaaaagtctgctagtggtcagtttgccttaggtaggttgttgctcttggccacagggtgtaaaggaggctttggacttagtgatcccagaggttattccctgctctcatgccagtattcttctgcagctttcctcatcaatgtttatatatttctttcttttttctgaaacttgctctttcactctgtctctcccctagggaacactaaaaatagcctgtaggttaaggaatctccaaaacacaggtgtgatttgtttgaaattctgtttgactcatgtgtgttgagttacttctaaattcaaggtattgtgactacttgaatgatattttttagaaacaaaataatgagaaaacttggtctgacaagggagatttttctgatctttgtatgcatttatttatgattatctgaagcgtgatgtaaaataacttatgtatatacatagcacagtgagttctggatggagagaagactaattatttatagaaaaagtctttttaatgtaaaaatattacattgaattagatttagttacatatgatcaaattgtcatttctaaataaaacaaaattctgaaggctgtccttgaaaatcaaagagatgtgtcacactagctgcggggggtgcaaaggtatgctcactaacattaagtaatttactgtccctttggaaggtaatatatattcccctaaacaggaaaagtaagtttgcaagggagcatggtttatgtacagtcacaggagtagggcttgtaaaagattctgtagatattgaggaggaggtatgtgtgagacagagcatgggatttaacatgtatagtaatgacctgcttggagatggaaggatttgagccaagttttgaaatgtgagggttttgtttagagactctttcaggaaaatgaagcaaacagagctgagcatcatcctggtagcctgactgaagagtacttggcaaattagagaagatatagttgcaaatggcagggaagaatgtgaatgctacgcatagtgcttttgggaaatagtccttgatggtgtctcttttacagttgaagagacagaatacacacacacacacacacacacacacacacacacacacacagagtcgcttcagctgtaaacacatatatatgtagttttaaatacatatatgtgtatacacacacacacacacacacacacacacatatatatatatatatatatttttttttttttttttttttttttttttttgagatggagtctcactctgtcgcccaggctggagtgcagtggcgcaatctcggctcaccacaagctccgcctcccaggttcacgccattcttctgcttcagcctcctgagtagctgggactacaggcgcccaccaccatgcccagctaattttttgtatttttagtggagacagggtttcaccatgatacacttatatattttttgtctctggtgtgtgtatatattatgtatacacacacatatataacatacgcacccacatttataacacacacatatatatgtatataacaaatcaaatttgatcttagcactaggactctgttgtaccaataattcagggttttttttttttagttctaggtaaaaacagtgtcattgatttactatcagtgaattcatgcaaattcatatatttgcattggtcgagtgccttgtactacaactacaatgttgaatagaacatgttctctcttttaggggagctcaagatacaggcaaacaaatgactacacttcagagccatgtcataataaaagtgcccatgaaatgatatacaatctaattctaatcagattctccaattgacttgctattttattcctgttctcaatggactcccatgtactttgtaaggagacagaatgtctgagcagagaatctttagagagaaaatcgtcaaataccatcttggataccaaatgtccatcttgtacttgtgaataataattcagtctagcaggatgtcctcttgcaaactgaaatgagcctacagtcccatctgtgggaaaacaagaggactcctaagtgttacacacaggatgttgctgatcttgggtcacctggctagcacagggcagctgtctgcagtcctttacctctggctggatttcctccttcaacttctaaaagtccaaggcttgaggacagttccctggtgaagatcaccagcatcttctgtgggccaactgaattgctgaggtgggaagtagtaaaagtcagagttagggtctagtttgtcctccctctctctcattttgtgtccagctttctttcccaactgccaaccttgatttacagttcagttaagtcccaaaagtagatgcaacagcaacaatcttcagtggacttcaacagttccctcagttttgtaagagtgaattgctctgaaaatccccgattctgtgtcactctaagtggctctgcctccctgatcatgtgtcagctgcattcaatcctagcaccagcccaaccttcaggccacctccaccatcactcactgggcgatgtgttctgtgcttgaatatcttcagaacatgcagatttgtcctaaacaggcctaggaaatgaatatacaattatacataaatttttattttatcgaaatttgttgtgagtaaaatggcagtcccttatctactgatggagtaccttctaaaagctttccttcttattctttatcaaattattcatttaatataaattacttatatatttttatgtattttatgtattttttcagagatgatcatttgggttttgaaaaattatattgtaataaaaaatcaaaatatttacatttatatgaggataattcctttgtccatgaatttatggacttatttaatggtagtctaattttcttaaagcactaaactctagaggcatgggttggctgaaacacacagatgactttgttgactctaacccaactatcctagagtaagattggttctactgggtgaaatgatccctcttctccaatgcttctgataccccatttcattgtctgcctacacagaggggagagggcaacagctgaggtttcttacagtcccaagagaaccatttttaaaactcagtctatataaaatatttcctggatgttttcaccaaagctcattaatgtaattttcacatcattattgcagctaatgatcatgtaagcgttcctgatcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatacttttataggggatttacatttgttatgggaatagtctttttactgactctgcttatattttcagaaatgtgtctttagccactagccgaggacagaccaataaacagcatccaaaaatgttaatgattatatatggttccagaatttacaatggtttgtgttatgattttttttaattttacagtggctggaaagtgaaacacattcaataaaaactgtatttcaaatacccatacaatgattctacttttcactttcagcacagtattcaataagttgcgagagatattcacatttcactataaaataggctttgtgttagataattctccccaactgtaggctaatgtaagtgttctgagcatgtttaaggtgggccagactaagatacgatgctcagaagattaggtataataaatgcattttgatttataatattttcaacttacaatgggtttatcggaacatagccccaacataagtagagaagcatttttattatagtgattttacatggaggcaatggcaggaaatggaaccagctgttcaaaagcatactttgtttgtaacttaaatgtttatacatccaatcttcttataaagtttgaatttttttaagataactatactagacttaatgttgtggtgggtttgtgactgtccttgattttagtcctcaaatatctatagcagcagcagtttgtatctgaaattattacaaggggatttgcctattagaaatatgcctaagttccattattcattaaggtcacagcagcaattctgattaatggagctgattcttgatagctgtgaggatacttccaatacatattataacttttacaacagagaaagcccttaatttccttacctgtaaaatctgagtaataattcctgccctatgaattgtaatgaaaatgagagaagctcccaaaatgatctagatgagacaatcaggtggagataagaccaagatgctaggaagtcagctagccactttctcacatctagcaaactgctcctacctactatccttgcaagaggcagaactcagatttgtcatttttaaatattcagtgaaccactgggcttattcaggattatttgaaactataaatacatatattttttaaaattcttggattcaaggggtacgtgtacaggtttgttacatggatgtgttgcatgatggtgacgtttaggtttctaataatcccatggcccagatagtgaacacagagcccaatagataatttgcctaccttaactccccaccctcttttggaatccccagtatttactgttgccatctttgtgttcatctttacccaatgtttagctcccactcataagagagaacacgtagtgtttagttttctgtgaaaccataaatattaaatgtaagagtaacaagagtctactgaatagctacagcagcattccttaatgttatctttttgaataaatacaattttgaaagcttcagccctgcacatcaggtcaatgcacttaagtagctaaacaagaatgtcataatttggtgcaagactgcacttcaggtattccaagtatatctgtgagagtagcagaaaggtccaaatcagaagagaaaatttgccatcttcattcagaatttcttaatcttactggaagtacataaaatctgtttttgttttaaataccctgatggaatagaccaatttggcagtctgaaaaagaactaaaaaagcccagctgtccaacaaagtcatgtctctaggaagagacacactgagggaaggatgtaactgagagaaataagacataggcctcagatttcctagttgggccaatgagaagagtgaacagcatcattatgtggagaaagtgaattatagaacctgatcgttatttgtgagctcattgatgtaatgaatttgcttacacagtttatatgtgacaaagttttgtatgtacccacttctccttgtccttaggcaataaattgccaagagtgtacagacttggccttcttgccgagaaaatttgtggaaactgccttttcagaaagaagcaaaaattagtacaaaacattgggactattttttttgttttgccttgtttaatttctttttttaagacagtcaaacccctgagggtgcacccttggaataacagaagtttaggataggaaagagtctctatggtcagcttgccctattgaaggagcacccaagaccatcagatggtctgcagagaaagtgtttatgatgtaatatcaatacatttgtgaaacctcatatgtcataatgctctcttgaagagtgacaattcatattatcatgttaaagactttaagtcctacattaaagaaaacactttaagtttaacccagtggttcccaaacttttttggccaaagatccctttaatccctaaaacctttgcatacttgtaaatgtttatttaatccaagcctgaatttgtctttagtaacttcctgcttaacatatggtccttagacgaacggcatcagcatcaccaagggcttattagaaatgccagttctcaggtccagtcttatatctatcaaatcagaatctgcattttaacaagattctcaggtaaaatgaatatgcatgctgaagtttgagaagcacaggctcagtattccttctgactcaccatcttcacttcgttgaagttaaagacctgctgaggaaatgtcttatgcacagcatttaagcaatattacaactacaggcaagttgtacctgcaaatagtatttgcacatgctgcctctctagtttctgtgatgctgggagatgtctttcagaggcctgagtgagtctttacaacctgctcaatttgttttgtgaattatgagtgatgaaattctagattacaaattgcagacaaagaagtctgtgccttttcccaggcatagcgtcagctggtgaagtttatagagccagatgtatttagtagaaatcagagcgtgactaacacttcaagaagaagatttgcagatgcacaaaaaagagcagagaagtccagaattgcagcttggctttcaaatatgattattggttttttctgacaggtgaaacatttataaggaatcaaaatgctactcattatgcaaaatgcctgcagaaatatctctatcagaagcaactaaaacgtatacagttgacccagacggagaacaagggccccttctcaggtattagaaatggtctatatattgataggggttacatgggtctatgcatctgtcaaactcagcaaattatttaaggtctgtatgtgatttcactgtctatgaattatacctcaataaaaacgtataacgtttatcttatgaaatttgagtgcagctgatattagatacagcaatgtgggctgtcaagaatactttaatggagatgtgcatttggaaataaatgcccttcacctggtatatggagatatttttatgggagggaatagccattgagtaggctgggttccagtgacttcatggtcatgccagtcagcgttaccagcaatccagatggcagagggggctgtagcatagactctgaattattgattctgggttcaaatctgagcctagttcccagtgacccagcacatgtgatttgacctttctgtgccttagtttccctatttataaatggcaatgataaaaatatttccttcacaggaacgtttggaagaccaaatgatttaatatttgtgaagaacttagtatagttctggcacagagcaaacactatatacatatttatcagataaacaaagtgactccaataagctagctgcaaccaccgcaactgtcatctacaacttaaccagttttatttttttacagcacttatccttctttaagatgatcttattttgaataatttatttgcatgtcattgtcagttgcccacccacctacttcataagccccaagacataagggactgatctgttttgttcttccctgtactcctagaacagtgcctgacacacaatagatcataacacactgaatgaatgaataaaggaatgatgtttaaagcaaaacaggttcttaaagaagtgagtcctatgatattaatgttccaccaaaatcatttccttaattactggttaaattgttatgtgcctatcctgtgtgctgagtggtacgtaaacagcttactggggatgaggtatctggattgatatgaccaaggaaatttcttgagtgagaaggagccaataattggaaaacccctgattacctaatgcttgtagcatgtcccaggatctgaagaattttttatatatcaatattttgaataaaattcgtatttgtcctcagagagacaaaaacttctgcttttaagaatactcagaagctaaactaagacattcattataccatctaattgtgctagattgacattttttccttcaggataataaatcaagtaagattaagcaatttatactatgactgggaggaaactcaaattaacaacagactagttctgccccttaaatttggcagatgctctatttccattaatctctgcacctggcttcaaatttcatgaggcagggtcctaatcacactcatctatgcatcgctcagagcttcctagagtgtcttgtatttaatacacacaataaatagatgagcaagctaaatgaattgaatttgaaagtgtaaatacatgcacaagagcttgagaccaaggatttaaagtaaggctttgtgttttaccaagactgccctctggaagaacagaggggtcacccacacaatctggaaattaggctcactccttccattttacaattccttattggccttggtaggcctacaggttattctcaaaaacctgacacacacacagaaacactcccacacccctcctcccccaccacacacagtgtagtgatggatttacttcaaggaccatgagttacgagataagccacacagagcagagcaagagtgtacaatactgaaaaatatgttgtggtgaagattcatgtttgagtcataggacgggaatccagatgtttatttttaggggtctcagataacatatctttacatttgaaaggcaacagggtatttgtttggttacactataagcatgtattattttgttgagactaaattacttttttttatttctatgatgcagcactcttttagtatggagaggctcatttggcaattccctcacctttttagtagaaatgaattttgatacaagaccaaatgagtgtctctttcttttcactaactcccatgacctgcattctgagttgttgttgttttttaacttgagatacatgagtcctctgtgctgcattctgtcatccccaatatcatttctacagaatgaattgagcaaagatggcctagcattcgtatttagcaagcaaatactatgtgtttagcaagtcttccaccaaaatacttagaaagatcatgttaacagtagagggtggtgactgcaagttgtccaggttcttggcgttttgcacaaagaattggacaaaacgtctagcagagcaaagaaagaatgaaggaacaaagaaggaaagcagggatttattgaaaacaaaagtacactccacagtgtgggaatggactcgagccacaagcagcagctcaggggcccaaatacagaatcttcttgggttcaaataccccctagaagtttcccattggccacttcgtgctcacctcatgtaactgaagcagtagcctgcaatcggtctgattggttgcagaaaacagccaaccagaggctgaagtgaagttacaaaggtcacactcccgtgcaaacatctgattggttgctttttgcaaccaatgacctgcattctgaggtgttttttttttttttttaacttaagatacatgaatcctctgggctgcgttctgtccttggctgctttttgcaaccaatcagaggctagggtgaagttacaaagttgccaaggaagactggacctgcaatcagtctgatttattgcagacagccaacttcccatctgccgcatagaaaaggtcaacttaggcgtggaaagttagggttttcctttcaatttagttccaggaaattggcatgaaacagtcttaggttccctgcctccaggccctattctcctgcctcaatcatgttatctatggcagtgcttctaaaactataaagtgcatccacatccctgtatgtgccagtgtggattcaccaggtctagggggcacctgagattctgtatctcaaactgggccctgggtgttgctatagaccacactctgagtagcaaagttctaaagggaaatatatttatcacccttccacaaacggattctatttaaaaaaagaaaaaagaaagaaaagaaaaaaatcatgttatcttccttaaaacatagtttcatattctttgcctctaaattaggtgactgtaaactccctaggcaatgaggagattcccagctatggtggtctaagtgcaaaacaattttttccacaccatcagcagcaatgtccacgctcattaaggctgtatttctggattttcctttgcaatgggcttccatgttagatcttcactacatccaatttcagaaaaaaaaaaaagttttgagaaaagttctccatgtgagagcacttctgtgctgtttttgaaacttccttctcatttttctggtatcttccagcaggcaatggggaaacctgcttaagctcacccctctttcactttgagctttatggtgacacttttctggcacatatgtcagcagagcccactttttagctgagttgaaaggaacatgggaagcactgcttcatttctgcctggaaaagccagggacacgatgaaatgtgattttgtttcctgaaacgtggaaggatggttggcgaaaaatgaaacatagcacagccatcgctcttcactaagggccaactccttgagaaatgtgctactttaactctcagtagtttctggacaaggcctaaaatcaatcataatcctaaaagaaaaaaaagttctatttcttttccagtggtatttcagagaataggaactctgttacaatttgatttgcactctgttcgcagaaaaccgaccacgcgcactggttttgcttattggtatgtttggatacacacgtgcgtgcacctgctcagaccacaaaattgaagctcagaatggaaaacagaggtttccattgaggtttcagctaaaataaatttaaatttaagcctttctttgccagtttgtgcttcaaaacttcagaaagtgaggagatgcaggtcaaagggcacagagcagcagatatgtaggatgagcaagtctagaaatctcatttacaacatgaggactgtagttagtaaaactgtatggtattggggttctttgttaaataagtaggttttagctgctcttgtcacagactcacaaagtaaccatgtgagatgatagatatgttaatttgctttaaagtagcaatgattttactgtctgtgtatctcataacatcgtgtcataaacctcaaatatatacaataaaatatatttaaaaatacatataggctgagtttttcaggacatagaaaagaaatatgaactggatgagaatgagaaactcacataaaatggaagaagattaccattattattattactttgagacagagtctcgttgtgtcacccaggctggagtgcagtgtcgtgatctcagctcactgcagcctcctgagctcaagggattctctgacctcagcctctcaagtaactgggattacaggcacctgctaccacatctgggtaatcttgtatttttggtagagatggggtttcaccatgttggacgggctggtctcgaactgctgacctcaggtgatctgcccgtctcagcctcccaaagtgctgagattacacgcatgagccactgtgcccagccagaaaaagattattatatcaagatggttttataataatgaagaatagaaatctggacatactcagatttgtagcatagactgatggacagtcctgtttgctctcccaagcagaaaatctaaaaggaaacctggcttctaagggtttggagattcaaaccttgaattctgattctctaattacaagtggacttcagtgagttaaaaatacagacatcagctggaacttgaatggagggtaggggctttgctgggagttgcctggtgagggaaatattttaaaaagactttgagtaaaactgttgtaagaccaacaggttcgtatgcccatttgcacagtaacaaatcatttgcagcagagaaagagtttaatcattgcaagtgcagatcagggagataagaggaaaccctcaaatccatctccctgaaggagttctgggctgggatttttaaagggattatgaagagtgaggggctggaaatttgggattcttgattggttggagtaaggaggataaaatcatcaggttttggaaaatgaattatttggtaagtcagcttctcttggagccctatagaccagctggcgtcagtagttttactggtatgcaggacctgaaagaatatcttaaaggaaaaactgaatgtttcataatgttcaagttgttatctgtacagcagttgagggaaactatatcttgtgtaacagggtctatgtgattctagaacaatacacaaacatctatgaggaagcaggtcagaggaagctgacctaataatttgtgctgaatgtgtggcaagtttggtttattttcttcccccacaaccttcttccctgattaattttataaagtttatagggatggtttcaaaacaaaggaaaacagatacaaccaggttgggtccaaatgattcaggacattctcagcaacaacagcccccatgacttgagtctctctaataaaaaaagaaaagaaaaaatctgaggacaactgtaagggtagtcagggttttcattttttttttttctgtgacagagtctcactctgttgcccaggctggaatccagtggtgcaatctcggctcactgcaacctctgtctcccgggttcaagcgattcacctgcctcagcctctcgagtagctgggactacaggtgtgtgccaccacactcagctaatttttgaatttttagtagagatgtggttttgccatgttggccaggctggtctccaactcctgacctcaggtgatccacccaccttggcctcccaaagtgttgggattataggcatgagccaccatgcccagccaactgtaagggtttttatagatgtgtttacataaaagaaaatagcacagggaaaaagtgtgcagtgtcaataaatgggacaggattattcactcctggtttgtattccccatcccaagagaacgacgatttcactgcaaaggcattttaagagccatgtagaggaattgtggccgattgaataggaagttctacctggttcaaatgagctcacatctctcggggaagctggtgactgtggacccaggtagtccaggtcatctttgagaaatgatggagaacgtagtgtcagaggtgaggggattctgtggcctccatctagcattctgcttggcatctcctacaaaaacttctcagaaatatgagaaatacaggggaaaatgtttgaatgctatcccatggcagttaatatggaatctgttgtggtttgtggattagttgtgtgattcaggtgccattggaggtttctggaagagaagggccttttaaaagcctctgagaggccagtattatccccagaaagaatgagaggaggtttattgtatgcacgcaagcaatatctatgaatccctttacttgcttgtatcttaccctcttctgccctaggaacaggctcgtgggagaagtgacccaactacaccttcctgccagtctcgagcattttaggtgttaaccaccaaagtggctgacacatgtacttactcacttggttttaatttgcagagtaggaacaatggacttagatttttttaaacttctctaactctttaatcactgaatgaaataactcatgttggaaagacaaagaatttcctggtagaccttttgaacaagagctcatagatttcagtgccattggtagccaatgtgataccatggcattgttgtctattgtgttttttaggttgtgacctatttgtgggttatgaattcaattttgtggattgggacctgcaatttaaaaaaaagatgaaggaaatagaacataatagagtcaagcgccatgcaatacaaaatgtcagaggtatcccaactaacaagggtgaatgatggtttgtaaaacttcagttacgtatgtatacgtgcatgtatgagtgttctgagtgataatataaaatgcattttttactgaggagcatgatcagaacaatatcaaaccattgaccaacatcaacatatttctattagaaagatatttaaatgaagtttgtatagtaaaaggaagaaagaacactaaaatatttgcaaatctaccctgcacagtcactttaatcttttcagcttctaattgagatagatgctctatattaccctgtttattaataaaccctcaaagatctaaaaaggtgaattaactctcaggggctttaacagataaattaacttgaacctgcctagttgtctgtttcagagccagaattcgaacatggattcattttagccgcagtaagcacctgtgttagtcagaattcagtgtgggtaacagaagggcaggccagattggagagagctggaaacatattccaggtagagacaatggtgcctgatgaagcctaagggtctgaatgctggagtaaagccaggggttatttacactgtgactgggtgtgaatctacagatagatctgaaactagaagataagcccatgaaggaaatgggaaaatgtgccctgattttgagttacattagcaaaaaaaatcaaagctgagtccaagatggaagaacatctacataattagagaggacagaagtgatcacgaagacctaggggacagggagaggcctcaggtaatgcaaaatctgtacataatgattgaggtcaggagaacagatgctcttcccgggtcagttttaaggctgaaatgtttcaggaaaactgggaacaaagcatggttggaaatagcaggctaagctgatgcatcaggagactgcagatctcagtgttaccttgcctgggaacaggatgggccccaagtatggctgagaatgcaagtctcatgggtatatgtttaatgaacctagttgggagatgttaggaggaagactggttctgatgtgaaagtttccttccaaagaataggccaacctaactgcagcagtgctgattatgatggaaatttcctattttgattcttcatcaaaagaaagaagagccggtaccatggttcttgcctgtaatcccagcactttgggaggccaaggtgggaggatcacttgaggccaggagtttgataccagcccctataggaaacataacaagaccccatctctactaaaaattaaaaaattagcctggcatggtggctatgtgtctttagtcctagctactcaggaggctgaggcaggaggctctcttgagcccagaagtaggagacagcagtgagctatgatcacaccacttgcgctctagcctgggtgacagagcaagaccatgtctcaaaaaaaagaagaaaaaggagaaattaaaaagtttttccttatggtttatctttagtagtttgacgtattaaagaggtttatattttattattatatatgcattaatatataatcagatattaattaaatatgtattagtatattatacattaacaaacttacattgtcatcttcttcaactaattctaagcctcaaacgaagtgtaaaagaaaactgaagcatcaaaaaattagtcagcttcaggcactatcccaaatgttgaagttttccatgtaaataaataaaacctctaaaattaacaagaggctattttcactgttgcctgttggacacaagccttaattatgacagtgatctgaatagccaagttacactgtaaggctgtttccctgaatggaaacaccaaccttttttgcttttttgaaaaagaagcagaaacagaagcagaaggagagggagagggaaaagaattctttcggacaaaatgtatcaaatgtttgacttcactccagaggcaatttttaaataccaaaaattgtttcacatctattcccaataaggtttgccaccaaaggagtttgctctaaatttgtgactggatgtttggttttcagaggtttcaggatttcagaatcatggtaagggattatagacatgtatttggtatgtgcaatattgggggacttgaatattaagtctgattgggaacatctctgggtttctgtatgtgtacacattctacacaatagtgtaaagttttctagaaaatttagtgtcagcaaaaattacgctggggtctgagtttttatgtgagaatcttataaagatcaaaatattagctaaaatttaaaatttgagttgaaagggcttgaatgctgtattagtctgcttgggctgccataataaaatgctgtagattaggtggcttaaacaacaaacatttcagtttggaaggctgggaagtccactatctgggtgctggcaaggtaggtttcagaacattccttcttttggcttgtcggcaaccaccatgtcactgtgtgctcagatgacctcttctttgtatgtggtggtgggggtgggagctgggaggtctctctaatatctctgttgtgggatttttccttagttcagctgaagacaggggtccttatcacatggccacgaaaaatctggcttgcagacaatctgaagcgtgaggagggccgggtttattgggtgaaagagggaaacagggacgctccgcaaggccagaatccctgctacagcgcttcctgcctgaagattgaatcccaggttccacccaggaataggaggggccaggcttcccccgctgcaaacagcaccaactcccgtggctccatgccagtgcgcaatcctcccagtgtgcaggctggttggagtttttccaaggacctcttcccacctggctgtctcatctcattttgtaaggacataaatccaatcctatcctatcctattctatccgagccccacccttatgaccttatttaaccttaattacttctttctagaccctatctccaactactactgctttaacatgtgaatctgggagtgggggagaaaattctatccttagcagatgctaaaactcaggacttgaaactgctttaccaaatgattatgtgctgtggtctgaagcagtattattttttaacccagtgtttttcattcccatgtttttttcttttctaagaaattattttcttcaggatcaaagcgacagaaacttagaagtggcatttgaagttgccaacattaaacctttgatcagtccggcctagtcaccagccaaacaaggaggagagagattgttgctcatccatctaaattcacagctcaaaggtgcagaaatccagctggagtagaaaacatttcctgtactgagttaaatttaactgaactccatgcctggatgatttctgccagtggcgcccgtgggattgtgtgaccccctctggctttgctatctgcaggtttcttgatcacacgtggtatccatttatcagtcctggctggagccagtttcccagagcaaacagattcaggatgatccgcactatcagcagaggttcaccaaagttctaattagaccaggaaggtttattaatacaattagctttagggaggacagttacaacaggaagcaaattccttgcagcatccggtcctctcttagccatgttagttgattaagaggaaagcctcagacttcaaaatcaagagcaaaattgaaaatgtctgggaatttaactttccagtaactgtaaagttttaaccgtgaactttctattaactgtaaagtataatttaactttctaataactgtagaacaagaaaggattctagaaaaatcttgggaaaaattattaatgaggggcctgagggcttaagtttggggagagtgggcttcttttgatttgcaatgtggaagctgcttttgctcatgctttctgaagatcttccataaagaggggaactgcgaattgcaaagtaaagcccctgctgtggagtgaatttgcttatgtcacactctatctgagtgacccttaggaagttccctaatctcccatgcctgttttctgggttgtaaatgcaagtaataaaagtaactgcctcataggtttgttgcaagtattaaataagaaaatttataacggacataaaagggagttggcatagagttaatgttcagtaaatgacgagtgtatccttctcctcttcctcctcctcctcctcatcctcctcctcctcctcctcatggacaattggtttcatccatctgataatgaaacactgtgaattgcccccaggagtgctttaaatgatgtctacttgtacatagatgctcaaaatttttgaattctatcagtatgacatctagaagagtcatgggtagcaccaagggataagctctttctctggaagaatagtacatttctttctattaaaaaaacatgaattagtcaacccattatgtgtttgttttttgcccttattaccagaaaactacaagatgattttcaatcacagtgaggattagtttctgtgactaacatgtttctttctttctcattcttatgagtttgatttcccattcttaagcaaaaaagcacaataggtgtgattgtgtgtaccatttttttgaatgaggcaggaagatagttgacagttggttaattcatgtattcattctagttagttttgtgtctgcacttccttctggaatttaaacatttttgaaaatacggtctctgttctattttttatttttcattcctataaagttttattgaatgcctatatgtgtccaacataccagatcctaaggtttcacataagtcagattggtctctgtccttaatggtgttatcatatagcagaggacaaaatcataaaataataataatatatgaaagatatgtaagcatgtaaggtcaagagggtggaaatttcttctgtcttattcactgctttattgctactcctaagggagtgcctaaaacagattagatgtccaattagtatttattctatcaattactgtcccaggcattttacacatattagaaatatgagaactaatgtttattgagcaattcatatctgtataccaaacattctactggtatttcaacaccgtgaactagaaacaattactaaggttatgaaataggagttaacactgaagtctagagaggttatgcaatttgcttatggtcacacagctaataagagctagatagaggtctcctctagagctcatgagcttaaccagtacctccatccatgacactgtcttaccctaatactggaggagttgaggaataggcttccccacatcgtggataataaagctaaaattttctaaggcagggcctggttaatggagggcacatgcaagctgacactctcaggactccaaagtgtacacacttttcactataccacacagcctctcatgcacgtagacaatcacacacatacaaacattctaacaaaagtttgtaggaattgtgctgggaccatgctgtatagctgtagtccatggtgtataacatgcctgcagtagaatatctattgaaatgaatagagctacaaggttaatccattggagaaggaatttggtgtgatacttacaagctccccagtggcatgaatgtgtcactcttcacaacactgcctagttcttgtgtagatacactataagcattaagacaatttatccttactgtacaagactatggagtgtagatgtggtagacctaattctgagatggccttcagaatcccatccgttggtgtccatgccctgcccattaagtgtgggcaaaacctaaggtttgcttctacccggtagaatatgacaaaggtgaagggattttgcagctataattaaagtgtcatgtcagttgattttgagtaaatcaaaagggagattatcctgggtgagcctgacttaattaggtgaaagcccttaaaaaaggaactgggcccttctggaggcaatagactgttcttgaagacttgctgaagttagtggctcttttggagaagcctacatatcaaggaaatatgacagcctccggaactgcaagcagcctctggtatccaaggccccaacaaaaagccagagccctcagtcacagagctcaagaaattgaattctaccgtcaacctgaatgagcttggaagtggattattccccaatcaagcctccagactttaacccaatctggctgatcccttagttacagtcttatgagacattgacaggagagtgggtttagacgttaatatcccatttccgttaccagatatactgcaaagacagagatcattttttcaaggaagttgtgactaagcaccatttgaaatatcactattgtggttttgactgaccccagatgaaaagatgaactctcctaagatttcaggcatctttaaggatagattgtaatgatgccaggtgattcctagatgagatacactaaaattcctctccacacaaggaaaataacagtgtgttctctacttctcttggaagttccatcattaaggatattgaatatgaccaggcacagtggctcacgcctgtaatcccagcactttgggaggctgaggcaggtggatcagttgaggccaggagttcgagaccagcctggccatgacgaaacctgtctctactaaaaacacaaaaaagttagccaggcatggttaattagccctgctacttgagaggctgaggcacaagaatcaagaatcactttaacctggaaggcagaggttgcactgagatcgcgccaccgaactccagtctgggtgacagagtgagaccctgtcaaaaaaaaaaaaaaaaagaatattgaacatatgtttacataaattaattattttgagcaatgactatttctgcttcagaaaatctggacttcttaagttgtgttcaagaaaaaaaaaacaagacaacaaacacttcaggtttatccttttatgttgtgactatgtgggaagagattgttaatttaaaaaatctgttaacaccaaactctcttttttctcttttcctcttttttttctctcttctctgtctctcctcattttataggttttggtgtctatttattttttctccatgtattgccaccctttgctctaggcttacatacttttaactacaaatccaggaaggatccctgattccacctgttccagtgaaaaccctgatgtagctttcattagaccaacatagaatatgtgccaacacttgacctagccaccgtagccatggaattttatttatttatttatttattattttctgaaacagagtctcactctgttgcccaggctggagtgcaggggtacgatctttgctcactgcaacctccacctcccggtttcaagtgattctcctgcttcagcctcccaagtagctgagatcacaggcgtgtgccaccacacccagctaatttttgtatttttagtagagatgagctttcaccatattggccaggctggtctcaaactcctaacctcaagtgatccacccaccttggcctcctaaagtgccgggattacaggcatgagccaccgagcctggtccgtaaccatggattttaatgatctgttcagccaggcctggaatgcacgccttcccctgtagccaggagtaaaataagcctatcagaaccatgcaggctggagttacattttcaaagaggaaaatggataaaaacgttccattactgagacaacctcagatattttcctcagagtggaaatcaggaaaccaacttagagtcatctcaagattagagggaatttgggctagaaggagaatattctaaagctactatttactaaaatattacctaatagtacaggaatagacaactgtatcaatggagtagaagagattagaaagtgttcaaacaagcataactcatttagaatggatgcatgaaatgctatttcattgtagcactattgttttagaaatggttttattaaactatacacaaatatatgaacacaaatccattacagtactgagtagtggaatcactatttctcaaataactagtcatccagtacagtagactgacatcttactgtttttaccatctatttgttctctctggtatggtgtttatttctaccattatttgtacttatatgaacatttttgggctgagatggctatcaaaaatgtgcaccagagtggcaaagaaaaattccctattcaatataaaaataccacttttactggggctctgggaaccttcaagacagtgagcaaggaagtattaggtaaaattaccaattatgtagctaattagatatgaggggaaatccttgaaaacttagtaggccacatacatatcactgcagcctctaaagattgacaagtagagggaaataaattgccaataaatgatactgagaatatatgtccaaacagactatgccattataaggtaatcactccctgaaacataaaaaaagtctattttatgaattttatatacttatagtttattttattatttgtagaacttttaaaatttatatcttcatatatgaatttcatttttattttgtgtgttctatcttatatatttgtagataatttcataaatgtttatttttgctagttaagcatctgatataaatgacatttccaattaatagtgaaatggtgtttccaggaaagatattggaacaatgaatatccgtatataaaagtaattttggcaacctacttcacaccatataagcaaataatttccatattatatacatacctaaatattgagggaaaaccaaaattgctagaatatacataatatactttttataactgtagagtgggagaaaacatttttagacatagcgcaaaacccagaagcaaagtaaaacactggtaggttatctgcttaacactgttaaacttctaatgggcaaaagacaaagcagacaaaggtaaagacaagttacaggctgggagaaaacagttacaagatatatcagaaaaagggaaacatataccatctctaacatactcttacatggctcttacaacccaataagaaagtgaagttctcaggtatctgtgaatgcaagccacagttgtctcttagccacaatgtctagggtgcgtcaggattcagacgactgcagttcctggccaagtaccccctagctttgctgaatgacatgcctctttatggcttatggacagcaaccattgggttcaggtctttgccccatttcctgacccaaggggccacaaaatcctttgtcctcaccccaggccacaagaagagcatctcctcagaaagtggccactggttatttcacctggccccaagacgatgcaaggcacccactctgctttttttgtgatgagatggagcatgactggccttgcacatgaccttcagtcactgcctctttgctctttggttgttgactttgtcggcagggaattcagagggaaggagagtcagcgacgtgctctcgtaaggtcatcttagaagaccactctctccaattattttaagcagctctttagagctttctacattgtgaagttctttatcctacctgtgtatccctagggctttacagagtggagattcagtaaatattttgacaagagtgagcaaatgatttaacagtcgatggagtgcaaattgccaacaacttactgtagcgtttccatccacagcattcagggtcagtggctaaaatacttgtcgtaaaggtgccaagcctccaggcatctagcagggcattagcacaccgaagcatttattagactcaggaatatactctttattggctcatttcaaacaatacctaaaaaagaaacctctttttttaaagccttcaaaagatggcaggatgtattttttcctaagacccataaaacaggtaacataaactgttactatttcataagaaaaacttaggtacagaaatactcaaacacttatccaagggagctggaatttgtgtcaaattttcttgaggaattacatggctcgtactatttagaccatgttctaaacaagcatttatcgctctttgaagttgtgtcgtatttagaaatttagattcatagtaattagatatttagatagattatactggaatatttgggtggcatatggacagcaggtctgtaaataaaatttaaatcttcattactatattttctacattctgccttatgcttgatttaagcttttttcccttcttttcactggttagatttttttttcatttattttttcttctaggtcgttgacctttttataggcatagaaaatgccttgtaccgtgcaccaaagttcttaaaattttaaaagctttctttgactaagtcatcccttgccctcttttgaagctattctgacctctattttctattttattttaattaatcatatcttaggatttgtaggcttatatgtggatgcatgtatattatcttgttaagggtacataaggcagttatacaaaagattatgttggcttcaaagaatgttaaacaaaaggaatgagaagattcctgaataatatagttatgcatactcagagcttctttcataagggcatttgaaatgtatgctgatcacctcaaggtcgccatgaaatgggaagatttaaactagtggtgtttggacagaaacaacttttaccttgaaagccagcaatcaatgactgaaaaatgtatatctaaggctggaaaatcatttcagtattattaagtattctgatgacaaaaaaggttcaaacatttgtgactcccatagctagtattgatatgggtgatgggaaataaggatgtatttattttatttggactttagtcatgtttttattgtctgtaaaaatgacttgactgttacagctagaacattgaagaaagaagggaagcaggtcaaatgggtccccagtgattccctgtggcacctggactttctccaggaattgattgttacatattattccatcaaacaccttttaaccagtccagttcttgtctatggatccagacaattcagtcttcccagggcttacccatgtttccatatatccagaaagtttgtatattatggctagaaaagcaattaaaccactttggaagggttgggggaagggagggttagggagagacttgttaaaggatacaaaattatagctagataggaggaataaattctagtattgtatagctttgcaggaagactaaagttaacaatcatatggtatatagtatcagatagctagaaggaggatatttaatgttccccacacaaagaaatgataaatgtttttgattttatatatatatatatatgataattaccgtgatctgatcactatatgttatatggatcgaaacatcactatgtactccatgaatatatacaattattatgtgtcaatttaagaaattaaattaaaaagagaaattaacccagcctcaccattttacagcagagggacttgaggtggaaaaaattcaagaaactttactctcgtcattcaacggagtgatcttttgaaaaaggtagcattacaagaaatccagtatatacccacaaatacgtggccacatttcttgacaatgttccaattattattgatatctacaattagaattaaatcgttgtttctaaccagtaatattccaagtaaagtagtaacattgtttattcattggcattaggcatctatggttagctctacagaattatagttgaaatctatgtgaaaatatcaatttttacacttaccgaccataataggatacttacagaagagcttgataccagactgtcagccaaagattttctgaatttggtatgaattttctaaaggtggagtgatttgcttcaagagaaaattgctttgagtgcattttgcagtcaagaactttgacaccttgcaatttactagttgcaaagataatctgatcacaaagtaagaaatctgatcgttgtaattccaatttatatcaataagaaataataaataatctttattttggaggtttgctaagtgactgaaagtttatctaaatacagacggttttgcatgaacgctagggactgaatgaaacactgtttgcctaccaattaaccaggcaggtgtgaaacataagcagtgaccgaccataacagacgatctctcagatattgatcactcttttaacagaaaaattcctatgggcagatagaggagggggagagggcagcattctcttgagattgtcttagggaaggatgatcatgaaactctttatatctgaaaaaaattttaaatccttttaaatatcaatccaggaggattagctaagcagcaataaagcaccttataactgttacatagttaattcaaagaagcattgtatcaagataaataaatatagaaaacaaggaatccattttcaagaaacatactttgttctagttctgacttcagatttaaaacacacacacatacgcagaagacacactgaatatgattgaatctagaatatagaaataaaataattgaatatattccatttgttaatgtgtgcatgtgttttcaagacatggctcaatgattctgtagttttttccttatttttattttgagaattttctagaaaaaatatgtcttaaatacttaatttttacttcttggttatcttagtccatttgtactgctacagcagaatacatgagatgataatttctaaagaacaggaatttattttctcacagttctgaatactgagatgttcaaggggccggcaggtttcgttgtctgtgagggtggctctctgcttccaagatggttcctctagaggagggaacactttgtcctggcatggtgggatgtgggctcaaaccctgtatgaagcctcttttataaaggccttaatctcatctttgagagaggagccctcataacctaatcagctcttaaaggttctacctcttaatactatcacaatggccattaagtttcagcatctgaattttagaggggacatactgaggcaataacaaacattatgtttttgagaaggtcccattttttcttaatttaaagctcagtccaatgaatatctgtaacaaagggttagtgaaatcccagtccaaaattatcatcttttgaaggtaattcagatggacatttcttgagttatcaaaatgtataatattatctattcaaatcttttctgttttattaattaaactcaggagattaaagtaccttgccatgacattgaaactagtaaaacagccaaatatgaaaaccaagcatgctgggaaaatcctaataatgatggaatggctaccaagtctttgttattcccttggatagtagcacaccttggaaagacttagcaaagcccagatttcaggaaagtagaaaaattgcatttaatgctttgattataaaattatcttgtgagtttcttgtttttttttttgtttttttttttgagatggagtctcgtcctgttgcccaggctggagtgcagtggcacgatctcagctcactgcaatatctgcatcctgggttcaagcgattctcctgcctcaccttctcgagtagctgggaccacaggtgtgcgtcaccacacccagctaatatttttgtatttttagtagagatggggtttcaccatattggtcagactggtcttgaactcctgacctcgtgatctgcccgccttggcctcctgaagtgctgggattacaggcgtgagccacagcacctggccatctcgtgagttttaatgcaactggcagttgactgtgggtcctaaccatgggctctgtttttctcaaatgtaaaattattggccgatgtggaagaccatccatcctgtagggtgaggccctgctttttataaggtaatggaagagtatgctattcaatatcaagttaaaaataacttttaccagtgtggaaaagaaatgagcagggaaacctattgaccattaggcttagttttctgtttggtgccccaacttcactccatctgctatcttttggatctccagggttttctttcctactccttaccccagaaagctgcattattctggctccctgagcaactgacttcagtctgagtttcaccagtgggaggtgctgtcacgctattggagggcagaagaagagcagcatgaaatggttatttggttattccctattcccttctgcttctgcatcacatttctggcaatggctgaatatctccctaactacagctcccaacaggcaacctctctttcatggttccagctcttaccagttacaataattctatttctatcacaaccccttcttccacccctaccccaattcttccagtccaggggtcacaatagcaccccacagtggctatttcctgggtttaccaacttcttttgttggttcttccagcctgcttacacctccgacttttttcctcattaaagtctcttcacttaatttatctgatttgaatttgtctctttactgagatcttgaccaatacctgattttttttttgtactttaagttctagggtacatgtgcacaatgtgcaggtttgttacatatgtatacatgtgccatgttggtgtgctgcacccattaactcgtcatttacattaggtatatcccctaatgctatccctcccacctccccccaccacatgacaggccgcggtgtgtgatgttccccaccctgtctccaagttttctcattgttcaattcccacctatgagtgagaacatgcagtgtttggttttttgtccttgcgatagtttgctgacaatgatggtttctagaaaccatagcttcatccatgtccctacaaaggacatgaactcatccttttttatggctgcatagtattccatggtgtatatgtgccacattttcttaatccagtctatcattgttggacatttgggttggttccaagtctttgcaattgtgaatagtgccgcaataaacatacgtgtgcatgtgtctttatagcagcatgatttatagtcctttgggtatatacccagtaatgggatgcctgggtcaaatggtatttctagttctagatccttgaggaatagccacactgtcttccacaatggttgaactagtttacagtcccaccaacaatgtaaaagtgttcctgtttctccacatcctctccagtacctgttgtttcctgactttttaatgatcaccattctaactagtgtgagatggtatctcattgtggttttgatttgcatttctctgatggccagtgatgatgagcattttttcatgtgtctgttggctgcataaatgtcttcttttgagaagtgtctgtttatatcctttgcctactttttgatgaggtttttttttttcttgtaaatttgtttgagttctttgtagattctggatattagccctttgtcagataagtagattgcaaaaattttctcccattctgtaggttgtctgttcactctgatgatagtttctgttgctgtgcagaagttctttagtttaattagatcccatttgtcaattttggcttttgttgccattgcttttggtgttttagacatgaagtccttgcccatgcctatgtcctaaatggtattgcctaggttttcttctagggtttttatggttttaggtctgacatttaagtctttgatccatcttgaattgatttttgtataagttgtaaggaagggatccagtttcagctgtctacatatggctagcaggttttcccagcaccgtttattaaatagggaatcttttccccatttcttgtttttgtcaggtttgtcaaagatcagatggttgtaaatgtgtggtattatttctgagggctctgttctgttccattggtctatatctctgttttggtaccagtaccatgctgttttggttactgtagccttgtagtatagtttgaagtcaggtagcatgatgcctccagctttgttcttttgacttaggattgacttggcaatgcgggctcttttttggttccatatgaactttaaagtagttttttccaattctgtgaagaaagtcattggtagctttatggggatggcattgaatctataaattaccttgagcagtatggccattttcatggtattgattcttcctatccatgagcatggaatgttcttccatttgtttgtgtcctcttttatttcgttgagcagtggtttctagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgattttgtatcctgagactttgctgaagttgcttaccgaaaaaagtccaggaccagacggattcacagccgaattctaccagaggtacaaggaggagctggtcccattccttctgaaattattccaatcaacagaaaaagagggaatcctccctaactcattttatgaggccagcatcatcctgataccaaagcctggcagagacacagcaaaaaaaagagaattttagaccactatccctgatgaacatcgatgcaaaaatcctcaataaaatgctggcaaaccgaatccagcagcacatcaaaaagcttatacaccatgatcaagtgggcttcatccctgggatgcaaggctggttcaacatatgcaaatcaataaacgtaatccagcatataaacagaaccaaagacaaaaaccacatgactatctcaatagatgcagaaaagccctttgacacaattcaacaaccctttgttttaaaaactctcaataaattaggtattgatgggatgtatctcaaaataataagagctatttatgacaaacccacagccaatatcatactgaatgggcaaaaactgaaagcattccctttgaaaactggcacaagacagggatgccctctctcaccactcctattcaacatagtgttggaagttctggccagggctatcaggcaggagaaagaaataaagggtattcaattaggaaaagagggagtcaaatcgtccctgtttgcagatgacaattgtatatttcgaaaacccaatcgtctcagaccaatacctgatttttaagcctaaggttaggaacacataggaaaaatcaaggtgagtattaaaaattagtagaaggagaccgtttagtgtactactcagattagtagctctttgtacagtcatcctcaataaatgggtgcttctgatgacttacttttttttctttctttctgataaattgttcttattaaggaattctattaagtcatcatggaagatgttatcttctaattttacttgatgcacaatttggaaatataattagtttactgaataatatcatcaaggttcaaagaggactcggtgatctggaattctagatacgtagaatagaaattctgaaattgcatgcaaatcttaagtatgtgtgtataaatatacatatactgagtgatttgctttgcaacatggtgatttggctgtttagaaatattaatgatatttgaacatcattaaatgaagtcaaaggccagctataccctgcaacagtcagaccacatatggtgacatgctgccacttaggggcactatgataaacaggtaaacaaccaagagagctgtgtggcaactagtttcaagctcagggttttaagagctagatttaggggcctgggttttactcacatcttcctccggtgctagctgtgaaatttggacaagcagcatatcttttgctcatctctgaaatgggagacctaagaccatgggaatactcattaagtgaatgtacatgaagtgatgcctgacacattccaaaaactctccagacaatacctagaatactactaataattaccagtgtgtaattggtctggaaaccacatgttgtgagtaacagtctagggaactgggaacaattcagtttatggacaaacatactgagggatagagtaggccgctttcaaaatgtgaaagattgtccaagaggagagaaaattgttctaggaaggcaggagactctcagtgaaaggtacagaggaatataatttggtccagtagcagaaatacctttctaactcctagagctgtccaacaaggaaataggctgataagcaatgtccttttgagccattagtcaacaaaggctggataatcactatgcggaatatgattttagcaggaactcctgcaataagggctgaagtgggggagggcaaggacaggggaaaaggtcacaacatgacccttaatttccctttgcactctacaatttcagactctatgtgtgtgttggacagaatatcaggaaaatggctgccacctttgtttgcattcatgttgtcctctttcaaatcaggcccttggcaaaggtcctgagacacattgtccaaacttgctattgacaatcctacatatattttcctgttcagatgctttggcctgccagaggctcactgggtgtcatacaatagtcttctgtgtcaccagccttgcagatttcttcaagaaactgtttgttgagtaggcgcttactagctggaacaaatccctttgcaaaggtgtaccttccttttcttgaacagaatgaaaaatgtgttgagcaggaaaagaaacttcacagtatttgtgtttttcttttggccctttctgctaggtatcctcactctaattgagcaggctctggaaacctgaaacgcacatcagtcttgtgcctttttctgtttcttccactagcagttgataattatagcttttcgtagatactcagcacattccatgtttttgatgggagcagagcctttgtatggcaaaattgctgatatacttttaactaaatctgtagatgtgttatgtttagaaggcagcggaagaagcctgagctggcagaataattgctgtgttagggcgccactgaagacaaatagtgtgcccaagattgtgaaaatcctttcttataaaaactttttccaacaccagggttccttttgggacagaaataacaatatctgttctttctgagaaaacttggagagaatgtcaatgtgatatctcagggataattcatttttgaaaaaggagaatcctttctactgaatactttttataagggacatttttagctttggaactgcatttctcttccctgtctggatgttagctgtttgtatgagtggtgaggacaaaaagtaaaggattgcatcccacaaaaaccaacctcaatagtttaaggtcacacagatggctttgaggtaagaaaggaaattacatctcctgaaaggcaatgcacaggctattgaataggatgaacttggaggtctcttctagtcctgagattttatgattccatgatcacagaaactactagtgaatgtgatacttcatatctcatccattggctatttcaaatggcaactaaagtgagaagggaaatcatttattcttaaatgcaaattcaaactaacagaaattggatatatttcttggtgttcatgagcattgccagtagtaaaatatatgtttagagataagaaaataaaaacaacttatacttattgaatgcttatgacataccaggtcctatatcaagcattttatatgcatcatagattctattattgtcaacatcttatggaggaggtaactgaggattgtagatattctgaagcagtgtcgtgaagctgacactaaacactcttggctaccatagcatcctgcttctctgtagcagacgctggtgattcatcacaccacatttctttggcactctggatttcagcacaagtgctgtagacagttaattgcctatcgctagtgtcccgcttccttcaagtgcatgtgggaaagaaggagagggaagagaatctgaaagaccgttcagcaggcaggtgcaactcagaattaagagagaataatatactctacctaaggacagccctcaaccagtggaatgatggggatggtttccgggtaaactccgaccctcattgtcccgaaggagaacacttccggggcacatactacaatcgtttcttagagtgtccctaacaggggtgagccccccactcaatacacagtggtaagaaactcattcctgcgttcttctaatacatcttccttccctatctcattgtctatgctcctcatttctgcatcctaggatcagctcccaaataaacttcctgccctcaagtccttgaccaaagtgctgttttggggaggagtcaaagtaagattttttaaagaacacacacgttactgctatgtagttacaggcataatcttactaatggactataatgtccatcataccatggggttgatggtcataaaacctaggcgtatttgggaatatttctgtgacattaaatctctaactatataatagaagctaatggtagtatattgaaatttgttctttggaattcaattattcaataaaataagagaaatctctaccacacattagcatgaccccgttgaagtcttcagaaagcctaatgatttagcatgactatttcaagatcatttttcctaggcttcctcccatcctactcctggaagtgctctgctattaatttcctttgtggtcttagataagtctcagactgcaggtgaaatgattaaattctcatttctcttgaaaaatttcacacgaagtctcttttcatctatttcaatacctgatatttaatttgaatggagtataacaactacattgatatagggaaagttttattgaatgaacaaagccatcacataaatttttctttcatttttttttttgtcagtctctgaaattagtgaataggtagagacatccatcagttggatcattcttaggtaacattttgtttataagaacagggcagtgctggaatgtggatttacccacaattctcacgtgagatttctaccattgtactgctgttttcttcttgtctctgatttttttcaatctctgctcctcaaacatccaggtagctttgatcagtgcttcaagcagagtactggagtaagtaatatatttttctataaccttgtaatgaaagcatgatctcttcttaaggactctgtacttagcgaggcatctatcggtgattgtatactttgtagattttatttgggtggttctaccatcctccatttattacatatgacaaactcagtaagattaggctaagaagaactggttcctagaagctaatgttaccctggacagttaacaaaatttttgtgaaagtactgtagagttagaaaacacaccaaatagtacaattctccacactggatttcttcaatttactgttaagttgtaaaaagtaggcttgtacctgatgaaaacatttggcaaatttgtatgcagtaccagtgaaaaatatgcacaaattggcaaaataaggcaagattctaactgctgtccatgttcaagaactataacagtagtggggtgaatgctaaatctttacaataatatatagattgtacatttgtttttcatggattataagacatttttcatttttcagccacacggtattgattcatcacttccatattcagctatgcctatatatgtccatgtcacaaagttattttcccattaaaaatttactctgtccttgcaataagaaacacaaaagagttagttcaaaggaaaaaataacaatttgcatttggataaaaatggtaaatagatttatttttgactcatcctgtgaatccttttcagattgccttctttattttttattttttgagacagagtctcactctgtcacccaggctgaagtgcagtggcacgatcttggctcactgcaacctctgcctcctgggttcaagcgattctcatgcctccgcctactgagtagctgggaccacaggtgggcgtcaccacacccagctaatttttttgtatttttagtaggtatggggtttcaccatgttggacaggctggtctcaaactcttgacctcaagtgacccacccacctcggcctcccaaagtgctgggattacgggtgtgagccactgcacccggcccagattgccttcttcaggtaagtattttaaacctcttatgagctgtttccttccttcatcccttcgtttcctcctttttcctcccctcctaggactctctttctcttttcatttgcctctattttccttcattcttttcttcctttgttcattccttcctcccttctttcttccatctccctcttcttctttcttccatctccctcttcttctttcttccctctcttccttttttcctccttatttcttgctttccttctttatttcactcatctaaaaaaaacctgtagtatagatctttgaggaaattattttagttttgacattcattgcacagttgtctgtaacccagttagggaattctttcctatttttaaaatgaaaatagctgagagatttgtgaggaaaatttgaaacaatgttgattctgaatgtttttaaaaatttctaatatttatgaaacaactgtatctcagatgagcttcaatttgcaaggcatcattccattttcatttttaattctctgttccaatgcctctgctaagaaataagcattttctcataggaagagattattccttttaactttttttcaattttaatttttattcagcctcttacctttttgctaaaaccaaaagttcaaaagaaaggtgatcaggacactcccaggaattttttagccatgtgagaatatatggtgaaatgattcaagtagatgcaacatggtctactggaaaagcactgagattttgaggagaaaacttagctctgccattagttaattgtcatcaaggtcttcctatgaaaattgtagttcaattttcaaacatttattgtttttctccaaagtgctaggcatatgcttttgtgctggagatgaaagatgaataacatgtaggtgctgtttttgaagaacatcactgaagagagagtgagctaaaacaaataatgatttgtgtgctagaatagagccaggttgtacagaaaggttctattaatagcgctcagtgatccctgcaaaagaagcatttgattctgtccaaagagatgagtacagaaaaagccaaagagaagaaatgatatttgatttgggattttgaaggatgaataggatttaaccagatgaatacattggaggaaagatattctggtaggaacactgtgagtaaacaactgtaggactttgggagggattgtgagtagagtgtgcaagatggaaagtacgttggcattataatgattcatcatcaacaacaccatgtttgcttgcctggttgaatgtccctgagtacaccagctgacatggatgccagaattccagctatgagaatttctcctctatttattttaaacgtaggtacaaatcagttctctttgaaccctgcctgactttgcatcatggtttcttctccttatctacttctttgtgaatgtgataactcaactttggaattgtaactttgtttctggcatcgcatccttcctaacatgctcattccaaaaactactctttcactgcactacttaggcaagaggcccccggccatgagtctcagagttctcctcctcatatcaccaaagtgtcccatgggttccagtggaaggtgagcaataacagtatctcctgcagccacctcacagaactgttgtgaaggatagagatgataacagatggaccatgtattcactttggaggtaaatagacttggatttaaatcctgagtctgactgagtaagccaagtcaagttatttaacttctatggtcctcgatattctcagtttcctatgatggggctaatagtacctacttggtagaattattgtgagaattttcattcaatgaatgtggactgaacacttgctatatgtgggctactattctagggcctggggatgtaaaagagaaacaagtccttgcctccttgaattcagactgtaaataaacaattaactacataatataatatcagaaagagtttggtggctggaagaatagcaaagggtaaggggagagagagagaggaacagagtgagagtagtgatattgcagagggtgttcaaggaaagcatcttacctgcatgaaataaagggataaaccatgtagaaatctggaagaagagtatttcaggcagatggaagagcatatacaaaacctctgttatggactaagttgtatccctctaaaaggcatgtgctgaagccctcacccacagtgtaactgtatttgaaaataaggcctctaaagaagtaattaaggttaaatgaggtcataagggtgggctctgatcccatggactgatgtccttttaagaagaggaagacatcagagctcactcactctgtgcacacacagaggaaaggccatgtgaggagacaggggaaggtggccgtctacacgtcaggaagggaggcctcaccagtaaccacccctgaaggcaccttggtcttggtcttctcacctccagaattgtgaggaaataaattcctgttgtttaagccatccagtctgtggtgttttgttatggcagcccgagctcactaataatacaggctctgaggctgaaatgtcccaggcatgtgactgcagcagagtcagtgatgggaggcagtgctgggaaatgccttggagaagtagccaggatccaggacacctttgccatgatgaggagtcaggacttgatgccaagggagatggctgtctttgaagcatgtgcttcaaggagtaaaatgacatgtgtttttaaaagatcaaactggctgctatgtggggaattgactctgggccagagaccatggtcttgagagcagttaggtagacaacaggagcccctagtggagttggtgagaagtggttgggatacattttggagatgaagctgactgaatttggtaatggattggatgacgaatggaaagaaacgagtcaggatgactcactggttattgggctgagcatccgagtgagtgatggtgtttttgtggagactgccactcttacgtctgtaatgctattctgcagacaccagtgtggctcactctctcccgtcttgcatgtctttcctaaatgtcaccttctgattcagaccttccctgggcagccttttaaaaattgcattgtttctctgtttccctgtcatgcctttcttttctctatagtatttatccccatctaacatattatatattttacttaccaattttattttcttctaaaatgtatatttcatgcatttttatctgttttgttcactgctttttagttcacatgtcttgaacgtggtctggtatacaacaggtgatccatatttcttgaatataaggatggatgaatgaatgaatgaatgggtgaaacctggggaagaggaatcaagaactttgttaaaatgagtactagttggccgggcatggtggctcacatctgtaatcctagcactttgggaagccgaggtgggcagatcaaggtcaggagttcaagacaagcctgaccaacatggaggaacaccgtctctactaaaaatacaaaattagctgggcgtggtggcacacacctgtaatcccagctacttgggaggctgagggatgagaatggcttgaacctgggaggtggaggttgcgatgagccgagattgtgccattgcactccagcctgggcaacaggggagaaactccatcacaaaaaaaaaaaaaaaatactggtcaattggaagtatctggaaggtaattgctataccattaaatgagatatatataacaattattattacaagtattcttcctctttttttttttttttttttttttttggagacggagtctcgctctgtcacccaggctagagtgcagtcttgcaatctcggctcactgcaagctccgcctcctgggttcacgccattctcctgcctcagcctcccgagtagctgggactaccggcacccgccaccacgcccggctaattttttgtatttttagtagagacagggtttcaccatgttaagtattcttcctcttctaagtgtgctgcacccacctcttagtagactttggttgggattatctgagagtagtcttttttagttctgtggctgtgtgagcacatggttgggagaatgtgaggaggatgtggccatgaccaactttatccttttgtagccactcactccccagcgtcacacaaatggatgcttacgcagatttcctatatcctccataggctcctatctttgtgctgagtattaattcccatctgtgttcaaggacggtaatcaggcaggggcagtaatcaaaatgatgtgtacagcaaaatcaaagctttcgcatcataatcaaaaccatgcagtaaattataggaatacgtgttctggtttaatcaatgactgatcttgcttggatgcttgatacagagaaaatcaaagatttggtttcaaattagccaaggggaacatattatgaatgatctcatataacttagcatgctatcacagtgattattttttaaataataagattttgctgtaggtctcaccacactactattttagcatacaacgactaagaaaaattctttagtatttgtccttacatagtgtcttgaagaatgacctgccctccaaaagcttgttacaggagagatgatataggcatgagcaaaaaatggtgaatgtgcttgtacccagcagtgttaagtaaattccgatctttgctgtgaattgcgagtgaaaagtttggggtgagtattttatttttcattgagaagtgaaataattgttagtttgtttagtagcactggtttttgggaattttttttcttttttgtctttacacattgcagagtagcagtaaagaaataggttggtcttttaaagggtgtatttcctgcttttaataaacacaagttttatgagaaaaataaataaatttcaatataaaattaagatgtacagaatatagatttagcacatataaaaaaggaaacaaaaatcattttaccttcactttagcctgggctgatttaacaaaacaccataaactgggtagatttttaacatcagaaattaatttctcatagttctagaggctgagaagtccaagatcaaggtgctggcagatttggtgtctggtgagagcccactacctcacagatagccttcttctcactgtaactcacatgggagaagtggccagagagctccctgggacctcttttataagggcactaatgccattcaggagggagggcatcaccctcaggacctcatgacttccccaaggctccatgtctgaacatcatcaccttgggggttaggatttcaacatatgaattttggattgggacataaagagtctactgcaaatttcttcatgtcagtcacattttaaccaaaatcatcttacatggacttctctagaggtagttatattttttaaccaactgcacttttatatgataacatatttttatatgccacctgcaaaagggctacctaatgaggccacctattttttgtaagtgtaagagactcagctggaagcaagttcaagtgtgaagcactgtcccctctctacctgggacatggtgcatacaaatgggagtaacatgagctttgcaggggtcatcttggcctcctgtcccacctccaccacttaccagtcatcattcattattgttattccatgaacaatgccacccacaaacccagagtgactctcagttcattgcttgtcttcacccagcgtaatgccagttgtgtgtccttaacatctttctcatctccttattttgtcctcacttctctccccactgccaatgtttaggcctgcagcaacgatttcctaaattgcccaccttccatccagcttccatcacactgctagagtaacacttcagaaaatccaagttcaatcctattaaaatcttattttaatcagtcgtctatttaattatttttattattgcccattactaggatagagaattccaagtttgtcaagtaatgaactgcatgatattcctggtctctttattcaaagtcatctcctacttatacccctaatgtgtgcgcgcacacacacacacacacacacacacacacacacgtacacaccatcttgccttccaggcaccctcagccacctttactactcctggcatgctgtctcctgcacaagtctcattgcctttaccctctgtggaatttccctctctgtgctcttaccagatcactttataaagttatttttaaatatgcttgtgaaaataaatgaagatcacatgaacaagaacagaggtgatttatttagagtttgcaagagaatcaaccactatcagttgcatttggcacagacttaaaggaacacagaaagataggaaacctttagagtgaaacaaagagcaggttccaggtacgctgtggcatgaggaagctggagttgagctaactagatgtgaacatctgatgtggttggtttgggaagcagatcttgcttcctccggttgattctgagttgaaaggagggagccaagaatagggaagctggcagtcattgactgtatcgtgactgttggggccagttgctgtagaggttgtggtttggcttccagctggttgctgcagaggtggtgctcagaattctgttgtcatatattgtctggccattgtccgtttgtatatttcatctctcatgatcaatcaatattttttgaatgagtacatgaatatttcatctcagtaagtgatcattccctcctcatccatcttaatcataaaattctaatgtcctaggttctttatctttcaacaaattatgtttccctttcttaatgggtagaaaaaggaagcttccccataggcctaaatgtgctgatttcaagagaaagcatacttctttgcaacaagaaattgcccaggccttcactcttaaccactatgctacatcaacgtccttagatgaaacagagacttgggggcatatatttcccaatttttcaaaatccatttttatcgcatattcaatttggcctgcttaccttatttacattacctgtctgggatgaaagacatttgaggttgtcattctggactcttaagtaagttcttcctttaaagtaaagaagctgaccttccaagctaatttatcccacttaacaagagtaataataacacaccacccactccagaaaggaaatcatgcagatgaatgaaataatgtttgtacagagcttgacactccataaaatactctaataacatggtgtctacactttgaaatgttcaaatcctatttcaatagaattaaaagccatgaagaataaaatgtgaattgcttgtcagacttttacatagaggtgcagggtgatactgatgccattagacaatttaaaagctgggttttagcaaagtttctgaggaatctgattggtttgtgggggagaaagtgatggtggtacttattcatatccatttttgtagaaaaacaataggttataacatgaaccgagaaacacttacgcagctaaatttacagaaatctgtctactcatctccgaggaaaagttttggctaagcaagttaattttgtcgttagacatttgcatagtaattgtattgagtctgaatgtgcatctgcatggaaagcatgttttttcaatcctgttctttggacatggattaatatagatcctggcgagtccttaaataataaattattgaagttgaatgcttaattactttacatttagatcttttataaccagatgcttgaacccctagtctgccatgtattgctgctgcctttattggtgttaccaggtaatagtcacctgagtttttcacatggtcttggtttgagggtagtctactaaagaatgcccacatatagtgtttcaaatattattaaagagtgataattaaatgtgcctgatgtataaaaagcatgtgaggtcatttaaactaacacttttattgtgattgttgtgaaggttatgaaaaacttgatcatgtatattatctaaagggattgttacaaacctcaagtgacttcaggtcattgaaaccattgcatgtggtgaccagctacagaggccatgacatttttcccttgcctattgtatccaaggttattttgcaaatcaccgctttgcatggtacaaccttcggagtttctagaaattgcctggagtgataaaccagagtatattcaacaataggatttcctagaattagtgggagaggtgtaattaagttactgtgtaatatatttcccccaaatgataaatatcaatatgtgaacactgaatatgtgctcctatgaagccaccttaagtggcagtttttagctcagaaattgtgaaccaatgttttgtccacctgaaccagtttgggtggatggaaaagacttaagggcagatttcagaacttgtttttctttgttaattcaaaaatgattctactaaactctagatgagatcaagtggtgatagagatatcagctgagtgagttctgttttctggaactttcttgaatctttattagtaattcatagcatttttctagatttcatggctgcagtttcatattgacatcatccagtatcactctaaagggactctaaaactacccttcctggcattcatctaagagctgggaagccatccgcttatacctggcttagaatatcatttttagagacatgaccacaagcctgctgacattcaagagcatggcttaagtgcatcccactcagagctttgtgaattcttcttgtaaattatgatgcctattcaagatttagtgggaatactccctcttctcaagcatttatcaaaacacaaggtgaatgcattatccacattaactgctgttcaaaaattctgtccaaaagttttgtttcaatataggcaaagtttctgtgtgatgcctggcatatggccaaccatataggatggccatgatctttattactgatttcttagtgtttattttgaatgtaaagttctttatgtttttcctaaaagttcctcactgtttccctcactcacccactagcccacatattcacatattttacttggttgtgactatttgaagaaagcccttaaagcttttttctaaagccccccatttaagattttcaagtacataggaaccactggggactcttactaccattctgattctgtaggctggggcctgagggtcttcattgctaactagctcctaggtgataggaacagtgctgagagcacactttgagtggcaagtctccaaagcagtgctgtctaatagaactttctgtgatgatggaaatgcttcatatctgtgccatccaaatgagtggccacttgcccgatgtggttaatgagtatttgaaatgtggccagtgcaactcaggaactaaaatttaattttatttagtttaattaatctaaatttaaatagatacctaccttatttgactatgctaggggacttaattaaagtctttatagctccttggctttccccagtcttgagaaaaagaatctgaaagtcgagggctctttcttatctccaattttccagaatcttgcatagggccaagaatattatgtatgcatagtaaatgacattcctattaagaggtctagtctgcagttttgggggcagactcatagaactgtcaaataataaaaagatttgactttgaagctataagacatggtgggtaggtggctcagcctctaccacttacaggataatttctgacaagtcacttaatccctctaagcatcaatttcctcatctcaaaatagcaatcatgattatggtaatgtaatacctatctcacagagttgctgtgttatgcacataaaattcctggcaaattatttttttcaagtgatacttgctctgcaaatgctagtttttgtggttatttcagcatgaatttcttttttcccctaattagttatatttcagtaaaacaatagaggaaggtaccctgtgtggacatagttgcaatccaattgagaggttaaataataacacaaaactacatgcagttttgtatcatttctcatgtggagaaagtagtttcgacggtcaaggaggagggcttcagcatgttactttgattctttgcattttatattattttatgtggaagcaaacaatatttttggcctgggattttgtgttgtttgatttaattccctcataaaaatgtgtcataaatgctttgctaattgtgattgaaatttcataactctatctcatcttaaaaatatcccattccaatttgctgaatacataatttccccttgtttaaagttatataatggacatattttctctttgtttttcttgagtatatttgctttgaaatagcttttttgtttttcataccctctgtttatatatatgtatatatgtaaatatatgtgtatatatataaacgtatatatgtatttacacacacacatatgtatacacacatatattaatcaaaagcattgcctacttcaagaaaataagaaaaatcacaaggggtaacatttcgcaagtgtgcaaagcactattctaaacaccttacatatataaacacgttgagttgtcactgaggctgagtaaacctttaagctcttttactgtctgctgtggtgttgagttctgaaaatattgatagtcctcttatcactggtaatgacatgacgtgccatccaatgacctttgtacaatcatgatttatgtataggttgaactaggggcatcgccatttaagaacgattaagacaaatcaaggcatttctgaaagagaacagattgattttgtttcttaaagtatttatagcttgtaaggcagctgtctgcttttgtatattcttaaacaagcatcatagaccttattcaataatttaagtgttttctttagaactgttttgcagcaaaccgaacttcccatttgcattgatcagtgttttcaccttcattctagattacattttaaagtaaaccaaccaatttggataaatgtaaacgcaatcacttgttaacaatcttctgagactgaatcggtgctgggtatttctgagtttctatggaaggaaaatagttcaaagttcagattggctgtctcaccacctaagctccatgccttgccccttgctttcctccacaataaggcttagacgcaaaacacttcgttttcctgatcaccactcaggcatgagagaccaggtgatctatggctggccaataggccaacaacaagtagggagaacctcctttcatgagtagaaaggcaaagcattgtgaagggagcacctttctatattattccaacctcgaataaatgagaatttatttatttattttattccagtttgttcatttatttcttatacgctctaagaggcaactcagtatgttgattatttttttcagattcatgcccattcatcttcttaaagtagagtttctacagatgctccaggatcagtctgacctagtacagagcagtgtgtgtgtgtgtgtgtgtgtgtgtgtgtgtgtgtctgtgtatgtgtgtgtgctcctgcatgcttttaattatatattgaagatatgctaaaatatttataatgcctctcaaagattcaaagaataataataaaataagcagctttccctaccttagagaccttctgtgtacccttcccttatcccttcattttcttccctaccaacataaccactgatctgaattttgcatttacttttctcattcttctcttacagtcatactacataccaggcagctctaaagatatattgtttaattttacatgttttggacttctttaaaaaaagaatcatactgaacaaaaatggaatcatattgcatgtattcttatgaaacttcatttttcatccaataatgctacttgaaatgtatttatgttgatgtagttactacagccatttttcactgctctatatttgtctcacttttgccaggtttaatttttttctattttatcctttgaactagcttgaaattatatacttcactcttttttctaatctcttggttactccagaaattttggcttgtatacgtaactttaatcaaaatctttatgattctcttgaatgataaaatatgttcagcattttagcttcagctatttagtctggtatttaattacaccttcctaaaccacacacattagacatttttactacaatcaatgcttatagaaattcactcacatatttatcagcattttttttatttacctctccttcatgcatctctgactttgcatttgggattattttccttctgactgtagttggttctgtaggaaatcctcccgggagtattgttaaatattttccatttgtttgaatgaaaaatggccttttgaaatcttttgtattaaaagttggatgcactgggttttcagttcccggttgacagttgtttcttcttggcacattggcagcagtttctcctatagtctaatattcactgttgctgttgacaagtcatggcaattgttattcctctgaagtaatctcttcctctggttgcttttaatattttcatgttgtattgggtgttctgaaatttcactaagtctccaggtatatgtctttctaagtttcctcctcaggatttgttgtgcttcctaaatctgaggtttgaggtaatcagttctctagcatttatagcccattgctactttgcctccctcccattcattctgttttccttttctcaatagacttttccactctgtcgtgccctccaacaactttcttatgattccaacctagctgtctcactgtgctgccttctaaatcactttttcataactatcttctaggtcaataatttttccttcagctgtgtctaatctgctgataaaacatctgtaaggaacatgactgtgctgcacccaagcaggcataggccaaggtaaacaacctggatgactcagcaggtttgtggtacaagtgcatagtcccatgtcttatataatcatagctgtgtagagataacatagaaaagttcaccgccatagccataacatagagaagctcaccacctagctctcagccactattgtttgtgtaatgtataaaagtaacactgaccctgtgaggcagctgctgaataaagccatgtctcatctacctgctgtttctcaagtgttcttccagctccctgccccacatccacccactcccctcagccctcagctggggttggaacttgaccccaagcatgacaacatccattggtttttaattttaattaccatatttttaattcctagatattctttttgctttattttaaaattgatttggtcattttttaatagttacttcttccttaatcatattatcatcttcttatttatttcctgaaatgtgttagacattcttagataattcctatatctattagaattatgggttgaagttgtttgttatttgtgctcttcttattcatgttgacttgttattttatatattatatattttcatggaactttcttttaagtgttgtctgagacctgggttcacgtcaaggatgatttttgtttgcttcaagtagctgtccacagaggtagaggtgggaaatcaaccagtggccaataaattcattccccaactccctacaaaagtagtatgatgcaagccataaactcaaataccgaccaggttgtgggtatgaaatctctttggagattttttttttccttcacttagtgctcaattcatcaggcaatttcccttcttgttttctgaaagaatttattgccagttacagcttatgctgctgttccaattgtataagggatctctagtgagactccccacattggaaagtccttagactttttctctgattgctccaactcacacatttgaaatcatacaaatggaagctcatggttgccaagactcagcagatatcttcagggtgaaacctggagtcagtgttaatgtctcttcagagtctttagtttgttttcatccttttccagcagaagagccctacaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccgttgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtggggacatggatgcaattggaaatcatcattctcagtaaactatcacaagaacaaaaaaccaaacaccacatattctcgctcataggtgggaattgaacaatgagaacacatggacacaggaaggggaatatcacactctggggactgttgtggggtgggggaggggggagggatagcattgggagatatacctaatgctagatgacgagttagtgggtgcagcgcaccagcatggcacatgtatacatatgtaactaacctgcacattgtgcacatgtaccctaaaacttaaagtgtaataataattaaaaaaaaacaaaagagctgtacagggaatctaggctggcatagtgtgagaaacaaaacacacatggcagctctttttgccatccacaacaaaatactaacaattgagcctataatcagctaaatccaaaggcaacataatgttcttccccatcttttacttgtgcagttgtgttttggatccagattaaagaccttaaatttagtactattaagtttattgtttgtaggtttgactgagctccgtaaaattttttggatcttaattctatcacttaacagtcacaattttccccaatttcatgtcatgcatacatttggccatcacaacttgaatgtttttactacactgttgtaaaaatgttgacccagatcagattaaagcctcaatatcccctctaggtagagactcgtgtatgatgtggcattgactaggtctgctgttaggaatactttctctttcttttcttttgttttatttttgagatctccctctgtcaccaaggctggaatgcagtggtgcaatctcagctcactgtaacttctgcctccttgattcaagcgattctcatgactcagcctcccaagtagctgggattataggcatgtgccaccatgcccaactaattttttgtatttttagtagagatggggtttcactatgttggccaggctggtctcaaactcctggcctcaagtgatctgcctgtcttggcctcacaaagtgctgggattacaggcatgagccaccatgcctgtccatatttctttatcttcaagaacatattttgccaaatgccttcctgaagtcaacacacattgtatttatgatttttttagccagagaagaattaaatcagttaacatgaatttgacttataaatccacctgtgtgttaatcaaagggctccatggatagccacacccagtcatcatttatcatctccatttattcctcactggggtcatttgaagattctgactcagaattacatccttgataccttgctaacagtcaagttaagctattatggaattgtgcctattttcatgaatatttgggcagcctcttttcctaaagcttataataaaggcctctatgaactaccatgaactccatggacagtaggtatacagtgttatatttgagttccttcccttttcaccagatgtccaggtaatctgtactttatttctataatgacatagcatccatccttttctccttttatcttttgagcattttccagggtgctttcatcatcttggttttggatttttatcagaacatgtgtccttgaacttgcacacaagaaagactttcagtgattgacacatccaaggcttcttatttagttgttcttcaactcaaccacattgtctaatagaaaccagccaggctctgctgtctgcaccattaggatgattatgaaaagaatttaactagcattttcctatttatctttcaaatatataagcttctacttagcaatatgaaataacaaaccactgctacaggaaaaatgtggataaatctcacagagattgtgtggaacaaataaaacaaatgaagtcatgtgcaaaagactacttactctgttgttctgtttataggaaattcaagaacaagcaaaactaataaatggtcctgtaagtcagaatagagttttcccctgggactgggaaatattgactggaagaagcgtgagggagccttatagaggctctatatgttctatattttgatctaggtagtagttataagtctgtttacatatataaatattcataaagttgtacatttaatacgtgtgcattttactatatgtatgttataccttaataaagaagaaaaactcatttaggttacaagtgagaatcagttttagtgcagtacttatatgagtatggactctggagtcttggatatataatcagttgattacaatcaacatctgaatgattttggaaactaagtttcctcatctgtaaaatggatgattttctgtgataactgtacatttttactttttgtataaggcataatggagtgatgtgtgtaagtcacttaccatcatacctgccacaatacatgcaagttttagtataatatcgtcctgattcaaaacatttcctgctttttaaaacatcctgctgtttagacagatgactgacattattcaatacatcaaatggtatgttttcattagttatctatttgtgacttgcttagtaattataatggcaactgccatttatgtaactctttatgtttaaaagctaatttatatacattatctaatttaattattcacaacagtgctataaaaatgatattaattttatcctcatcttgccaacctagagcctgagatgcagagacctgaagtaacttacccaaatgacatagtcaggaaatattagagagagtcataactcagtcatttatctttccctcttcaaacggaagggtacattagagtcacctacagagctagttacaagttccaccccccgtagtgtctgattcagcaggtttgaggtgggtcctgagattgctgcatttcccaggcgatgctgacactaccgtcctatggaccacactttgagtagcaaagctttgcagatgaagaaagcgtaagcatcagacctgagttctgccttcaaagagcttgcatttcttttttcaggaaacaggactgaagtatgaaataatagaagcctccctaaggtggtttatatcctgagaacaccctctttgctggaaagaaagtttcatagtagaagagaacttaagaatactcagattatatataggagaacaaagtatgcttagatacgctaattttaatggtgttcaatgacttatatgccaaaatgttaaaatggtgggaggcccctaaattaatatcctaattcaagtatcctagtcgtgttattctcacaaattgtcatttcattatgtcaagtaatattttagggtgttttaaccatcgttatttaggtctttgattgatgtgaaaattagtctcagtgctgtaaccacaggtttttgtcagtgtaaccctactgagttccagcttcttttttaaaaaaaagtacatatgtgtacccacaaccattgttactaattgaaatacttgaagaaaagagagaaaacagtgaccaaaattcttataaaaatcaaaagctttccattttttccagctttgctttgtttcacagcagccatttatcagagttttaacaagtaacaagtaaccagtcacctattttttaagtgacagcattattaagatataattcacacaccatacaattcactcatataaagtgtacaattctgtaggtttcagcgtattcgtagagttatgcaaccatcactacaatgtaattttagaacattttgttacttccaaaagaaaccctgtccccattaatagtcattcctcatttctcaattcactctgccctttgcaaccgctaatttactttctgtctccatggatttgtctcttccagacatttcatagaaatggaatcacaaaatatgtggtcttttgtgaccagcttctttcatatagcctagcgtttttgagatccatccgtgtaaaatggatcagttttttattccattttatggtcaaataatattcaattgaatgaatatgccacattttatctacccattcatcagttgatggacatttcagccacttccacactttggctgtatgagtaagaacacatttatgtacaagcttttgtgaggacatatgttttcatgtatctttggtatatacccaggagtagaattcctgggacatatggaaactatgtttaaaccataaggaactgacagttttcctaaagagttgaatcattttacaattccactagcagtgtatgatgattccacgttctccacattctcaccagctcttgctaatatttatctttttgtttacagtagtgggtgtgaaatggtatcttgttgtggttttgatgtgcatttccctaatcctagtgatgctgagcttcttgcatgtgcatttgcttactttgttttctttttccatcctttgagacaaggtctcactcttagtccaggctggagtgcagtggtgcgatcacagctcactgcagccttgacttcccaagatcaagtgatcctcccacctcagcctcccaagtagctgggactacaaagcacaaactctttagttttttagaaatggggtctcgccatattgcccagactggtcattcatttatctcttttggagaaatgtgtattcagattatttgcccattttttaatttttttttctttttaaaatttaattgtaaaatttgaataacttttttgtgctcttctttgttttggtcttgttttgtttgatttggtcttgttttgttccttaaccttttggtgactagtgagtagctattggtagaaagtgggtaattactaaacaaattgcaatgagaaaaaaaagaattaaatagtgtggaacacttgcaaatatgataactaagttttaccaattatgaacaggttaatatttggtttactgtttggaaaataataatgtacaatttacacattggttctaatacagtatttaatctgtatctttgtgtcatatttaataccaccattttccaaattgttccatggaatgtaataggttttatatcaaaaaggggtctgtggcttaataagtctggagaaccataggctcaataaacgggatggagtgttttaactcaagggcttccttgaacctttaatatgtaaatagacattgtaagtgttcaaagcaaggactgtacatgaaaataaaaccctttactttccctaatcatttcttttgggacttgtgttctgtggaacacactcggggaagcattgctttaaggatgttaatttttcttaaagaaagtatattgccctggagagctcagattgtgacaactggacaggtacaaagactggatgaaacagcagcaattgttaagttacgtgttacaaactcagaattaatatgggaaggatcctgacattttatgaaattaaaactaatattaattgaacagaaatagaaaaaaacctgggaagacttgagacagtttgtgattcctctcagctagctggcatgtttattttgtattacagtgcataattgaccccctgctaggtgaattggattttgcagactcgccttgttatgtatttcaaagagctctaaatttaatacatgctgctcctcagggttcaagctttgaatcaccctccttttcctgtgttttagctgggtaagtttctctcttttcaagaacagcaactttttcaatgcagacagtttaattataaagatcttctcatttcggtaatgttttagtgaatctcatatttcctcataaatttagggagaatgcagctatttctaaaaataggaattaatagttgagttgttactggcttttttattgtcctttccagaattacaaaaaaaatagtctttggcagttcacattgcttcaggttgaaagtatgcaaaatttttaaactattccatattcgtaataagtgaaaaaataattatttttgatttctcccctaaggtactagcaatgtgtccattaggaaatttagctcttatttttggtgaagtagcagaatttttgtttcaaggcaaattcagcatagatacttgattgtaaagatattattgtttgcaaatctttgtggagttttttgggggccaaattgaagcattaactcaaaagaatggcccttttcttttattgttatgttcttttcattttatttatttgctttcatacattttctaattaattttatgtttttaccaataccagccccatcactggggttctggtgaccacttaattttactgtgaagtagaagccagatgatggataagtcaagccccaatataataaagccaccttaactagttaaactgatattatagagcttagctctgactccagatatacatatataccattactttatagaacaactctctctggaatagccgtgttctctttaagccaggtatgatggtgcatgcctgtagtccagctactggggaggctgaggtgggaggattacttgagcctaggagttcaaggccaacctgggcaacactgcaaaactttgtctcaaaaaaaaaaaagttatcttcgtcattgagatgttgcattgatcacccaagtatggtgaagaattgaagagtagccaattagagtgctcgattatgaaaatatgatgcaagatagggaccaggaaggtcaccacagttcttcctggggctagttgctatgaaagataaacccccacatctcagtagcttaacactattgaagtttacattgttgtttacaaaatgctctttctggtggactgtttcccttcaagccatgattcacatggccggcattcttccatcttgtaaacccatcatctacaaacagagacatccaacttaccctgctaggctgcatcaagccagaaggagaaagagtatggacggtcaccagtggaaggtttctgtgaatgtgactctagctctaactctgtgagctagaagtcagtcatatcaccaaacctcatcccaagggacactggggcatgtaatccaaccacatatgctcaagaagatgaaatggattttggtgaacatgcagtgatcttgacatacactgctgaatatttgcttttttatatttacagtgttgaaattaatctgactaatgaattggagttagttatctccaaaggaaaaaaaaattacacatgcacgcacacattaattatacattagtcttaggctaataattaatatatccacatgttaagtaatttctttaataagttctcttcaaattagttcaaagatgtctttggcattcctagaaggcacattttattgatctgttctcaatttacaaaacaaataactgactctttatatctcctgaatctcctttgaacattaaactgagtagcaaagcatcacacatagcaagaaaattgattttgacaatccagccttgttagttatcatttcaacaggtgccattagtatcaagaccgaggtgcctgccacagctctagtgcaataatgtgaagtaaatatccatccaagcaccctggcctcttctccaaaatagaaaatgacatcatgtaattggttttgtctgaactgctcagtgagtgaaaatgtgtttcagaagagttaaggcatgatgtcattattcctgaagtggattcttgcaaaggctgggcactcagcagcctgagtcttaaaaccagcagcagtacaaaaacctgatgcagaaccttaaccccatttatataatatggtgaattttttctcaaatgggaatatggtgcattatctttaaaaacaagaagtgatcacatgctccagaacaccactgatgcctctaagaaatcttattgaattaagacagttaattaattgtctgcaatagtcttgactcttgcctgtctctcacttgagcatgtgttgtaaattaggcaggaatatcattagggcatccagttcgttcccatgccccagtggcaaagaggggcaggacatgaagatgattttatttatttaacaaatactgatcacctgctatgtgccttgtaatgatcttagtgctgggtatatagccatgaataaaatgagattcctctttttatacataataagcaaataaaaatacaacccaatggcaggtagagtttcatgctaggaagaaagataaagcaaaatgacatgctagagggtgatgcgggagtggcatggactggaagatgggctgtcagagtatgacatttgagcagaggctgaaatgctctgagggagaaaatcataaatcatgtggatatttgttggggaaatgattataggtgtagggaacagcaggggcaaagtccttggatcggagtgtgcttggcaagtttaaagatgagcaaacatgaatgaggggtagagtggcagggattatggtggaggagaggcagaaggagcagaacatgcaacatgctggatgctgctgtaggccctcataagggactgactattgagccataaagccactcgatttcaggcttggcattcatgctctagcaccagaagtgtaatgctgggtggtctatgggctctgcatttaggctggggactaagatgtgacatttctggaccttggatgattgtcaaaggatgggaggttggttctgggttcagagaatggggaagtacattgcccattaagaattttaagagatctaagtgtgaccacaattgatgattttattatcttcacttcagtgataaaattcttcaccctcctcattccataatattctgctgctttcacctgaagttcgccaggtatgattaaacattgagtaattcagaccaaagcttccagatatctagtaacaatatacactagtcaaaaaacaagatcacacacacagacacacacacacacacacacacagacacacacacacactctttagtatatttggcaaggagaaatcattgagtgcatgaatttataatgggattgtatattttcaatcaaagatcttacatgaaaaatgttcaatcattaagataagggagacatttatgttatgtggtacccaagatatgccagtaaggttttttaaaatacactttattcatttgttcaaaagccattttgggtggtggaggcttactctgtgctactgaagacataatgaagatcaggagataccctggcagccgagagcagtggtgcatgcctgtaatcccagctactcaggaggttgaggtggcaggattgcttgagcctgtgggttggagaccaacctgggcaacacagcaagaccctgtctcaaaaaaataagtgggaaaaaaagacagagatgtccttgcaacaaaccagaaagtgaggtataactattctaattttacaaacaaggtaactgaggcacagaggagttcagcctgtgttcggagtcacacagctggtaacatgaagttgaaacacaaatgtaacttttttctacaccttgtctttttaaaaccaacaacatctttcagacacttgcacactttttttcagataattggtgtatgtaaaggatttcacttcacatggactatttggtagatatataacatcttagatatagccaatatcttgtataggaacaatgtttgtatgaagtaaagaaaaacaataggataatcaatgcaaggtagaaagtgatagcacacttctgtgattaatactaggataactggtaaagagtatatgctattttgtattactatttccataacttccaatcatgcacatggctgcttctctacaactctacaaagacagtatctaacacactgtcatacaccactgcttcctatcttgttaaaatgccaattctgacgcaggtctggtgtgggacctgagattctgcatttctaacagactccagggatgcagatgtcattgctctgtgctcttaaatgtggagtttaaggctattacagtcatttccggcaccaaccaaaacactgtgtcttggcccccacggctactggtggtcacttttgcaagaatgtttcctgggagacctagtagagcagcttacaggagttcacaaagacacaaaatgatggtaggaaggaataaagaggagaagtaaaagtgttgcaatggattctgtacctcaatcctgaagaaaccacagatcagtcacttccttcttgttcaagtgtgtcaagtgtgtcaagtgtgtcagcctgatttggcacagctgacttgatgaagcatgatctcacacagcaaagctgttgatcaccttgaagaatatgtactttgctccttggtgtaacctaaattttacctcgctaaaacaaaacaaaaagaatctaatattctactcatattattcattctggctggatgctaaagttaatttccttaagtgcttcagatactatattaaaactatccttttatcaaatattttaatataaagcttttgaaaacatgcaagagaatttcttcattagagccttctccaattttaatgagcacacaaatcaccttaaaatcttattaaaaatataaattttgactcagtgagtctgggatagggattgaaattttccttttcttaaaagatcttagagaaggtggatacagcatccttggagcactctgaatagacgggccttggaatatcttatcttcacttgtattaggatggcttttttgtgtgtgtgatgttcaaaatgatgaggaagctatatgtttacatatcaccagaagcttaaaatgatggaaaggaggctcccaccccatcatataggccattgatcaaagattctgcagtcacactatttccttaccatgatggattattcaaacaccagctgtaggaaaaggatttttttcaggaaactgatggtccattgtagtttttctgaaatcaggctgtacttgaggattactcagcgggttccaaagagtacagacatttaagatccaccccagaccaactaaatcagaatctctgggcatgaatctaatgagtagtctctagaccagcagcacctgcaagcttatgagccatacagaatcgcaggcccctccagatctactgaagtacagcttgaaaagatccccaagcaattccaacgcatgttcaattttgagagatgttgctaactgggaggcaaagctgtagagttgccgcagcaacttaattgtaaggtattaaaagtctcctttcctatctaatcgtttggatgtctgccaggtattaggaccaaaggaagacgggcagacataagaacccatccaatggtggttacattgattatatccttcctgaggcatctgaaatagtataaaataataaggagagaacaccaaaaatgtatcaacttccatgtaactagtgtgtattagcccatttttgctttgttgtaaaagaatatctgaaatttagaaatttagtaatttagaaagaaaagaggtttatttagttcgtggttctgcaggctgtacaagcttggcaccagcatctggtgaagcctcaggaagctttcactcatggcagaaggcgaatagggagcaggtgtgtcacatagcaagagaggaagcaaaggagtggggaggatgtgccaggctcatttaaagaaccagctctcgcatgaactaattgtgcaagaactcactcatcaccagggcgatggcgccaagacagtcatgaaagatttgcacccataatccaagcagctcccactaggccccatctccaatactgggaataacatttcggcttaacgtttggatgggacacacatccaaaccacatcttagtgctttacatagactgttccatctatctctcctctttgtcatgggttttggttgactttctcccagaaagtcctccctgcttgtttctggctttaaatctattgagtaaaatttatctgaaggaaatttaatcaataattcaaaacaggaatagattattcatagggagagctgtgctcacagttttgttaatttgcagtggtagcattctttatcactggctgaaactcaagtaaaggagtgaaagatcaagtatttgttgagaaactattttgtgcctagcatcatgctaaggattatggtgacaaccgcaaaaggttagtttcatggcacttgttggagatgcatgtatttaacttgcaaatagtatacacaactcgtgtgttattaagttatgaaatattgaaaaagcataacatgggagtttaataatggaacacagacagactgagcagaaaaaaaaaattagtgaagggaggtgtcattttgaatttaggcttcacagagccaacagaacttgagtagatttaagatgtggacattccattgagagaaaacagcttcaacaaaagcaaaatatataaatatacatatataaataacacacagatgacaggaaacaaataataatgagagcttacccttaaacatgcagcactattttatgttttgcatttttaattttgggcatagaatttcatgtatgttggggaaactgtagaaattcttcttattctaattaaggaaggtagctttgaaaacaagcatattttaaatagttaaaattttcattattttttcctcaaaattatagattgtggtgcttttttgtaatttttgctaacttcaaaatgtaaagttaaaggttttatgaaatatcaattctgaaaaaaattttctgctactaatgatctaaaaactgctatgttaagcaggctcttttcatagattaaaaatgctcaaaattactttgatgtaaacttcattcattatacatgtaaaaagcttggtttacatggcttataagtcagttttacagtctggctgttaagcctaattctttagataattactatgtgaaattttcgttgtcattaattcttcattgtggcaaactggcatgagtattctctattatggagtaataatattaataagaagtgcacatattcaaaataatgtagaattatatgcactataatttacatatttgtttaatgtcttattttttattatcaactttgcttgtttatttgttttatgtcacctgctgtagaatgctaattggtaacaaattatagcattatagaataggtgcaagccatcaaagtgtacatttttatgtaaatattttatttttattatagaatgagtaacctaaagataaatgcagtgcattctcagcaataagataatgctgaaatacatttcagaagatacaatatttttaaacctgacaggaaattataaaacattagcttacatgaaataagtttcattctatatgagctttaatactgcaagatctatgtctattaactgacaatggaaagttttgtgaggaaaatggttgtatgctatatctttgcttccactaacaggaaacattacagagtcacaattcttaatagaccgcaggctcctttacaacttagccatctatattactcacttttatgtccctagcattggtgatagatggtgttatttattcacaattcttttgctttccatctttgccatgagtgtaagtggagttgacaatctactgcattgacttggccctgtgacttgctttagctagtcaaatgttagtggatgtaatgactttacatgtgcttgtgtggtatgactccttctcttgcatttctgccctttactatgagaaaaatatcttttaggtagttgacgatttcgaaatgaaaaggatatgaagatcagaacccaacctgtagcataacacaaatctatatgcacaaagcacgttccatgcagtcatgtcttagttctgggatttctaggtatgggatttccttgagctgagcactacatgtaatagtgatggtgaactatctaggtatcggtttctaaaggttttctcagtagtgggacagtagctgagaaataaaggagaaattggctaggccaggagacttctccatctctagggtcgccaggtaatagttcagattacttcagagatttaaaggtgcagcattagaacatggttttccaggttagcagggtcaggcagttaccagaagattctgcaagcatgacttggtgcctgagtgggtggcgagccaggggtccctgtccaatccccaagctgaacagagaataaaatccggattatgattaagctcatatccaccaccacaaaatggagagaaaaacaacagatttggttaacacccagtgttcaaggaatgagaaaagggataggaagcaaacttgaagcattgaaaaaatatgtcaggtcctgaaactggggggaggagaagtgggaaggagatgttctgaagagcgtcactgagaaaggcatatttatacctgaataagttctctccaatctgcctgcaatttttagctagtttgcctagtgtagccagattacagcctttgggtgtgttctgtgtcaccaatgaggagggctctgtaactgttgatgattgccatagaagggtgggtttcctgtcaagtcctccaggtactatccagatgctcccccaggatctgacagaggctggactaagggagccttctgaagaatagagtagcacacagcttgagaactgcagtgtggactgaacttgaagctcagctacatggtgttataagcagacttacaaaactacctctcagtttgggcaactgaaactgaaagtttactattgaatatagacaaattttggccaggcgctgtggctcatgcccagcactttgggaggctgaggcgggctgatcacctgagctcaggagttggagacaagcctggccaatatggcgaaacctggtctttaccaaaaatacaaaaattagctgggcgtggtggtgcgtacctgtagtcccacgtactggggaggctggggccagagaataagttgaatcggggaggcaaaggttgcagtgagccaagagcgcaccactgcactccagcttggagtagacagagcaagacttaatccccctaccccccaccctcccaaaaaagaaaaagaaacatgtaaaatacattttcatttaaaaagttaaattgtagtatattcacttttagtaataaattttttataatatgtcattaccaggcagacaaaaaaaacttcagatattttctttcaaagtgccttgagtgccttctgatagaactgctaacgagcaaaactagtactagttaaatagcactaatttgataatactaattattgtgaattgtttggatgacttctgatacatatattttactttgaaggggctttttctaggaatattgatatttaatacctgttatatcttctatttgtaaatgattattaagttggctacttgctctgcagagtattaggaatttcagtttttactggttggtggttgcatgtagttttgccaaacagaatgcttaataaacattttaagcttgttctgccttggctgtatattttagttcattttttgtaaattttctcaaaattaattgtaggctagcttacctataatagtccttaattaccattttgggggggaattcttttgtatagtaattgttctcccccaactagagtttatgtgccttctctgtccttctctgtccttcacctgaataatataatgctgaccatcatggagtaagcactgaacttataaatcatttgaattggttttttgatctgaaattcacagctgatgaaagcagttgaaagtcgatgttttctgtgagtcatgattttttttttccccaagctggagttgaaatctacttgaatatctctctcctatgacaaaggcaaaattaagtatcatgataactttcaggattcgaataaaataatcacttaatagtgatgtgaattttcatgaacattcgcagcttgaagaattattttagtatgccatgtatttatagtttaataaaacatatgtttctctatagttcaatttattttgtgcttgaaggaattttttttttttttttttttttttttttttgagagggagtctcgctctgtcgccaggctggagtgaagtggcgtgatctcggctcactgcaacctctgcctctcgggttcaagccattctcctacctcagcctcccaagtaactgagattacaggcacataccagcacgtccaactaatttttgtatttttagtagagacggggtttcaccacgttgggcaggatggtctagatctcttgatcttgtgatccactcacctcggcctcccaaagtggtgggattataggtgtgagccaccgtgcccagccagaaattatttttaaaactgtggttttgtattcccaggataaaatgtgtatcttttgtacagcttcacaaattagtatgtccatttacctatagcagtgcataaaaggatatttctttaaagatctatttgtataacattctatagtcccctctttattgaaagtactaatagcaatatttctaaaattatttaattttccagtgaatgccaaagagtcccaattatgggaaaatgtgttccattttggaaaatgctacatgcagttctcattttcactcagaaaaataaaaggcaatttaattacaaaggacgcaattttatagattggaaaaatatagaaatccagactgcttgccaagtggagtgagactgtgtgtaataaagtagattttgaaaacttatgctcaaaacacaatcaaaaagtcacagaatgtgagggtattatggatggcaaagagatatttggcaaatgtaagcagggcaggcagtccttcattttttttttttaacctctttttctaaatgccctctgctgaagtgggatagttatttagaggtaaggaaatgatggtgggaaaaaatgtgggagacatttttctctccaagtgcctgaaatcttgacattgttctctcgatcgatggaaataatcaaaaaggagaaggccatagccctggttaattaaccagctcactatttaagagcacaattctccaaaacagccatttatttctatctaataaacattaatctcaaataaataaaaacatattctctctctaattctattgtaagcaccttaagacaaaacctgagtcttctgttttgtcctaacaatggtgcaatgtgccctctagagaagacccttcctaagtgtgattgactgggatgggcttagctgttctacctttttctaaaggtggcactcccacataccttataaatgcaggtctagtttcatcattccattaatcacatgctgacatatcagcttcaattatttaaatcaaatatttacagttaacattagttatatgaagtcggtcctcagaaatcactgtatggaacacacttttatagttgacattgtttaacaatgtccttctaaatgttggccaagtaatttgcctgaagagcccttctctgcctgaagccataagtacttgaacagacagttttttggggagatcttcctagttaaaaatattgagctaatatctaaacttatagataacttcgggacatttgatttgagttaaggttagaacaatgctgcgtaattctggccacatatataattaatttaaattcttctagattaaaaaaaatgttgcagaatgctacagagctgcaaatgaagactagtatcctgttaaaaccatttgatctttaaactggcttgcttcatttcataatggatcgaagacaatggacacaaagtatataggcagtaaaataatgataaaataaatgttggtactctaaaatagaaataaattagaaaattaagaacaaggaaaacaaaacacaaatgcacacacatagcagctaagctggctcatacctcagggcctttggacctgttgttccctattcttggacccgttgcttccttagatctttggttttgttttactttttgagaaggaattttgctcttgttgcccaggctagaccataatggcacgatcttggctcaccacaacctcagcctcacgggttcaaacaattcttctgcctcagcctcccgagtagctgggatcataggcatgcgccaccatgcccagctaattttgtatttttagtagagacagggtttctccatgttggtcaggctggtctcgaactcccaacctcaagtgatctgcccaccttggcctcccaaagtgctgggattataggcatgagccactacacccggccaccttctcagatcttttgctagctgctgcttcttcttcttctttttttttttttttaaatggagtctccctctgtcgtccaggctggaatgcagtggtgtgatcttggcttacagcaacctccacctcctgggttcaagtgttctcctgcctcagcctcccaagtagctgggactacaggcgccccctcaccatgcccagataattttttcatttttagtagagacagggtttcaccgtgttggtcaggctgttctcgaactcctgacctcaagtgatcctcccgaagtgctgggattacaggcatgagccaccggcctgctagcttcttctttcttgtcatgtgtctcttttgagatatcactcttccagagatgctctccttgaccaccttgtctgaactatccttatagtccccttgtgtcatctccttttgctttcttttcttcagatcatttatcaaaatcaagttgtttcttgttcacttccatgtgtaagtattgttgtctgtctaccccaattcaaatagaaactccaggagagtttgctcactgctatatcccccagttgtgcatgtgggtaccaggtgacactttctaagtagtttaaagtgagtacatgttcttaggaacttgctatgtggcctgaagctttctagaactcaaaatgaagagagagaaattagaaaggcagatgcttaccactgctccccagggaataataatttgaaaaccagcacttaattataatagacttgtattgccaggaaccccatccagtgggtactgagctggtacagtgagaaaactgtcaaacagaactttgtacaggagatactcttattgtggtccaaatctggagggttctattagatgaagttcatccaaacatagaacttagattaagggagtagatgtatactccacagccaatccttcacaaaactcatttgtctccattgggttttttataagctctggaaaacaaacaaacaaaagagatatttaataagttatctatttttttccagagtttcccttgttctcgtgctgatgattaactttaactcttcaaatcaattgtaagctgcctaaaggcagaaaagataatgtatttaaatatgtcttcttattcttaggacagaagaaggtccctatacatggcagatgttcattaaggatcagggtttagtgatgttaatgctattatataggttcattagtcatataaaagttcattatgtgccaggcactttcaaggcaagttctgagaaacaacattaatgactgggcacagaatctcagactagaggacctcatctggtgaacttgggcatgaatgagcacagcaaattagtggcagagcctagggcttattctgctaataggagcaattctaatgttggcatgcactcacacagggaaatgtgtgatatatgtttccatcacatagggaaagcattaaaaatctacatgcttggactttactcctaaatcagagatttggggtctacagaggtatggaaaccctccctcaatcttggagggtgtattagtctgttctcacgctgctataaacaactgcctgagactaggtaatttataaaggaaagcagtttaattgactcacagttccacagggctggagaggcctcaggaaacttacaatcgtggtggaaggggaagtaaacacatccttcttcacatgataacaggaaggagaagaatgagtggggggaaaagccccttataaaaccatcagacctcaatgaacttactatcatgagaacagcagcatggtggtaaccgcccccatgatccaattacctccacggggtccctcccatgacacatggggattatgggaactacaatctagatgagatttgggtggggacatagccaaaccatatcagagggatacactgagatacaaggggataaagcagataaaaaggcaaactctagtcaattgaatttctcatatatctttcattctaacccgttcagatgtactaatttgtcacatgccatggttacttttccctttttagactttcaagttggaaaaagcttttttcagattcagaaagataaaatatcagccatgtattaaatgcattaaatgtttttctctcagctgcttttattccaaaatattttttttttttttttttttttttttagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctccaaaatattttcttaagggtcactgacaatcttgcaaggatgtaaatgacaagctgtatttgtttgttgacattatctatcaaagaggcttctaaacacttttgtgtttctgatgtgaataaaggaaatacaacattgaataataatccaggcaggttgcaggtggcataaggcttcagaactccaccatagaaatgaacgtgattggaaatgcagcaatcaacattttgacagaaaagtgaatgtttcaactgctttatgttcacaaattgtttctattttctttttgtattacaaaatgtaagcagtgtgagtttgtgtgtatatgtgtgtgtctatgtgtgtaaattcaaaggtttatcctgtaataagatagaatcagagatagactccttgctattctcaggttattttttccttgttcacatttttttacacttgagtaaaatacttctgcaagacatattggaatagttttgtgactaaatcctagaatttgcaaaatagtgaatcacaatataatgtttcctttggatactattttggccatacttggttggctttctggaagtatgaagtggaggtttcccagtgacacctgtagcagtgcttctcagggacatagaaagacaccaaattctcttatactgggattcatccaggtgaccagcatttgctttgcaacaatcatctgtggtgattgctcaagtgtagaagggttttcaagaactccatcatggagttttgtagtggcagattagctgtcctctacttctcctggagtggctgggattcttcaacaccaaaagaggcattgagtctttcttaattggcttcagtcagagagggtggggatatgtgaaacttctcagtctgatctgttcttcagctcctcagaaaagttctacagctactccagatctgtttcgataaaggggcggtggtgcaatgaaattattcataacagcccactttagaggtctgcctgaaaaaggtggagtatttttaatagtagatgtgttgagtgtcttatccatatcctttttaccgaggctggtgcacccagcccttgagatgccgagtacattatgttgcattcctcccaggggtggcacacaggcaatgactgactcgtatgagggtgtaaacgtgcagctcccttgcctctaggtgggatgtgggatctatgccagcactgtccaggataaagtcattaaatctagaaagtttacatggattcaatgaattcctctattcgaagtcttactatgtttaatagcaaaacaaaatagttacctaatgcagttcaatacattttgatatgttgttatgatgaagaaacatgaaaattctaaaaatgcccatttgttgattacagagcaattaagttttaaatgattcaagtgagtctaggaatgtaaatcttaaccattgcagaagtgaattaaacatgtttagagaaatcacaattagtcaaaaaaggtaaggtagattattctaccttaccacagggctcaacagggaactccacagggatcaagctcatctagatgccaaatctttgccagctccttcctctgccccatcctacatctctcactcccttacaggtttcccctaaatgcattcccttaataaatcatgggacaattattttcatctcagcctctgcttctgggaaacccagctaacaatatcgaatatggaaacatcaaacccctgaatataaccagggctgcctcttacttaaagactcatgcgtgaaatgacctgaagtgcttagaataatctaccttaccttttttgactaattgagatttctctaaacatgtttaattcacttctgcaatggttaagatttacattcctagactcattcgaatcatttaaaacttaattgctctgtaatcaacaaatgggcatttttagaattttcatgtttcttcatcataacatcatatcaaagtgtattgaactgcattaggtaactattttgttttgctattaaacatagtaagacttcaaatagaggaattcattgaatccacttaaattttctagatttaatgactttatcctggacagtgctggcatagagataaacatttaattgatagcttattttatgaaaaatataacatggcaaaggtttacagttctgtttaatctcagcagtggcatgttaagaagacaaacggagattaggaaacattttttctaaataaaatacctcattttatgtggtactgataagcagtatttacaacatgaaataaattattcctcgtatacttattgaataccttaaaagtatgtgctaggagctgggaacccagagtaaaatataggtcttgttcctaagaggatacgtctattatggggagatgaaaggggggttaggggcaagcacagacttgtaaataatctatgagtaaacgtctatacaccagatttgcctagaggatggtgtatttgcgtggcaggacattgggtacagctttagcagtgaaaagagcaaagtgcaaagagaacctagaagaatgcaccactgggagctgactattattattttcattaaaggtgagtattgcataactaaaatatttcagctcaatgacctagttaaataaatcgttgtaataaataaaaatgtcttcctgtctttatgtaactgctcattttgtgaaaagcataacttggctgcacaccttttttccgccttcttctgataaattcttggagtccaaaaggtatctttcatttagtagatttttcaaaatgtttatattcatagcaagttctggtttgggtcaagcaggtggtagaaatcataactgcctccagaaatcaggagggcccacgcagtacaggacttggcaggccctggtggcctaaggtcagccagagtgcagatgcaatgcagcaactatagtaccagcattattctagaaagttcttacttcttggaagtactgacttgtaagtaaaagagcattttaacttgatcatattcactctggagtcttctacatctgaatctaaaggggaactgtattcttcctgcaaatttgggattctctaaataaagttccagggcaccagaggttccactgggttagacctttgatttattttaatgaagagcccttcttctttgttgatgtctgacagcacattcacagtgatccagtcatttttggggtaagatagaaggaatccaggtagaatacaatataaaaatgtctcaaactaggcaagagaagagtctagtcctgtggtaggtcatatttgtcaaaatatttgctaccctcttagctgttcatcctcactgagcctctctcttcaaaagattatccttcatatcccaacactgtgaggcttgagcacgtgctttgctttgaacaatgaaatacaagggaagcaatgtaatccatttctgagccaaaaaaattaagagccattgagtgattctgccaggcagtctcctgggtcatctccagaatctggagtgcagagccacagtgacccataatggacattgtgtaagcaagaaataagtatttgttattcataaattaccagtgttttgggcttgttactgcaacattgacccattggtagaaacaactcagcttctggttaatagggtattattttaaaatccgctatgaacattcatgtatagtaagtctttgtggatggacacaggctttctatttctcatagataaattttgtaagcaaatggcaaactgtttacaaagtggttctatgatttcactgtcccactagcagtgtatgagactttcagttgctccactttcttactaacactttgtatgacagcatctttttaattttagtcattctaatacatgggtagtgatattgcagtatggttttaatttgtatttccctaatgactaatgatgtgaaacaccttttctagtgcttatttgccatcccagtttcttatttggtaaagcgtctgtttatgctgattttaggagaatagtttcttttcttattttcagattttgagagttgttggctcatatatataggcatatatatatatatatgtacacatatctatatgtacacatatatatgtgtacatatatattagcatatatgtgtgtgtgtttttcttaatacaaatcctttctttagatatatgatttttcaaatattttctccaagtctgtggcatgtcttttcattcttataacaccgtctttcaaacagcataaatattttacttttataaaatctagttatcaatttgttcttttatggattttggtgtttgtgtcatatatatatataaatatttgcctaactcaaatattttatcctcttttttaataatttattttttagtttaggttttatgcttaggtcttataaaaaatattgagtcattccatctatgagcatggtatatctcttcatttacttagtttttaaatttctttcagtattgctttttagttttcagtgtataaatctttcatatttcttgcacttaggaaggcattcagctccttgatctatgagtttaaatttattctcaccaaatttgaacgtttttcagacattacgttctcaaatatttttctgcctctccccctctttcaaggactctaatgacttttacattagaccacttttctgggaacaagttccagactggaaaagtggtctaatgtaaacgttgtctaatgttccactgggaacaagtactgtgtgtagtgctgaccattgttaccccgaaatcttgaaatcttgtgggtagtctttcctcaaccttgggaagtcagtactcaagtgaatactcactgggatcctgtacagatcttcagagttattgctctctgaagctgttttccaatattcttttctgtgaactcaaattgccttaatcttcctggattctcagcaatatctcctcaactcagaatccctgggttctcctttcctgtaccaaggattgccaattctcacaagacaataagttgggttacgataggactcatctcatttgtttacctgcaccccaaggatcactgtcctttgttacctgacattctgtgtcttaaaaacggttgttttgtatgttttggctgttttttgtttgttcttttttttgtttttttgttttggttgttgtttcaggttgttgaggataattcttatccctgttaatccattttgacagtaagtagaaataacaaaattcacttataaattagtatatatattcttggttcaaggagtaatgggctaaagtaattttctccaaattgtgttatttgtcttggccacatcattaactagcaaacctactcagttttaataaatggttgctttgccaaccattttttttttttcaaccagcccctctctgttttaaaaagaaaattaagctacccactttctgtttacttacatagaattccactatttaggcttttgaaaatagcccttctgacttgtaaataacttatttgactctgtgtgtgagtcactcacttttatgtagcttgcattgttaactgcatcttccaaattgaattctggtaatgctgataaactgttcaaataggtcttttgtatgtttgcatcagagaaagttttatgggtatgtttggtataattaagtgctttttctctgtgtgtgtgtgtttgtgtgtgtgtgttttaaataacatggcataatgctaaataatccaagcaggaataatttgtttttattaagtcagattgccttctgtacatatgttggggagtaatttagtaggttatagtttcagtgtaataaaaaatggtggggttggggctggtggaaatgatgcctttcttctgtgcctaagtgataatgtaaacataagtcaggaactaagagtatctgtctgggaatatataataggatcaaacctaagcacaaatattcccagaggtagatttttcttatgctgatttagttatgaactggtaaatttgttttcatgactcaatttctacaaagcaaactttattatatatatatatgtgtgtgtgtgtgtgtgtgtgtgtgcatttttaatgtatgttcatttttttctgttgattttttaaattatgttcattacataagttcctaactgatagcattctcatcgtaaacaggtcaaactgttcagataaaataaaattcccttatatcaccttcttatctccagctgatttctttcccagaaggtaatcactgaaatgagcttggtgtgggcacctctcaatggggaccccaagatccccttctgtaacatacctgccacttttgaggtttgaatactcatgggctgctctccccttttcaaatgcctatccctgcaccatgattttctgttttagtcagtcctatatgtcatctatctttcactgatttctctcatttctggtcatcaagggcacccctttttattctatcatttggctgaaaaagtggcaaacatgaacactgacttaaaaaaaatactccaaaaataatttgagtttagagcaaaagcaaatctatcattggttaaaattttttgtgtaggttgtataacaaatttaattttcatgaatttctaaggttgtgattttacatcatttgattttagctaatagtttaattttatggtaggtttcattagaggagataaaaggctttggtttgcttcgtgtctctggaaaatttattaaatctccatagttttcagaacctagcaaatggtaagcttgtttccattctaactttatgagatgctttgtttcttgtaaagtgaattttgagagtgctgtgtgctttagcatcactggaagctgaacctcaggtagtagcccttaccttggtgtatgagagtctgcatgagtgctgtgtgctatagcatcactggaagctgaacctcaggtagtagcccttaccttggtgtacgagagtctgcatgagtgctgtgtgctatagcatcactggaagctgaacctcaggtagtagcccttaccttggtgtacgagagtctgcatgagtgctgtgtgctatagcatcactggaagccgaacctcaggtagtagcccttaccttggtgtatgagagtctgcatgagtgctgtgtgctatagcatcactggaagccgaacctcaggtagtagtccttaccttggtgtatgagagtctgcatgagtgctgtgtgctatagcatcactggaagctgaacctcaggtagtagcccttaccttggtgtatgagagtctgcatgagtgctgtgtgctttagcatcattggaaggtgaacctcaggtagcagtccttaccttggtgtatgagagtctgcatttccaccttcgaagattctgaaaaggaattaaaaagtagtgtcttgaatattggataaacttaagattacaagaaaacattctggaacatgactttcctcccgcttttgaagtttttcacttctttttctctagatctttttatagatgttcagaggcattttaggttgaattattatgtgtttaaggaattctaagataataattaccaggaaattaactcaaattacataatcatgtattcgagataagatacgttgtattgttgtggtaggcaaaaatgccatgacccagcagaatattttaaaattagcaatgtattttaaatacttgaacgctctctttcatttcagaagctagcctgcacttaagtcagaaaacaaaagctaactgccacagtgaatgaaatactttaggaagagaggagagaaaaacaggcttttctcattctgtaattctgagtgttctttaaatgtgtcagaatatttgctttgtccattttctgtgtcaatttctacttctttcttcttgctcagaaagtttcataatgctccctctaacataattaagtcatttatctttcctccctctcttgctgtttacttccttgcttccttccttctctaccacttctagtttacatagtaagggacttctttggcttttgggtagtaatttaagctccaaatttcagtttcatgttatgtaaaacacaaatgatacttaccgtatttcacatggttgttatgttgaggactgagccgcattatgtgagaaggctaaacatcatgtccttaatactgaatatatgttcttttccccttttccccttttctttcttctttgctgtcccactctgagactcctttcttccaactctgagatgtagttttaaatcttttatgaaaaaaaaaaaccttatggagaaagggagaagaggtggattcatgagcaggaggagaatgataactgaacttttggcatcagcatttactatggctagtcaccattttaagcctgtcactaaatgaagttatattcatttagtctcattacaattctatgaaagtgctatcattatgtctattttatacttaaggaagcaaagtcttagattaaggcaagatcacatagccagtaagtaatggggtcaaaatgcagaccttaacattttggcttcagactctgtactttgagttcagccggtgtttgtggactttgccttaccttcctttctttttttttttttttttttttttttttgagacggagtctcgctgtgtcgcccaggatggggtgcagtggtgccatctcggctcactgaaagctccacctcccgggttcacgccattctcctgcctcagcttcctgagtagctgggactacaggcgcccgccaccatggccggctaattttttgtatttttagtagagacggggtttcaccctgttagccaagatagtctggatctcctgacctcgtgatccgcctgccttggccttccgaagtgctgggattacaggcgtgagccaccgcgcctggccgatttaccttccttacttaaccaatcatgccactagcttgcactggcctcaatacccaacgtttttcctaccttagggaccttttcctaccgtggggcctttgtattctctattccatcctttctgcaatttttccagatctttccagctcagcaaaattgccatctctccacattgccttcttcactctattcaaagtaacgaagggtacttcccccaaagcaactgatgttcccgtggcttgctttattaatcacaataggacatgatcttctacattaggttttcctccatgttttctggcagcctctgaaggatatgagccataacagagcatagacattgcttttttctttgtagcttaatctccagtgcctagtatcattcccagcatataatatgtttaatgtgaactgaatgagaaaactaaatgagaggcttaattttatacagcagtgaaggtatgtcccagacttataatttaaggagaacttactctctagaaatgtggagtagctggacgtggtggctcaagcctgtaatccaagcacttcgggaggccgaggtgggtggatgacttgagcccagaagttcgagaccagcctcggcaacatggcaagaccccatctctgcaaaaaaaaaaaaaaaaaaaatacaaaaattagccaggcaggggatgcgcctgtagtcccagctactcaggagactgaggtgggaggatcacttgagcctgggagatggaggctgcattaagcagtgatcgcgccactgcgccccagagagagagggagatgcagggtaattgatttgtacctttactttgaaatgtttaataattagtgattttctcagtcctctctttttctcatgggcccctttagtaaatgctgatggacaagattcacaggccatactttaaagccattgatggaggtagattttcttcccagggtgcttttttggcatggagttggctaagaatgtccttaaaggccatcatacataggtggaaagtagaaatcagttcaaagaaagactggcagagcagatcataagtcaatacatgaatcaagttggcctgtatcctaccaagtacaatcttttgtttagtggtgtatctactaccacactctcaaactcctaatgatactttaaaattaaccttcatgctcatttttataataatgttgaaggtcaggcaagagataatatcctcactttacaggtggaggaactgagtcaaagaagtacaggacttgtataaagaaaagctagtctatatgatgtctctaaatcctgggtctgaactactttaacgatattaaaagcttgcttgacataaaattttaagactgttacgattagagtgaatgtcagtgatatatgtgtctaaggaatttgataaatatacatgagatgctctaatgaattcaattgcttggaagtgaaggggaaaatgcacaaatttttacttaggctcatgcttttcatgtagaaacaaacattgaaatttggaagtgaaaaatctacctcttatcttgggtatatatgctgcctatatatatgcatatagtaagatgtttaagtttttaaaattaactgcattgttgagtatttgaaatacacatctgttatttgttattgaactttaaaatgatatatgaggatttaggtaaatactgtctgtctaaaattaattttggaaagtaactcataagatgatattttcaatacagttttgccagcaattattaaatatgtttcgagaagaaaattgctattcaaattacccatctcatccttggcactttctaaaaaccagacaaatattttttagtttgtgaaggctgctcataacagttacaagctaattaattataaaagatttagccatgcatttgaccataaaatagattggttgtggctgctggattatagttttagatgattttatgatccatgtattgccttgacttactgatgatttaaatgattgtgtgtgggtgatttaaaaagcaataagattaataaaatatttattttgggtaaaggtacagaatatgttttgaataaataaagtatggaaaaggtatctaaattcctcatacatttttaaaatcagttaataaatagtaaacatgcaagaagctcattaactatagaaatttagcctattaattagggagtgttcatttttaaccactatgttcattttctagtctagtacataatatttttcacaagtcttcagaacctcatttttccttttatataataatgactctccaaatatctttttgtttcttggtcattatttatcttttaataagacaataaaaccaataataaaagtgtattcctatagccaatagccaagaatcaaaatatgcctttatgggtttttcttttcttttctttttgagatagagtcttgctctgttgccaggctggagtgcagtggcacgatctcagctcactgcaatcgctgcctcccaggataaagtgattcacctgccctagcctcccaagtaactggaattacaggcacgtgccaccacgcccgggtaattttttgtatttcagtaagatggagtttcaccatgttggccaagatggtctcgatctcctgacctcatgatctgcctgcctcggcctcccaaagttctgggattacaggcgtgagccaccacgcccgaccacctttatgttattttatttaaccttcaaataattatataaaattgatattatttctttactccaccaatgcttattgggcaactaacaactatgaacccttctgagaatttggggtacagtggcaaaataaagttgtcaaagggccctgtccccttggggatcacaatctcaaggcggcggggaacatccggaaataagatagttatagttggtgatgcattaccagagacatgtgatgccataatagtgactaacccaaggacagtgagttagcttttgttgcataaattacccccaaaatttagtggcttaagacaactctttgtttaggctcatgtttcggctatttgaaatttggggtaggcccagctagctgtttctgctgatgtacgtcagactaagttcagttagaggaacttataggagagctgtgaacttccagatgagtcgaagacaggctgagggtatcctcaactgagatggcttatttctgtgtcacatggtggtggtagggatcccaagtacagcacgggtcattagtaaagcagacgttctggccttcatttcattcttttgagtgtatgctgtataaaaattgaccaaattatccacaaatcttcctgtaccacttgtcaaggttgaaaacccaagaaaaaataagattctttctatcactggagtgatattactgagcttttcagagtctattctcatgccaagatgtatgtttgttaaattttgagccggatgtggttttcattcagaaagtatttgatgatgacttctcaagcaaggaataactataatagcttatgtgcttttgggatattttaggtaagggtgaaaataataattctgagaaacatacaagtattgcttttttcttcacattccctaattttcttcttttgtacattccacggaacaatgccttctcatatattcacctgacgtgttgaacatcaatataggattgaatgaagcaaaaccttatgtatgagttacactggagaaaatcaaataactatatatttttttctggcattagaaagtcagaaagatatacagaattagtgccaatgactgtatcagttgttcaatgaagagaagataaagaggtcatatagcagagaattgtatttgtatactcttgtctataaaatttagaacattttggttgttgtttaaatttatataagcttgttttattcttggtatatgtgccaatatctaccctttaaaatccatgccattcaggtagctcaaaggatatactcaactctgacatttgtaataagtgaataggctaacttgctgcaatttgataaaaacagaagcacacattaagttaaatatttgtggagatttgggtgtgattcacaaaacttttctctcattttatttttcattaattcattcaaccaatgcatactagaagtgtattatttgttaggcattgttttcggtgcagggaacactgataaataaacaggtaatgttactgctgcctttgagcttctagtctattaaacattagatggacaagtcagtctttctactttttagaaacaaccagcagataatatttgttaacaaaagtcatgatgtaaggaatttactaaaggaattcagaaaagattacatatttttctggttacataatataagaaatttactgaaagattatagaaaagattatgactaaactgtatccagtattttagtgatttgtttagcagattattaatttaggtaaaggtcattttgattggaaacatctatcaaatcagtccatgaggtaaaagaaagcaaaagaaagcagagtctaacaaaggagacagaacattttaataagagatacctttaaattatattttataccatacgaattggtctctttgtttgagaattcaaatattttacagccaataccacatacatttacattcggattctatatactcttctagtttctagttatatacagatatttcagataataagaaccaaatcttgcctcaaatgctaacatcgtggatgacaacatagagcctactgtaatccattatgatatgagcaatgatggtaggtttgacagctgcatagggatcacaggagaaactgtacctgagctgtacctgtatcaaacaactacataattttttctgtcattgggaagtcagaaagatatacagaatcagtgccatacctgagagttcaactgtgtgcaaatagctcacaccgtctctaagtgttttatttctataataagaaaggtaagatttaccaaactctttcttctttatttttattatacatcctttattagtgattactagcccatgctcaaatgttagcttgcctcgaatcaaatcctagagtcactcttaattatttttatggtattaggtaagtgatttcacctccctaagacatagtttcttcttccataatatgagatttatgaggaaggtcctaacttgtagtagggtggtcaggaggcttaagtgaaatcatagctaaaacagttaacaattcctgaaaccacacaagtacactggatatcctgactattggtacttgtattcatacttgcatttataatacgcatttctcagataccccaacagttcatatccagacacccccaatggatacacctgagactgataccaggtcatcatttttcgttctcatgctgccagctacacaagaggcacgcactgtggatccacagacgaaacagacagaggctatgttccattcaagacctggaacagatgatcccttttccacgacaaggaccaacctctgccaaaacaaatcacttggcacaatttctaactctaaattaatgtcttcacttatttgcttaataactccctccatcctcgctgtcagatcaggctaggagagactccattggatgagcagtagactgctcttccccaggtgcctagcacagtgcctgatgcaccacacgctctcagtgtgtgcttgttgaagaaacaaagacacagtctgcccttttcattgaaagcagtgccccaaggcagcgggtccaatccaggtcacctccattgtgccttcccatgagggcttgctcaaccctctcccacctcctgtggccacctctctagagaagcttcttccagcttgccagacagtctagcttggaatgctgaacagcatccctggtccttctgaattttctagctggggaagcaaaatgtcagtctatgattaatcccacacaataggtggtaagaaacataccgatgccatatcttggcctgaggcacaactcttctatggagttgagtttcctgtaaattcgtggctgttgattgttagtgtgcagtcttaaggccttaacatgtatttataaacagtcttctttttaaaagtgcaggagcagtgtatatagtatgcggtatgccactattttttttaaaaaagatatatcgcatatatatatatatatatatatatatatatatatatatatatatatatatatgactttttcttgcttgtattatccctatgttttattttattctccaaagttgatattgttttcttctaaggaatgcaattccaaaaaaacaaatattgaaaccaataaagacataaaatttatggttaatagcttcatttcatttgttaaatgtaattaacgtatctttttattactaagattatttaccattttaatgtatataatgactattgcattagattttatttttaaaatgctgttacgcaaacttaaaaccaaaattaccagtgttctatgggacagctctaaatacagtatagctattaaaaatatatattcttaaagtgtgctaggaagaaaaaacacttgacatgaactattctgacatttaaatcttctcttattcttgtcagcactgccacagcaaatgataaaggtggtattaatagccatataattttctgaaatttttgtaacattttttaactcacaaggcagctggacatgtttacagcttgaaatcttttattgcattatttgtaagatattaatatatggatatcatatatgaaggaaataaaatgcataattattttctggcacattgacttgcatttaattaaatagttttttcctacttaagttcatctatctatcgaacatttctatgttctagttattctttgaacaactgccttcttatagataagaaaattttcggtttgctgattggtaaattggtagttactcctccatttttggttcttgttagttttctaacactaggttcaaactcttgaagaaaatattttgttctgcatgcacctttgcagaattcttcgaaaatttgctggcagaatagttgtagaaaaccccaattacagataataattttgccattttcctgatgacccctagagaggaataaatttgcaaaattagtttaattttgttttactcctgtgtcttgtgctttctcatttcctttcctcaagttatagaaaatacataagcccagtacagattcagtcccctcttccactctactctggccagtcacctctcttcatcaatcctggggatgactaaagagaagtagggaatatatgatccttccactgaccagctatgtgcagggacatttggcaactgagttgacctttatctggacaatgatagaatgagaacccctcttagaggttaatgtgaagatcaaattagttaatagaagggaagacactttggaaagtgaaccacaaaggccaccagtaggagtagaatactaggaaatgatctttctaaatgccaatctggtcaagtgcttcctgcagcctgtctccaacaatacaaagtatccaagctccttagaatggcattcagatctctaaggatagctgatggcttcttggactgccctttgattcctaagagatactgcccatggtttttcctttcctcaaattcctggtaagacacctctgtcttccttctacacactattcaataccgtcttctctttgacatgaccttttccttccacctcttttcacttctctcttacttgcagggttaggagacacctgctatgtgagtgtatgtaaaccatacttcacagagcaagccttaaaaaaataccagctttcatcctttttccttcccttcctattaaaccctatacagtcatatgtacaatgtattgaataagtatggtgagaaaagaaagtgatatatttgtatttcttgtacagtcttctacaaatctctgaaattagacatgactgtgatttttttttaaaataagtggatgttaggatctgggctaatagggttgggggtctgagggagacttttcattgtatacattgatttgatcttttgaatttttaatcatgggaatatatttctcatgtcaatattaagtaacataaataaaaatttagtataaaattttaagtctagaaaagtcgaatgtaaaagtttcattcactcgcctaatatctaaattatgtgacttacaagcatatggtggagaaaagaatatggctcccattatcaatatttcctcccttccccttgtcctatttctcctccattactcagtagaacactctgacatccttagggttgaagcagaggtggagaggagagttaaggagcataaagattttacttgaaaggcattggtttaatcagtttttggcagctgagcttgacagaaaaacaatgtatttctcagtctggctatggtcccattgcagatcaagagggggctgtgctctgtgtcacctccactctaaggcccagtgacggagcctgcaccgtttctaatgtttccggttactgtggcagaaggaaaaagcatatgacgaatcacacactggctcttcaaatgtctgcccagaagtgacacagtccccttgagctataagttcctggtcaaaacaaacaacatggccacacctaacttcgaagtgggcagagacatgcagtgacccatgtatctaaaaatactaaaaataatggtaaatagcactgataaatattttctgaaaaatataaatcaagagtggaattccttttaatttttcatttagttatagtttgggctgtgagatggttgtgttacacatgaaattcacataattagaaaactataggtgagtatgctttaaccccctgccccaacttcctcctctttctttgttcttgttttcttcccctcctctttcgcttatattttcctctgacctcaccctaaaaacacagtttaacctacaaggtaccagaataccaaaccaaaccaaccaaacaaaaacaacaacaaaaattgggtgccctctggaatgtttggctccaaaaaaaatattgaaatctatagcaccactgaaatgtctaatattaccaatgtggcattaataaatggacagtcgtgctcttttgtagcttttctctctggaaggaagatattggatagtttttgttttttagagacaaggtcttactttgtcacacaggctgaagttcagtggaacgacattggcttattgcagcttgacctcctgggctcaagtaatccttctacctcaacctctagagtagctaggactacatcaccaagccgggctacttattttgaaagttttggtagagatgggctcttgctatgttgtccaggatggtctcaaactcctggcctcagcaatcctcctggaggccttgatatccaaaagtgctgggattacatgtgtgagcccctgtacctagccagatagttcttactgtgacaaggggacaagaagccttttctcagggaggaccaatggcaattctttttaccccacactctcaacaatgattcttccaggaccatttccatttcttcagtctattgcctcctttctcattgagtggcgagcactcttgagacccagcagtttgctctatctcaacccactgtgacaaataggtaaacataggctgggatgtaaggaatggataatggatactggttttagttaccccaccagagacattttaagttaatgcaattgatgagtaaagcaacatgtatggttctctctcaccaggagaggaaaggaatagaaagaatagagaaatatagcctactagtcagtttggtgtttgttccaaaataaaccctaaaatctttgcagaggcaaattgcttattactgtaccgtcaagtgaaatgctccatgaaatatgttctgttttgctagacgtgtttggacaatttcctgaaactgttaaactgctcaatggtattaactcttctccaacaggccattagaaattttagcatttaaaagagagaagagggaaaatacagttggctcagttgagaagcaatctcttggagctggtaattatgtcacatctgtttggagaaacaagttggcctttaagagagtgaatggggtaacaatttaattaaagatgggttagattgcatggaaattacttgctattattattggaggaatctatcaaaatggaccactgggaaagcactgttttcactgtttcttgaggaaattgttcttggcataacagtagaatttaacttccttttctgaatgtaagtttcagccctgctgtatggaggagtgagatcattgcatagggtctgtgcacttccccagtttctgttttcttcctttcttactcagatgctgttcttttataactttgtttaacataacacttgagccaacatggtatgatctggtttgtggtcgctttctttggtttgcaagaattttggaaggtattatttgcgtttaaaacaaactatttgcctattggccatctggccagtaattccagcatagaattctaagctctgtgaacttgaacctaactcaattgaacttgctaatctaataataagtctattgccccacctcaatattaccagtgggatggtagaaggttttataagcacctcagtttttttctcagtgtgaaatcatctatatcaatctttttggtgctgtaccctatactgaacatggaaattccaccatttaacgtgctaaacagctagcaaagaactattccatagatattgaacttgaaaactatacattttaataagccaaagtacatcaggaaaaatcagagctttaatgaagctacaattgtagatatgttaaaaaagacaccaagttcattgtaaatgaatttccatttgttggttgattatttatagggtgaattgccaaaaaagatagagttaaataatcagtccatctaactgaccttaactaatgtaaaattactttctgtaagcccaggttagttataaaaagattgaccctttaccgcagtttatctgatataatctcagattaattaatcttgattagtttgttatttgcctcagatttttaattttaaaaggatattattggaattgtactttttaaaatagttttaataaaaatattacataggtctattcatataataaaactatagtagaaccttgaacaaaatagaggtgaggagagctgactctttacatagtcaaaaatccacttataactcttgactccctaaaaacttaatgactaagagcctactgttgaccaggagccttaccaataacatagtcaattaacacatattttgtatgctatgtattgtatactgtattcttacaataaagtaaggtagagaaaataaaatgctactaagaaaattgcaaggaagagaaaatatatttactattagttaagtggaagtggatcatcataaaggtcttcatcctgtttgtcatcacgttgagtaggccatggaggagggggcatgggaggacttggtcttactgtctcagggatggcaaaggcagaagaaaatcagaatataagttaatcttgcaactcaaactcatgattttcaaggatcaactgtaatttcttagtaataaaccctttagtctcacaagtgtcatgatttgaacaacaaattgtatggtcacgttggtcaccctaggtagaaatttgctgatttcagcaaattggaagttactgcatgattgtcaggatctgagaaagcaactgagaagtaatagttacaataagttacaaaccttttaggacggtgaacattttaaggcgtatgttttctccatgtgtcacaaccaacagtaaacaaagatcaaaatcatggtagaaaagcaggatttaatggacatcagagaaattgcagatctggaatacaaggcaataaaaatttacaacaaggaagtggtaagccagagagagctgcttcatggtggtaggcccagggggattggagagagtggtgccagaaagttggatagaaaagttaatgcaacaattataaagaagataagaacgtagtatttgaaaataaatattttaacaagataaatataatacaaaaaatggaataagaaaaatacattattatcgaatattctgtattgagttttggaagtttatgtgtctccttttctaatgccatgattttgcaatgcattattgttagtaatttttaggtctgcctatccaaattaggcttttgcagcatctaacaccctccaccctagctcacttggtgggtgagcctccaatgactacacccaaggaggatttaacacagggattttatgacttgcaacaagtcaggaggacatggggttggggtagttcagcagtgcctgtctgaacaaaggtgaaaattgggcttttattgggctgatcaagggggagtaaaggcagccaggagcagtcgcctgtcatgcttctacctatattgcatgtatagaaaagggaaaataaactccttcctgggcagggttttagtatgctaaggaggggagttattcaacttcaatccaactcaagcatcagcattgctgcgtccatcccagttttgttttgctggggctgaacttcttcctataactttttgaaacaacaagaactcaaggtgtgacagttacaagtgggccctttttcacagtgtgtacctaaacacgtgaggaccctggattacagaatgacagactcgaagtgactcaagttccggttgttcatctttagatggtaaagatggctgtacgtactatccttgcttatttccaatctattgtttaaactcttgtatatgtaataccgcagaggctagagatacaacctttgaccaaatgagtgaattcaagtaatccattactaatgtgatctggaaacaaacatggtgttgaatgtgcatatgtcagttctatgttgggagttcactataagtaggagttctctaaaagcacttccacgtagaatgcaatgattatttaaaaataagtaataaaaatgtgcaaatttaaaacatgtatatgctttgaattatatatatatatatgaattatattttactatgtatacaatgaaaactgaacagtaacctcagctattgtataaaagtgaaaccaacaaaagattttttggggaggaagattattttactactgacataaagaattgccaggaaacaatgacagcaaacacaaccaacttttagttgccatttaagaaaaattctttcagataatgcattcctttattacttgaacggagggcagaccactccgtccattctacccttggcacacatcacttcctaaactgtcttattgcttttaattgtatattttttcccttaatttcaattaaaatctataattcattagctgtcaaaacctgacctgtttgaagtagtagcaattcaacattaaacctcgactagtgttgaataatattttggggctttgtgttgtatgctacagagtgaccccccacaagttccttgcccatgtgtggctagacaatggaaatagttccgtgcttcaacatgttccccaaacacattccacaggagagcgcatccgagcatcaattcttgtaagacaactgggaaatgaagtcataatttgagctgaagcaaggaagattattaaatatattttccatgtgctttgaaaatatatgcaaagtaaagcaatcagtgcttgccactttgtttgtattctaaaagaaagctagttaaggtttttcatcaaactgtattcttctttaggcttataaagtaccatgaagaggaggtaaagagagagtggatatttcagtggctaaacccaaagttttttagcatttagactatggcaccctctagaaaagcaatttaaaatgtgaaaaaagagaggtcagttaaaaaatagattagatagataggtagatagatggataacaggtaggtagacagatgattgataaagagataggcagatcatagatagatagatagatagatagatagatagatagatagatagatagatagatagcatgaagatggttgaggtgactacaccctatgcttccttctgaagtttcgggaataattgttcattttccaagtgactgctcaatacaacattgctctgttaggtaatttaatgactggtgtaagtacaaaaaacattgccatctgctttgtttcttttggccttaattataatgttatcttcttttcagaggctatattgtgaaacacttattattcaccattatttctggcagtgattataatttatgaccaacagtgcagcactgaataatgtcttgattgattgactgattaatgtagattttgtaggtgataagggacaaaaagcctgagaagattttctggaaatgtaaaagtaattttattttctactatgtttgatgcccaaagatcactgtactgataattttagtgaataaagtgtcaactataacaaggagcttgtttattctatcaaccatgtgatttcaaaactggagcttgctttcacttttgaaattttccataagctaaatctaatcctctatatttacaacgaaattaattttctgagttatttattttaggataactctgatctttttcttttctttttctttttttttttttttttttaagatggagtttcactcttgttgcccagactggagtgcagtggcgcgatcttggctcactgcaacctctgcctcccaggttcaagcgattctcctgcctcagcctcccaagaagcagggattacaggcatgggccaccacgcccagctaattttttttttgtatttttagtagaggcgaggtttcgccatgttggccaggctggtttccaacccctgaccacaggtgatccgcccgcctcggcctcccaaagtgctgggattacaggcgtgagccaccgtgcccggcaaccctgatctttttcaaactgcaatttaaaatttactgatcacacagaactgaattgatttttaattgtcattctgaagaagtaattaaactttaattactacttctgaaagagagggtttttactaggactttttctgacaggacaataatttcattttttgcaatttttatttataattggcaaataatgattacatatgtttatggggtacaatgtgatgctatgtgtatatattgttgaatgattagatcaaactagttatcatatccatcacctcacacactaatcattattttgtagtgagaacacttaaaatctgcactgttagcaattttgaaatatatattattattaattatggtcaccatgctgtgcaatagatctcaaaaattattcctcctgtctaactgaaactttgtaccttttgattaacatctctgtctcagcctctggtaaccaccattctactctctacttctgtaagtttgatttttttagattccacatataagtgaaatcataacagtatttacttatctttctctacctggctcatttcacttagcgtaacttcctccaagttcattcatgttgttgcaaatgacagaatttgcttcttttttttaaggctgaacagtgtatatatacatacaaaacatttctttatccattcattaactgatgaatggagataaatatatataaaacatttcttcatccattgattaactgatggacacttaggttggttccatatcttgcctgttgtgaataatacttcaagaacataggagagtggatatttctttaacagttgatttcaaatcctttggatatgaacatggaaatgagattggtgaattctagggtaattctattttcagttctttgaggcatatctatactgttttccctaattggctatactagtttatattcctgccaactgtgtacaggggttccctttactccacattctcgccaacgttcgttatcttttgtctttttgatgatagccattctaacaggtatgagctgatatctcactgttgttttaattttaatttctctgacaattagtgatattgagcattttttcataaactggttgaccatttgtatatctactttcaagaaatgtctatttaaattctttacccatttttttaaaaaattcgattctttgttttctgctataagattgtttgagttccttatatattttggatattcactccttatcagatgtgtggtttgcaaatattttctctcgctctgggttgtctcttcagcacagaaatggacagtcgcacgttaccacctgtatgatcattattttaaacacaagcaggaaaagcttttgggttccaaagtttcagtcattatgattgaaaaactgccaaactggtagtgaaacatttattggattggggattaagctattcattcttttcgcattaaaacaatgatgtagttttattcgtaaatctataaagttaagtgcacagtcatcacttttagtacgttctgattcattgaaatcctgtaaaattttatggaaaaatctgtgtaaacaagctttaaataaggcaatattccaataccaaaactcgggatttaggcataggtgctatatttacaattcttaagtaattttcatgtatttcacatatttttaaaactcatgttacaaaatagcctaattctctttactttctgtgtatgagggaggaattaacattttgtaatataaacctcccaaaagttattcagaatatttctaaaataaactgttttagattcttggagaaattctgtgatgtcaaaatctctttcctttttttaaacaataaaaaacattgtggctttgtttttttaattgataaataataattatatacatttatggggtgcatttatggggtgcaatgtatacatatatcaaattttaccccatattgtacattgggtacaatctgtaccctcataatacaaattgtaccccaatgtacaatatggggagcaatttgatacatgtatacattgtggaaggagtaaatccgactaatatatccattacctcacgtacttatcatttctttgtggtacaaacatttcaaattcattctcttagcaattttgaactatacgttattattaactctagtcacctaatgtttaatggatcaccaggaattattcctcttgtctaatggaaactttgtaccctttgaccatcatctccccttttacctcccaccctctcccaacgtctggtagctaccattctacttcctacctctacgagttcgaatttttagattccacatataaatgagatcatgtaatatttgtccttctgtgcctggcttattttacttagtataatggcttcatttttttaaaatgtttaaaccaaaggtttcaatacataaatctagacacaaacaagtactgtgtgattccattttttataaagttcaagaacaagcaaagttgatcaaagacaagagacaagaaactttcagtagtgttggacatattctttaatctttgtggaggccacacagggatatagatgtgaagaaattcactaagctatgcagtcagtattagagcccctggatgtacatgtgttatgcagtaatgaagggcacacacacactcattcattcacacacagcaaaagcaatctatgaagtgacaacacgacacagtgaacactgttttcatggtaaagttgcaataagacaaattacattatttttacagtataaacaattatattcaattaaatgcacgaagtgtgctagaatatattggataattcggaacgaatacctatactgcaggtgctgaagccaagagagaaacatccccattgaagtattgtaagaattctgtcccccctgccagttgctatgagatatcactgaaatatggtagtgttttctaaaatctactgcatgaggataggacaaacatgctttcagtgaaatgataaaacgctaccagaactaaaagaaacaaaagtggtcaggtgcagtggctcatgcttgtaatcccagcactttgggaggccaaggcagaaagatcgcttgagctcaggagttcaagaccagcctgggcaaaatagtaagacctctgtctctattaaaaaaaaagttaaaaataacaacaaaaaattagctgggcatggtggtgtgtgcctgtagtcccagctaccaggaggctaaggtgggaagatggcttgccccagcaggttgaggctgcagtgagccaagatcatgccaccccattccagcctggacaacacagtccctgtctcaaaaaaatcaaaaaagaagaagaagaaaaagtattttaaacctgtcattaagaagaaaaaagatgtaattacacacttagggaggccagagtgggcagattgcttgatcccaggagtttgaaaccagcctgggtgggccgggcatggtggctcacgcctgtaattctagcacttttggtaggccgaggtgggcagattgcctgagctcaggagttcgagaccaacctgggcaacacggcgaaaccctgtctctactaaaaatagaaaaattagccaggcgtggtggcgtgagcctgtagtcccagctactcgggaggctgaggcagtggaatcacttgaacctgggaggcggaggttgtagtgagctgagattaggccactacactccagcctgcgctgggcaacagagcgagactccatctccaaaaaaaaaaaaaaaaaggaaaaaagaaaccagcctgggcaacatggcaaaactccatctctacagaaaaatacaaaaaaaaattagcaaggcatggtggtgtgcacctgtagtcccagctactcagaggctgagaagaaaacagattatctaccgtaataaagcaagaaacccaatccctaaacaatactgtgccccatagagtaaagccgtttcatttctcttttagtactttttctaccctaacaaagaaaattgtggctaaaagttaaaacaaaaacagtatctttttgctagtttcatgatatatcttgtatgtatgtatgggtgaatattcttatattattatttttggttcatgtaaagtaatttttccaagtgaatatctaagaccaatgcttctgaaactttaatagtcatacaaatcacctgaggattttgttaaaactaatattcatctccaggagttcaggggttaggctaagattctgagtttccaataagtacccaggtgatagtaatgctactggcctacacactactctttgagtaataaggtcttagattaaagtggacttgggcccactaacattgattagcttatgacaggaagacaaaaaacaaaaacaaaggaacaaacaaaaacatagaaggtaaaatgttaaaatcaaggcacaaagtattgctgtatggaaagtgtctgaattttcaatatattcagccctggaggaagagcttcccactaccacttatttactgtttctgttctaaactggctataatagcccttcaattatagagctgtttcagtaatagcatctgcttcattataacagcagttttattaaactaatagttgttagcatgaagacaccattacagtaaattacatttataattatggctctaaatatactcaggttgcatacaattattaaaaatttccaccctaatcatttacctttcctgaagctttcctcctatcacatagatgctgtgagcgtgtgttagtgtatgcaggcttttctatgaggctgctttcctatatcccatacaattattcaaactgatgcctggtgtatctagaaatttgtattcctagctcagagagcagctaattagaacctccttcccaatctctacttcccacaatctgggtcatttccttgtttagtgccttgatcagaaataatttattgtctggttgtgcatggctttgagggaggcacaatataaagaaaagttcatataagaaatgtgcacatttaacatcaatgcataacaaacaccccaaagcatagtggcttcagctaaaaactgtctatcattgcatttgggacagctgggagtgcttatctagatttggctcagctgggcaggttagttaaggtggctctgttacacagtgtctttattagtctgttctcatgctgctaataaagacatacccaagaatgggtaatttataaaggaaaaaggtttaatggattctacatggctggggaggcctcacactcatggcagaaggcaaaggaagagcaaagtcacatcttacatggcaacaggcaagggggcgtaaggaggggaacttcccattgtaaaaccatcagctcttgtgagacttgttcactaacatgaaaatggcacaggaaagaccctcccccctgattcagttacttcccatcaagcccctcccacaacacgtgggaattatgggagctacaattctagaaagacttggtctgggacacagccaaaccgtatcatcatctcacatgtcccctctgagcccaggtcctcctggcagtgacccaagcacatgagaacacattcaaccatgacagcacatttcaagcctccgcttcattgcttctgataatattactctggccaaagccagttacatagttaagctcaacttgtgttaattttgcccacaatgaggccaaagcaagtcacatggccaagatcaacataaatggagcagagaagtgtcatctcctatggaagtgaacagaaatgagtgatcatttcagaacaacaacctactctatcagagatagtttcccttttatacatgtaagtacaataatgttgaaagtctctgagtttattttcataacatgctaaatagccacagtcttatttagccaaattacaaacattggaattgcatggtttcttttagaatctaaggtttttatagaaaatataacatcatatatatatatatatatatatatatatatatatatatatatatatgtattccattttgatgctatatactactagtcagtcacctgtaagagtttttgactaaagttttcggcaagatagatatagttgagtcatggtcaaggtgaaaagggtattcactcaacaagaaaaccatccatcaaagatttcctatgtgccctttgttacggctgtgcagctaagtacaacacagttccaggctttacagttcttagagtgtttacagacaaataagtaagatgctcaatatgaggtggtaggtcctgtgtactgggtgtatgccagatttcacaaggagtgagtttaaccactggacagcagagtgggtgctagagctgactcttgaaggatcagaaaaaattcaccacaatagaggggttgggcgttccacatatagagatgacattgggctgcattcggggagcccacaagtaatggcatagaagtgtttgtgtctgatatccccttccagacatcccacaacctaaagagctagacactgagggggcctgcatggtgagcctagagccaactcaagatgcaggaacaaaacagaatttattggaacatagaaagatatgaaacaacagtagttgctctgagaggcgtcgtctacatttgaaattgctgggtgttgtgctgaacccttattaaccccaataaggaaggcacaagattcaagaagccaaagaagagacccagaggcaacaaatgagacatggggttttattaaggctcacatacaggggagagaggccagtggtggtgagctaaatatgataacctcatagcccagtggcagtgggctgggcgggaaaacagcaactgctagcaatcagcatgcactttatatagcatttccacttaacaccctcccccagtgacctccacctggcaaccttcatattgtaacctaaaactctgggcctcaatcccctgtacggcctgtgttccacaggactgaataggatgggaccggggctcagatgttcctcatggacaaggaatgaatctctggattggctactcctggattccctagttcagaacatacattcaggtgctatacaaggtcattctaaggttatgcttaagttattgctgtcaggtatgtttatcctacaccaggttgataagacaatgatgtcatcagtcagagccacataaacttgacagccattaaaagtttatcttcctggctaggcgtggtggctcacacctgtaatcctagcactttgggaggctgaggcaggtggatcatgagatcaagagatcaagaccatcctggccaacatggtgaaaccccgtctctactaaaaatacaaaatttagctgggcttggtggcatgcgcctgtagtcccagctactcaggaggctgaggcaggagaatcgcttgaacccaggaggcggaggttgcagtgagccaagatcgcaccactgcacaccagcctggtgacagagggagactctgtctcaaaaaaaaaaaaattatcctattttatttgtttttaagataggttctcgctctgtcacccaggctggagtgcagtagcaatatcataacttacttgtcttcattgactaatgaatcccaacatgctgagtttgattgtcaccttttctctcccagcttcagcaatactatatgtttagaattatagaattttttcacagctcacaaaggagcctctcaggggtgggatgtaggataggactgaagaaagaaaaccctactggggagaaaatatcaagtggagactgagtattcatttctactctttgctaaagagtagttaatgtactcacagtttatgttcagaacattgtcagtttcagagaaagatttcattagttcattagtttatctataaatttatccatcctgtacttattgggcatctactacagcagcagtccccagcatttttggcaccagagatgggtttcatgaaagacaatttttccatggaccagggcagcaggttgggagggctgatggtttcaggatgattcgagtgcattaaatttattgtgcactttattttattattacattatagtctataatgaaatacttatacaactcaccataatgtagaatcaatgggaaccctaagcttgttttcctgcaactagatggtcccatctgggggtgatggaagacagtgaaagatcatcaggtgttagattctcataaggagcatgcaaagtagatcccttgcatgcaaagttcccagtggggttcttgctcctataagaatctaatgctggggccaatctgacaggaggcagagctcaggtggtgatgggagcaagggggagcggctgtaaatacagatgaagcttcacttgcttgcctgctgctcacctcctgctgtgcagcctggttcttagcaggccacagactgatagcggtccatggctcaggggttggggactcctgtactacagcatgccagacaaaatgcccactgaggttggaaatgaagcgaaaacagacacactccttgctttctcggtagcttacagactggagagtaagaagggcattcctacagtggtgaatactatagaggagtagtagacaacgtgtgtgagtgcatttagtatggagctgggagacatttatgggaggaaagataaggaaaaacttctccgatgaagggactttaatctgacatcagaaagaagagtagtagcaaactaggtaaacaaggatggggatgaggaagtaggaggtacaaaatacaaaacgaaacaaagcacagaatatctcccagaacaaagccctcttcatcctgcctgctctctctcccccatagtgattgacagtttgaggaagggggttattcttagggatcagaatatttttgtataactgcttccattttgtataattgcctagtttcccagggtaaataaaggcaggagacacattcagggccaaatacagaactctatattcttacttgagaaacacaccaaaatgatatgcaaatattactatgtagtatttatgtcttccttctctccccaaaattcccatgtgaaaataaattttctatgacctatatactgtcattttgcttaatcattttaaggcaatatgaggacatcatgtattaaatcctggagaattcttagttttcagatttcttgttggatatttcctgatcaataatgtgcaaagggagatgatatttgggccagaaccatcagtttaagcgtctctatattataagaaattctgactcaggctacttaatgtagtttcttttttaaagcatgaatgctttaaagttcatgttttagtcaagaaggaattgcattttctcaaacctggcaggcccagaaaaaagctacttagaaaatcacacttaggtgacagaatgataagaaaagtccctttaggggccattagcactttgcctgaagaaaaactgttagtggttcttcctagctttttaacttacagaagcagcactgttggaaagctcttggtaaaaacaacagaagtaaagcagtttattttggaatctcatgttaggaattccagaatatcccattggttaattttaagttagagtccttattattgcaatttccatcataatagacatattatatttgtaataggtggtgggacaaagactagagtttggatatatcatagaaatctatataccaaactttcattaactattttgccagttaaccatggccaactgatttttttttctttgttcacctcctccataaagttagatctaagattcaagtaacaacctatgcacctttttctaacagtactttattaaagtacaatttacctttagtaaaatgcacaaatgttaaatgtacatcacacagaactttaacaaatatacaaactcatctaacatccagatcaagatatggaatgtcaccccaaaaattccatgttgccctattttagctaaccactccacgactaaaggcaactgctatccaatttctgtgggtataaataacttttatttcttttcaacttcatatcagtaggaccatacagtatgtagtctttggggtctggcttcttttactcaaaatctgtgcattttgaggatttctgaaatattaaggatagcccagggcttctgcaaatgtcagatggacatacaactcaatttatataaacactgtgggaagtaagctaatatttgttaacctgaaagtttctgattatcatgaaatgtccctaggcagggactatgttgttagctacacaatatctaagaaaactatcctaagacaaattaaatatagaaataaaatcacaggcaatagcagatatatctaagcttcttatagataagctcatcccaagtactcttgaggtgcaaaaagaaaaggctaattataaattattcttatccatttattgaggctgttcccttaagggctaattctaggtaatgcttcattaaccttgtatcagttacttgttcttgaatttcaaaaattcattttttccataatttttattaattcagtgaggccctccttctcatttgtacaaattagtaagatgtcaacctacatgtggagttctggagattcatcttaagacttataaaagggaaaaaaaaaaaagaataagtaaaggtattgagggcctactacgtgctgatggccaaggtactttcacctacattaacaaatcaaatcatttcaataggccctgtagggtggctcatgtctgtaatcccagcactttgagatgctcaggtgggtggatggcttgagcccaggagttcaagaacagcctgggcaacatggagaaaaccagtctctataaaaagtagcaaaaattagctgggtgtggtggtgtgtgccttcctcccagttacttgggaggctgaggtgggagaatcacttaagctcaggaagttgaggctgcagtgaattgtgatggagtgagactgcctaaaaaaaatcctttcaataaattatgattcacagaatccaatacatccaatgatccaatggaatgctagttcaaatacattggtacttaagcatggactgcattctaaaagttcacctctaactcagctattttatcatagaaacacagatatataactaaacaccactttttcaagaaaaggtaaaattgtgaattgcatttcaaccacacagaaaccaaacaaagttcgggagtgcaaactatattctccttctttcttaacatcagatttttccattgtagcaaatgtgattaggcagggccttgactaaatcactagaacagtgagtgctgacactaaagctggaagctaaaaatgcctccagaagattgtccttgagagccaagagtcaccttctcctgtgataggcagtctgctactatccccatgcaccctaaagctggtatgcaaggactctctaatcctgtggtatgaaaattcagtcgcctcacctcaaggctagacagatacagagatgcaatgtaggatctggagctccccttggattgaacacacatcttgcttcccttcttcccttacaagcgtttcctgagagcccttcttcaataaatcattttctaagaatctctgttacctccccatctcaggctctgcttctaggggaaaccaatttaatacacccattttatctatgacatcatcctcattctggcctgtggttacgctaacaatttatcttctcctggagtccactaagaaggacaaaagccattcagaatagaccaataaaattcaaagcctagtcttcttccagcaccctatgatctacactttctccccaactgacacacgtggtcaagcagaatgcaacgcccttttcttggaacccagaaaagacaaattaaggaaaatgagtttggaacaatgaaacagtctcctgtgcaaataaagcagacactaccattttaagtatgaataattggaaaacaaggcattgaatagtcttaattacaataagtatacgaagcttgcattagtcttaattacaataaatataagaagttttaaaactaagtgttctaagccacaaaaaagtaaaatatgtccttgtttgtacattatttcaaacataggaggataattaagataagaatgtgaaataaaggcttatctttatttaagactaatttgttgaggcaagaaagttggtggggtgggatgaggcccctgcttctcaaataaggaaatcttaaattaaatcaatgccagtcaattgctgggacattttagtcaaactgggtgtaatgtgctggttaagctatcaaataaaatgttggccatagagcatgattcgtggtcctcaatggaatcggcagttgaggatgagattgctgtagatgctcatcatcctctacagaagtgatgaactgagagcttgtatctttgaaagggtcatataatccttggacaaagggggtagtaggcctgttatccctgctgcctttattcatccacccatctaaacaaccctcccctcagtgtttactgaatgccaactctgtgccaggaactagtctagacactagggatatagtagaaagagaatgtatacggctcaggaagttgtgatttagtgaggattcaaaagaaagattagcaagtctttggagcaaaaattagagtcaagaggaagttttgcaaatgatcctgatcataacaaatatgtgtgtgtgtgtgtgtgtgtgtgtgtgtgtatggagagagacgacaacaaatatatatatatttggctctctctctctctctctctctctctctctctatatatatatatatatatatatatggagagagacaacacctccaaagaaaagagaaaaaaaggaaagcacatgaccgtgaacgaatctagcagtatgagaatttgattgaaagtctcagggaagacctgagatatagtgaatagttggccacagatatggtgttagtagcagacatcagttgggttactgaacaacacttttaaacccactaaaaggggacaaatggaatttactcagagcttagtatattaaggttactcagatcattgcgcattgggagggaagaagatgcttgtgcattgtcagagttgaaaactagagactgtgtgcctgagaaatgcccagtgagacacagaggaagcaactccacggatgcagaaaccatgccacccagaggcctgcatggggagcgtgtgttgtatggaatcaactgggcggagttaatacgtgaaatttcacattaactaattaattaattggttaatcaactgattgattttaaaataccaaaaagcttccaacaatcatttcaaaatttgatatatatgttgaaaaatacagcaacaaaacaaagtataaaatacaaacaaaatcttaatttatttcaatgctatgtattaaaagccttcatatccaaaaaatagcaagattgttattaaatacatttacatactctagtcaaaactataatattctataaactaacattagagaagatgcttgaagaaaaataaacatttaaaatacacccatatggctttaggaattcagaaaattcaataaatcatgaaaaaaatgaacctcctgggttttgttttgttttttcctttgagggaggggaggggaacactatgagttttctctttctttttattttttcagtttctttctacaggatacctaagcctaggtcaattgtttttaataacttcgttttgctaatcggtcatggcacttgtttctctccttaaatgcaaattaggatgagaataaccttgtaaacgtgtctttgtcttctcaaggtcatgtttggccaacagtatcagtcagggtttctttttccttttttaagcaggcagccatgttctgattaaatatttataagtctagttgagtaaagttaaacggagcagatgaggcaattaagaagtaaaaccaagtgtcaaactgcagggtctccttaaatgatgcaagaccttgggatcctgacacttttcattgacactctttgtaagccagagttgttttgtttgtatgaaaagtggcagtgctgtctaagatttactgatccctgtttagaagtcatctaaaaataatatctgagtaactcaaaccctctccattttccccagaaatagttttactgtaggggtgagatgtaggagagggagggagcgtctgtgtactgccacagctgggaacattactgcacctacttcctagtgccttgcaggcatctttgggacttgctaagaacctttggagaagtgtaagcagaggttaattgttcaaccacctgcttttagaaagatataaattttatatatgtaaaataatttttaaaatcatgattaatagcctatatcccttcagttacttttacaaagccttccaatgtccagaaggaaactgctgacagtgacatttatggagaagggggaaaaaaaaagtaatttttcaactcaaattgaagggcagtggatagagaggggaacataaattcattataaaatatcttcttaacccatatatatagccaaaaaaaaaaaggagctaattgcagaccaattatggaaaaaacctgaccttgggagaaaggcatgctatttatttataatcagtattaaggatttagaagcattttcaaggtttgcatttatttggggttgaaatgtcataaatatctgtcagcatggcaatattctagttaatttgattttggtgttgataaggccaagttcaaataatcaatctcaattaggctgattaatttcacactaaaaaactgtactgaggggacacaatttacttaaaccctaattgaccgtgttgtgcctttgggcacagagagatcttaaaaaggagaaatcagggaaatcactatacacaaacactggaaaaactgacttaattttcttgtttttaccaacaattggttgtgttgttgtcaaatggataaagtagaactttaaagaaaaatcaactttgtgcagtctcttaaaaatacctgaatgaaatgaaataaaattcataaaattctatccaacaattgaaaaaaacagctttttttttttttgcttggaggctagaggatgatgatgagtagctctattctgttagctctttctgtagctctattctgttaaattgtcatgacatttgttcagctcctaaaaaatgaaaattgggattgaaaatcaatttttagtattttttttccaaagcatcagcatacttgaagcctgtgttactatgaatggttacccttaaaatgaaagaatagttgttacttttggagcgggatagtaaccaggatagggcatatgagtggcttatgaaacacactaaatatcctatatcatgatcagcggtggagatacctgagtatgttaattttgtgaaacctcattgatttacacgctaatgatttatgcacatacaattttacttccttgatactctaattttttaagttgtaaaaaggaatttatatttaaaaaaaggttggactcctatgttcatttctataaatgaagctgtcacacagacctgaaattttatttgagcactggctctatcattttcttttgatgatgatgtttctttgatgtatgcatttttatcaaatatatctaatttgatgtttctttgatgcatttttacctagcttttaactgggacctggtttctgtagtgtaaaaatctatttgcaatttctagtgtattatactatttaatgccttcttctcatttggaactagaaaatcacttgggttaaatggtgtccagctgccttcagagataagccctggctttgacttattaatacatttccatcggcctttcctggtaataaacattcttactgtcctccaatatggtaaaatatttagcgtaagagtagtcttggctcacagtatagttgttgaatccatgctgtttttcagtcattggctgctctgttcattacattctatacaattttgtatactgatgtcttggggttttaattgaattttaatgaaaaaatggcccggattagcagtaatatggccagctgtgggctgcaatgttaatatgcacctactgtttcaatttgctggtaaagctgataatgactgaagagggcagctaatgcaaaaaactatgcctggcaattacatcaagtcaggttttcacccctcatctttagcagcttgcctccagcttttaataaagagcagagcaaaacagggccagttcaagcatcctctgatgtttgtttagacttttctctgttgactgagcatttgtaattttaaaggtctggtctctagtgtagttatgggcagtggtgtcagacacatctgggtgatgccagacacacttgagtatgcattcttcagccatactagccctgtaagatttagtaaggtaattttatatcttttagcttcagatttcttatacagaaaaatgggtataattgtatctttttcttggattattaaaaagattaaatgaaattatggatataaattccttaaatagcacctagtatccatttctgagctcaccaaatggtgaccattatttttgttaaatatgcttcaggttttccccatcaatatcaaaaattaagattggacttggaataaaagttctattttatattttaaatcttacaaatgaaaataaataaacagcatggattcaataactatactgcgagtcaagactactcttattacactgaatgttttaccatattggaagacagtaagaatgttggttgcccagggaaggccaatggaaaggcaagtcaaagccagggctagtaaagtatatgatttcacttatatgaagtataaacacaagtacaatcattttatgggattaatgtcaaaatagtagttccttttgtgaggcatagtacagtctggaagaagcagaagggtttccaagatgctgaaaatgttccatttcttcatctgggccatagttgttgtattttatatacgtaaaaattcatcaagctgtaaacttaagatctatgcacattattgtaattatgttacaactcaataaaaaggaaagggcttagcaacaatttttttaattaattgaaaaaataaactagcacagacctttgggaaattaaaaagtcataacagtgctcagtaatcccacccctagtttctctattgaatattctgatagcagaactattccagtaacagataaaatattatgtatatggaggtgttcaatgcagcatttcctattttagaaaagcgacactgaaaacaatataaaataaatgtctaataatgtggtaacaatgacgtaattgatgatgcatcaattccaaaattatgcagtcatcaagaataactacattatgtaaaatggtgcagccactttagagggctctttggcagtgtcttataaaactaaacatacctcagccctatgactcagcaattccacttctgcatttctaccaatgtaaatgaagacatatgaatccacacaatgacttttacatcaatgttcataacagctttattcataacagccaaaaactgaaagcaatctaaatgtctatcaataggacaatggatgaagaaatgatgatgtattcatacagtgcagtaaaactcaggaatataataacatgaatagatctaaaaaaagttgaatgaaagaagccagacacaaaagttattccattcataacaggttacattctaagttattccattcatacgaggttctagaaggggcaaattagtctgtggtgacagatattagaacagtgatttacctctagtgggaaggtcaggaactggcttgtgatgaagatactctatcttctttggcaggatctacagcagccatcatatgacactgaggatctgcccagtaaaaatgtaaaagtttcagtcctaaaattgttgagctggtgaaccaatgccgggatttccgtaactcttacataaaagaaagtaaagccttatttgttcaatccattatagctggtaacattctgtaaaagaggacgcaaaaggcacccatgaccaatactagataatacgtattcaatcattagacccttttatgaaaacaaggggcgaaaagtgctgcgacaattcccagagaaattgaaatggatatttcctatataatgctaaaagagcatcagatatgaagtaagagggtgtgaggagaagctgctaactacataatgcttcaacagtgaaaaaaacagttctacacaataaccttctaacgattcctcattgtggacgggtaggtggtttgtacttccagtcccttcagtatcagatgtttatcatatatcaaaatcacacacttgatgtttttcctttgtactgaaatttttaacttgttttcattctatttcaagaaatattgatgaatcattttgaattatgctgttatgaagacattcatgtaaatctgtagtaacatcataattgtatttaattatgtatccatttatcattttccaaaagattaaaccatgcacaaaaatacccctctgtgttctttacggcagtattaatagttgcatatacctaggagaaaaaggcaatttaaattttctcccatgttattttagatgtattttactcctcctcctcaaagtgggtatgaacagcaacacttcccccagaacctctcgcatatgctcaaggaacatttgcagggattttatatagtccgtcctctctttggatatgtttttaaaaataaggaaaagtttcatcttttaaggaagtgccttttattgacattcaactagttactgacagatttttactgttcagtctcttaaaagggtttgaaggaatgagaactgggtagttgtgttgctggtcattttaacgttattttatttattttctcagtagttaatatacaagcattgtactgcagtcacaaaattcagaaggaggaaataagctagtctccctcacaccctccttctccagccatcctgtgcccttccccagatgtaatattttcaaatagtttaacgtacgtttctgtgctgattactttttttgctatttccaacaatgttgctatgaatattcttgtcattgcccccaagtgcacatgatttcaagagttctgtaactcttggagtataacaaggactagaatttttgcattgtatgctatgagtattttcagcctagctatgtataattagttactgttttccagatagttctcatttatcttcccatcaggagtggaggagagctgtgtggctccacatccttgctcataactgtcagtgtcaagcttttcaatctggtgtgtatgaaatcatatttcactgtgattaaaatgtgaatgttctggactaacaaagttgagcatcttttcggatgtttattcaggttttcacttctatgaagtatcttttcaagtgttctgcacatttgtttttctctgttgagtttcttggattttttcttattgactcataaagcatctctcatatgctttggatgtaggtatttgtcagttatatttttaaatgcctaaattggatgcagcattccctaacttcaagtctgtcttattttctaaagtaaatatttaagaccatttcttcttaagtcttaactacatcttacaagctttgatacctaatatatttgctataatctacttgttaatacagtctgatttccattatttctcctttgatccatgaattgtttagaagtatgtttttgtatctataaaaaaaggagtattccttgtaactttttgattatttatttaaactacattgcattataatcaaagaatatgttcagcatgataccaatacttcaaaatttgataagattagctttattactaaaatgtggttaggttttacgaatgcccacatgtacttcgacatgtatattctccactcaatcaaaatagtacattgcacttttcaactattatatgtctttactgttggcctacaatcacaagagtctgatttgtccattattaatgaacactttcagtttttatattcaagcatttggtttgatccaggtttatttttatataaagtgtgaaactaagttcaggctgtttttttccccagattccagttgtaacaatagtttttattgaataattatctttttcattaccaatttgttttgtcaagtttgctacataccaaattgtcttatttttatttacttatggatttttattttatttcattaatctattcatgcaagaatgggacatttttattaggtgacagtaatgaaaatttaaactaggttttgatgcagtgatatactgatggacccaaggtagaaaattaaactagatttagaagagagaatttagaaaaatgaatagggtcatggtcttttttgtctaaaggagagtgtgtgaataataagtggaaatgaaaaacctcagcagagggaagtacacattgttaacaattattcagacccatgtaacaaaagaccgtaattctctgctctgtaaaagaattatattaaagagacaaatgtcacactaaatgatacttgcaggacttacacaggtctctagagaaaagagtgagtataattagtacatgtgttatgatgttttgattctagtccaaaccaactagattaaatacatttactttttgaacaaaaatggcaagacataattattacaattggaatgtgatagtaatatatataatatgtatatcttagtgtgtgtgtatttatatatgtatgtatgcattccttgtgcctaaaacacttcctgctaggaaattaagccagccttctatatttgtactcacaatctatcctccaagatatgtagagttgataaaaattaatgcttgcctacaaaatttcagcaatgcttctcctatctctgtacctcccctctgtatacatttgaaaaattaatcctgaccatcccaggaggtagaaaggaaagggtggtaaaataaatagttccttgagattttataaattcatccagattaaaatatatatatatatgtatatgcacacttgtcttgaaaaagttgtgatgatgttatatatcagaaataaaaaattgtttccactcatccaaaagtttaggactcacaaatttttttcaagcagaaataattttgtttcataaatttggtttaatttcttttgattacataaaaaactagaaatggaaatttatgtatatagcaatgtaaaaatgatagtgagtttaatgctaaaatctgatctactgggctctgtttaacctaatacccaaagcttaagtaatggttaagttggggtttagaggggcctattaccttcttcagggcattggtattttgtttcctaccttaatctaaaattagtgtcttatttgccagtctaatatattttacaatcaatctacattgcctaccttttggagtatttctatttaaataaaacaaaatgagcgtttaaactgggaacgtattagattcttctgagctattgagcagtatcagatccttcagcaagaaagctgttttatcatttactaagtacctaggcacagcatcaccttgcccgttaaaagccctgtcaggtacacattttggttgctaggcagctgctggggaagcaatctcttccacacatatggtttatgccacctggcctgcatttcacaccaacctccccaaacttcccagggagttgcaagagaggtcctcatgttcctgtcttcactttccatttccctgtcataagcactccatttgttgtcagctttcattaaggacatttccaggagctaaatatggtagatttctattaactgattctaaagattcacattaaacagaaatagagcaaaaccataaagccatctgtggaatttgagagtatggaggggaatatattaagattaaaagataatcccggttacacttccattttcatgacatttgataaaaacactttggaggaaggagaagaaatgggccagtgagagggaggaagaagaaagagacctggaaaggaaaaaaggcaggaaggcagatggaaggagaggtacagaaggatgaatggaaggaggaaatgcaattttttttcttcctttttattttattttattttattattatgatactttaagttgtagggtacatgtgcacaatgtacaggttagttacatatgtatacatgtgccatgctggtgtgctgcacccattaactcatcatttagcattaggtatatctcctaatgctatccctcccccctccccctaccccacaatagtccccagagtgtgatgttccccttcctgtgtccatgtgttctcattgttcaattcccacctatgagtgagaacatgcggtgtttggttttttgtccttgcgacagtttactgagaatgatgatttccaatttcatccatgtccccaaaaaggacatgaactcatcattttttatggctgcatagcattccatggtgtatatgtgccacattttcttaatccagtctatcattgttggacatttgggttggttccaagtctttgctattgtgaataatgccgcaataaacatacgtgtgcatgtgtctttatagcagcatgatttatattcctttgggtatatacccagtaatgggatggctgggtcaaatggtatttctagttctagatccctgagaaatcgccacactgacttccacaatggttgaactagtttacagtcccaccaacagtgtaaaaatgttcctatttctccacatcctctccagcacctgttgtttcctgactgtttaatgattgccattctaactggtgtgagatggtatctcattgtggttttgatttacatttctctgatggccagtgatggtgagcattttttcatgtgttttttggctgcataaatgtcttcttttgagaagtgtctgttcgtgtccttcacccactttttgatggggttgtttgtttttttcttgtaaatttgtttgagttcattgtagattctggatattagccctttgtcagatgagtaggttgcggaaattttctcccattttgtaggttgcctgttcactctgatggtagtttcttttgctgtgcagaagctctttagtttaattagatccgatttgtcaattttgtcttttgttgacattgcttttggtgttttagacatgaagtccttgcccatgcctatgtcctgaatggtaatgcctaggttttcttctcgggtttttatggttttacgtctaacgtttaggtctttaatccatcttgaattaatttttgtataaggtgtaaggaaggcatcatctttgagatgaatgtgaatgatcgtggaatattccttctgtgacagactttatttttgagacaggatctcactctgtcatccatgctgctgtgcagtggtgcaatcacagctcagtgcagccttgaactcctgggctcaaggaacactcctagcctccccagcagctgggactacaggtacaggcgctgccatgcccggttattctggcttcaagcaattctcccacctcagcctcccaaagtgctggacttacaggcaggagccactgcgcccccggcccttgtgacagacttttaatgaaaccattatatttacttctttgacagcctgttactatgtcaattcctccagccactacaaaacctgtcctcatggtttagagcattggcagtcactccctaaaattggagtggagtgaggaaggcagttctgtaggaggggcttatggactccttaagggcataggctgttggagtccctgctgagagatctctgccctaccttgtggaactggagtgaaacaacgggggcgttgcttccagccatctgggagagaggatccagagcttcccctcagagagctgggatgttgtcagcaggcatcagacagagcaaaaagccatttttctttattctattcctgatacaaagcaactgagatatgcgtttctctttggaattgaggaagggagaataatggagcttttgcggtgatggacagggaaaaagtgggggagcagttaattatccatcttgacaggtgtagacacaggctgggaagctgggtgtgtcttaatccctgctcctgaaccaccgtggggagcaggaagcctacagtttccttatatcagcaaatgcatcatgttgaaacaattttactgcttgctttctgaatttaaatatagattttccctgagaagggctcaagcatgcagatggtaagaaaaacaacagtctagaaagatatcttcaagttccttctcctggttggtggaaatagagcaattcttttccaaaatataatttttagagttttaaagtaaaaaaaaaaaaaaaaaaaaggatagagtcaatttggaatttcttagctgaccattctattagagcataggtttttcagaaaatagagtttatgggcaaaaaaaaaaaaaaaaaaaaaaaaggaaagaaaactgttttaagtatgatatcttcagtgtaatatatagttaacatatactattttgttgtaattagaatatgcaattattatatattaaacatatctacatctgtagtaaaatgtgttgtcctacatttcagaaaactataaggcttttgggaaagaaaatttaggagtatacattaaaagccatgtcaatgccattccctttaacatagtagttccatttctaagggaaagaagttaaaaaattgaataaactcacatgcatgaaaatgtttcaattataatcatgaaaaaggaaataatataagtaaccaggatagaggattgattagggtagttgctctcaattttgccccccagtggacatttggcaaaggacagcgcccctacaacagagttatccagcccaaaatgtgagtagctccaaggttcataaactgtacattagtgtaattagagtgtactgactcaacagaagaatgtgcagtctttaaagctcatattataaaggctaagcttcaacatgaaaaattattttgatataataaaagagaaaataacaggatgctatttcatatatacattattatggtcaaaggtagttttaccatgatgctggtgaaactttagttgcaggatctctcacttacggaagcccttcaaaggcccttacggaggctgtaactgtgtttcatatggttataggcttttgtataaatttttaaactaagattattttaattttattttaatataatatttttctttttccctcctgaagttatacaagtttcaggcaccactaaacttgatttccctttgactatcattttaaggaaatgaaacttaatgcacatgatggaggaaaaagaatgtgatgagaaattaccaaatagctaactgaagtcatgtaaggatgaggggataatggagaaacatttttctcttctctagtttccaggtgttttccagagctattatattagtttataatgaaagaaatgattcttaagagaaagaaagttcatggatatacaagaagaaaaaaaaatttggaaaaaaaccaccatgttaggcgccggatgagtttgttgtggtttgagttttgatcttctcatgctgatctttccggctttgtagttctctctcctctcgtacttctccatcattcatgcttgtgtccaaccacagtattttactaagagagcatgtgttctagtgccctattgctgcagagcaaaccacccaaaaaacctacataggctctgctgggtggttctcactgggggcctctcaaacagttgcagcaagatggtggttgaagctgaagtcatctgaaggctcactgggctagacatcccaggtgatcatcactcaccggccccatatctccgtgctcctatctgtagcatctcctgacagcagagtagccaggtcttcctacatggccacttggtactacaaaaggcaagaagaaagtgccagtcctcttaacaactagatcgagaactgagagagaatccattttaccatattcagtggttcaacacaatcccaagccagcacagattaaaggggatgcaagggtagactcctttgctgcatgggggaatatcatacagtgcggcaaaggaagggcttgatggaagcctttgaacacaagctaccacagcaaagaacatttgatttccaagattcccataaggtagggagggatatgcaatatagagcaagcatcttccctagaaatatgcatgtgataaaaatatctacctacagagatattgttagcagtggaagttattcaagttagtaatggcaaattcatacgggtctgcagcaacctcaattcttgcttcctcagaagaaagaatttgactgaggggcataaggcagaagacgagatagaggcaagttttagagtaggagtgaaagtttattaaaaagctttagagcagaaatgaaaagaaagtaaagtacacttggaagagggtcatgtggacatcttggaggtcaagtgcactgtttgatcccggacttacagtttttacatgctgtcctacttcctgcatcttttgtcccttttccggtggaatgccctccgaaggtcatataccagttaaactttgccattttgcctcttaatgtacatgtgtgagctcactcgcccaactcctgagatctcatgaggaagctgcgcatcaccagtttcaggtatttcctatctatatagggagactgcctttccctggtgctggctgtgaccaattattattttagagagacagttaacagccacctgcccagggtcacctgactttcttggtggggtgtgcggggagccctttcctgccccgctcatgcctgactagctacctactgtaacaccatgtgtaacaccatgaacacaaaatgaatatttctgacaatcagctatagagtgtaaaagcttttaagtagcactttgccagttagaatgctctaaaatggagcctcctaaaattctccaatataataattttctacggaaatctatcagaatagagcagtgacacccagaggaaatttggaaatgtttagtagtatagtgttttatgcattttaaaataaacaataactaatattttaattggaattttttgagaaaagatacaagctactttcaactgaagaaaagtgtcccgagctaaaaagactacctttgcatcatcatagactgcttgatagaacaactaaggaagtaaatgaaacggaactcactagaggccacctgaatcatcaacaaattagtcaatcagaaatgttgactagagtccctctttgatgaataacaaaattcttattctgtttccaaatgtaagaataaatgaccagggctgttatttgctctaggggattaatattctgtacattcagttaatcttgcttgtgattaatcagcaaatagtcaagacaattgaaatattcacatatcttatgaaataaagagatatttgcaaatatcaacaaaaaaggacattatgtaaaaaattcacttattagaagcatgtcagtaggccacaaattaactaaccctaagcattattttgctttctttgtagcacattccccttatatggtactcttttctgggaaacatggtcttgctctgttgcccaggctggagtgcagtgttgcaaccatggctcactgcaggctcaagctcctgggctcaaatgatcctcccacctcaaaagcttttctagtagctaggaccacaggttatgccacacctggctaatttttaaaaaatgttttgtagaaatggagtctccctatgttgcccacccttgtcttgagctcctgggcttaagtgatcctcctgccttgggctactaaagtgttgggattacaggtatgagccactgtgcccagctgataaggtactcttttatgtcagacatattaaacaaccctatttattgatatcaaagtacaatgcaccaattctgtgaccagaaaatgagacaataaataaaaactatcttaaactttctattccccattttatttttacagctaacttttttttttttttttgagatggagtcccactgtgtcacccaggctggagtgcaatggtgccatctctgctcactgcaacctctgcctcccgggttcaagtggttctcctgcctcagccttctgagtagctgggattacaggcgcctgccaccacgccagctaatttttgtattttcagtagagacagggtttcactgtctcaggctggtcctgaactcctgacctcaggatccacccgcctcagactctcaaagtgctggggttacaggcatgagccactgtgcctggcctacagctaactccttaactacccctctccttaaaaaagtaatcaaatattttcatcgtgcccttaattctcattttcagtttgtcatagctgtagaataaatggaacttaggattaatacagaacaatttcttcagttacttactctatatgacaaatggaaccagttatatgaatgctaagacctagtatcttgaagactctcaagtaaaaaaatgctctggggaaaataatttaaaaccatttgtctctggttttgacacacttcaaacaaacttgtacaatatattttcccaacctgaacatattcattcattcaaggacagatcagtcacccaatggacatatatttagcaatgattctatgtgtaatcatgattctgggaacatagaattaaagatgattaacaagttaaaacgtctccctttgaggtcgggaaatattcacctgactttactgttatactgttttatcccccagtgcctaatattatgcttggaacagggtagatacttgcctcttttctttattttctttctttctttctttctttctttctttctttctttctttctttctttctttctttctttctttctttttctttttccttccttccttcctttcttttcctttcccttcctttcttctttctcttttttctgtcctctttccttccttctttccttccttccttccttcctttctctcttccatttgttgttctttgtttttttgttatttaaataagtaacattaataaaacacactggtggaaataaacagaagtgagaacataaacagcttaggtgactgggatttaagcatatggctttctatgtcttagcaaccctcatgtggttggaggttgtcagtcttattccccatttgacctccagcattagcccagaggctggacaaaagaagtaatcaattaataattgatatcaaaataaatgattcagtgtcttttcaacataggacaacacagtcagtgaggctaacaagaatgatatcaatttttcaagatgttaaatgctacacattatactatactaaagaaaaaagaaagtttgcatcacttttttttcatttatctggaaaatttatttatattgaagttctcatttagttttggtgcctgatgaatgagctattacttgatattctcttgctttctcaataaccatctcatctagaaagcagggtgggacttctcttttttttacttttctgacgtggtgaagcgtctatcagaacatctttcctctcattggcagctcactacgcagcttgcaaaggttcacaggtggctgaaacccaacccagttgtaaatcacaacatgggtacatcttgcatattttagaagacagaaaagaaaataccttgtcagccagcaatcagaagcacattatatctcagaaagtctgccccttgtgcctgtcagcctgaatgggacctttcacacaaaccttcctgccaattcacttagagcagccagacaactccctccctcccatctttcaaattactccacatgtctaagttttcctttaaaatgtttccaaaccactggagcacacctctcatcacagacccccattgatgagagacaggattaaggttatgtcagatataactgatgattagagttatttccaccttctccacagttgttgacagacagcaaataaaggcaacattgttagacctacaattgatctattgaagttaggacttatttcttgactcctgaaaatacaaccttctaccagggctattctaagccagtgatttagagccctgatgccctgtatttatttattttttttactaatttttccactgctatgcaatgaggcatatcattattattattgtaaccgcctggctctcagtggcatgtgcacaaacacccagaaagtaaaggcatacagaagcctccgttaacgttgagaagggacagacaccataattgttttccactgttccttccattttaaacagtggggatcttacctatgttaagcatttctaggtgaagcatagactgcttaagagctgtatgagtagaaattaggaatttaggcttcagatccaaccccacctgggttggtatttgggtttcaacatatagtagctttgtaactgctggtgtgccactaatgctctccaaatattaaggaaggctttgaatgctattccaagatgtttaggctttcttccacaggcagaagagagcctttgaaagccttggagcagatgagtaacatagtagaaaaaaatacttcgagataacttgcaaagaggagttgtcaatctccaggatttgctcagctccattctccttctgggcacatggaagttctctgtgtctggcactgcattggttctccaaatctcacaaacagtgcactgaatgactgtgatgattgaataattgaccaagaaacccagataatgaaaggaagaaagagaaagaaagaaagaaagaaagaaagaaagaaagaaagaaagaaaggaaggaagatagtaatgaaatgtgggcatggttgactaatgtatgagagttcatcagatgtataacttacttttcttttgaataatttgtatttatttattgagcattacctggataaaatacataactagttccatgcttcacttaatggtttaattatcaagaagttttgaatcaatactgacctgcaagcaatgtctcaaatctggaagctaccaagaattctgagatccaagttttctttcaaacttccctcccttttgcattttgaagtggtagtacaatttggatcagataaagaggaacaaggtggtttcagctagctgcagaacacagatatgacttcattacccagctgttagtaattttcctcccagtcggaggcagaattttgaatagactgaaaacatgtttgtgcagggttctaagatgctacatgaattcagatgttcattcatttaattcatataatagcctcagatgatatctttctttctcaccacaaggctatgctttgtctaaatggccaggtaaacatcccagaagtgagtggtccctgaagtggtccgtgaaccgatttccacgaccggttctttcctacgtgtgaaccgtgctctgctgcaatctactagtgcctcgggcattcctgcggcctttgtctaagcagaaagggtagaacttcctgaacactaataaaggaaacataaaagcagaggtcagctggaagattggcaataggctaatgaaactgacagtcatttttgaccattttaaacaataagtttgttgcccctacatcctccacattagctgcccagtcttgtcaagtgacacacgggatattatgttgaatttttaaggtgcttcttggctgtgaatatggcctgggatctttctttccttttaataatacttagcacataattgttctgaaatcacatgttggaaaagctcttgactagaaatgttgagagcgggggagaaaaagaacagcacttaagaaaagaatggaaaagtttcagtgacatttgcaaaattgcttttccttctgatttggttgggaaaattatttttcagactctagggaattattgtttctcacacacttcatataagaatatatttcaagccagaaaggaccttagaggtggtgctcagtgtccttcgttcagatcagggaaggaaactgaagccgagggacgttaattgaattgcctctgttgtggctgcaaagtcagccagtgaaaacaaaaattctctaggaagccagctttgtttccttatatttaaaagtcattcactcatgtattcatttggccacagactatgtattgcacagctattaatattatgtggcaggccatatcaaggcatggagaatacagtggtaaacagaacagatcaaacctctgcccttatgttggtgataaatgctctagcaccttggtaatcaaaatacctccgtattagcagtttatcggaaatgcagaatctcaggccccaccccagatctattggatcagaatatcctttaaacaacatcctcctggagtttcatatgcattttcaagttgagaagaaatagataaaaaaataagtaaaataaggaaaataggaagagtttggggagcttaatgggagattatgtaagagagatatgtggaggtcaaatgcccagggctctgtgggttatttgaaggacgtgggcttttgctctgagtggggtggcaaaactggagaggattttgagacaaggcatggtgtaatgtgactaagtataaattctatgtagcacagccttaaatgttagagaggtagaaaacagatcagtggcggcctggcaacaggggataggccacaaaagggcacaagaaacttttaagggtaatagaaatattctgtaccttgatggtaatggaattacactcatgtatatatttgtcaaaactcatctattggtgcacttagaatgaatgcatttcgttatttgtaaactacttccaaagagttccaaaaaaaaaaaaaaacctgttggacacatctgatacggtttggctgtgccgtcacccaaatcatcttgaattgtagctcccgtaatccctgtgtgtcatgggagggaccttgggggtggtgattagattatgggggcagttcccccatgctgttctcgtgatagtgagtgacttctcacaagatctgatggttttaataagggggctcattctcattctcgctcctgctgcactgtgaagagggaccttccaccatgattgtaagtttcctgaggcctccccagccatacagaaatgtgagtcaattaaacctctttcctttataaattactcagtcttgggtattcttcatagcagtgtgagaatggactaatatacaacatcataaccaggatataacttaaattgtgtaaaagaaataagcaggatcacctccttatgtgggtactatgctcacaacctgggtgacaggttcaatcacaccccaaacctcagcatcacgcagtatacctctgtaacaaacctgcagatgtacctcgggttctaaagtaaaagttgaaaatttaaaaaaaaggcagatgagagaacagctgttgcaaagagtatcagttgaaaccaaatttctctctaagccagaagaatagtgggtatgtgagcatgtgcaagattttgcactgcaaaagatcatttcaggagtccagaacacttgagaatatgcagaataacagtggagaattcaaagtgataccgaaatgcaaaagcacactaggtcaggatttatgagatagattctatttttgcctcacttctactactgcctaactttgtgaccttggacaagtcatgtattgttcttgggaatacaattttcttctctttcaagtggcaatcagagcacctgtttccacattgctatgtgggggtcaagtgcaatgtgaatgctggaaaagtgctttgaaaatgagaaggcactgcgtatgtgtaaggactgctaaaatggccttttccaagatgcattcacatcagtgacgccaagaagttggaaaggacaccaattattagatgtttctgacactgccttaacttcagggcatgtgcaagttttcctgatgtgcatgtgaaactgtgtctattacatatgctgaagttttcccccaaatgggaccagcacccacatgtctgatatattccttaggtagagccattcttctcaataaaacacaaaatagtgaaatacagaaatgtctgatttgtaaagagagggtatctgtaacaaaattgaaagtcacagatttgatatctacttttacattcttgtatccagtaacatttttttgagcatctgctactgagtgaagcatggaaggatacacaaagatgaataaaacacagtctttattgtcaaggagatgacagtctagaagaatggataagatgtgtctaaaagtaacttgaatgcaaagccatatgtggaaactataagacaaaaattaacgcaatggagttagatagggggaaaaataaacacttgtctctcggaaaccttcctgagaaaagtggtgtttgaagtgagcattaagaatagattaagtcatgtcatagaatcaggaaaatacaaggcatttctggaatgatgtggtggcctgtttggctgggagacagcttatgtttggggcactagtgtgatatggaagaggaggctaaagaaggttaattgaagacaggaccatggaaggttttccatgctagcctttctaggctggaaatggaaaaccactggaggtttctgagcagaagcgtcgtatgactcaaagtgtgtcagcggaagaggactttggcagctctgttgagtatgcactaatgttgggacagaccagtggtaggaaggccaattaaaaactaaatgcaatgatttaggggagagaaaatgaggatttcaactagtgtagtagattataggtttggacagatatgaatgaatataaataacattgtatcaaaaaattggctggaccttaaaaccatctggatgtgggaggtgagaaagaagaaagtaccaaggatgactctcaaattcccagccaaagtaaaaagccctgaaagagtgcatgggtgaaagatagtggatgtatttttaagacatgctgacttagtggtgctagtggaacagctaacattattatttcttctatacggcacacatttaccatatgttattctatttaataatcaaaacaggcttgtgagaagagtaagatcataccagttttacatagagggattaaggctaaagagaagtaacttgcttaaggtggcagaatcaccattggagaagaaacataaatattgtgttctttgtatgccatcattgcaaaaatctagcagattgttgaacataagaaactgaaattcttggctgggcgcggtggctcatgcctgtaatcccagcactttgggaggccgaggcggacggatcacgaggtcaggagtttgagaccagcctggccaatatggtgaaaccccgtctctaataaaaatacaaaaattagctgggcatggtggcgtatcctgtagtcccagttatttgggaagctgaggcaggagaattgcttgaacccaggaggcggaggttgcagtgagctgagatcgcgccactgactccagcctggatgacaagaacaagactctatctcaaaaaaaaaaaaaaaaaaaaaaaaagaaagaaactgaaatttgtgatttcctggtccagtgatcatttctaattgataccaatgaatccctctgatgaatatttcactggtatttttctaatatatgatacattcataagttggttcctaagctgtattttaagagaacatcatgatttagatttttcttatactaccaagaatgccactctgattctttatggaaactgagaccatacacttaagctctaggggggaggtaatgtaatgcaacctgtgtttctaaagcacaatcacactataaacagaccttgctgcaaaaataagtatattcagcacagagctgataaacctcagatctgtggctgaaatgatcagttgatgatattatagtaaacaccattaccaatgttgtgttctggatgtttttcttcaagctgtgtgtctgtaggaaatgactagtatcataaaccctcttgacaaaaaaaaaaaaatcacatttctgttttccaaaaagagttttttttaatatcataataaatgagttcttttgaattcatctgtgcttttctaaatattatcttctggcaatgactttgccttatctctgctctgctgtttctggagagcataattttgctacatgtatctgaagatttataattgcgcctcttaattggaaatcaaggcttggcattagttaacagttactggtgaaatggcccactgataaaaacaaatgcttacatttctagaataataacaggaattcttctctgaagaacccagagtggcagactatcacttcacaaaactttctcatttccccaaacttgtaataaagccagctcattgtttcttcaggctactaagcatcaagcaatttgttttctgtgttcagtctgtcatcttacggctcgctctaatgttcactgaagccctacggcagactttgggactactgtttttttaaataaacaattatggcattttcagatatggatattatcaaaggaatgatctaattgtccaccacagatttggatcagatagttattcctcataatacctcaagctgagactcaggaaactagtcctgcgtggggacatatgtcaaatgcattacaaaagcatcacctccttagtctaaataacgtcaccaccacccacccagttatgcaagcaaggaacttagacagtatcctttttacctccctcttcctcattgcccatatctaacccgttctatgttctgaaatagtacttctggattcattctgtcctgttgtatttttggatccatccatttttctctttctcaactaccccacttgtcagtccaccttgacattccacagtggcctcctcactgttctctccatccttcattcatgctcctctccagtgttttctccacctacattgagagcaatgtttccagattaactagtatatcaagtgagtcctaggtttaaaaacctgcaatcactttcattgcttttagtataaatatcaaaatccttatgcaggaccttgaaggctctacatgctctagccccactcacttctacagaccatttgttctaagtctcctcttctctgggaggaagagatcccctctactgagaatgcttctcttctcccatctcttcccttagttatacttttcctccaccttcatatctcaagtgctagttcctcagagaagccttcctcaccacccacacactcctggtccagggacctcccttcctaccttcctccctcccttcctccctttcttcctcccttcccttcttccttccttttctttttttccattctctccttctttctttctctctttctctttttttcctttctcaccattagctttctttcttcccattttctttccttccttccttccttccttccctccctcccctcttcctctttttcacccttccttccttctttcattttttctttctttctttgtttttctttcgtcttccttccttccatcattttttctttctctttgtttctttctttcttttgtctctctccttctttccttccttcctcccttcccttcccttcccctccctccccttctttctttccttccttttcttctttcatcctgttttcattaatttgttctttctttccatcatctatctttctatccttccttcctttcttacttcctccctccctccctctctctctttcttttcttctttctttttcttctattatctactatctatgtttttgtctattatctatccatctattcatctatctgtctatctctatatgtatatattcaatagaaccaaatctctgtatttcagatcacttatttctacttataatcttatatttattcatatctacagtcttaactctaggctgtaagctccgtgagaacagtggttgtatttggtattacttaattttatgttccatgttctcaagcctaactttgtgtctgacacaggtgagctttcaataaatattagtagaataagttaaagtgctttactgagctctgaatgttgatcaagaagtaaccactgcgaaatattggatgccaagaaaataagctatttaacatttcccagcaaatgattttcagtgaagcagtgaggatgggaaagacacaatccctgaagactgaaagaaatttaaaaagaaaatgggaaggcaaatgaaaagcacataaaacaaatacctaatacatgcagggcttaaaacctagatgatgggttgataggtgcagcaaaccaccatggcacatgtatacctatgtaacaagcctgcatgttctgcacatgtatcctagaacttaaagtaaaattttaaagaagaataaccagaaaataaataaataaatatatatttttttaaaacctgctttgtcaggtactgttacagttgatatagatgaagtgaaatctaagaagaatgtctaggcccaagatgcctagtgcttgcttttaactattttcattttttagccaattactaattaacagaggactagttcaggactcattggaatgtccaggtggctaagggactgcacagtgtttgcttttgattacaaaaacaagccctagctcatgcacttcctgataagtttggttctgtgtccccacccaaatctcaccttgaattgtaatgatccccatgtgttgagggcaggaccaggtggagataaatgaatcatgggggcagtttccctcatgttgttctcgtgatagcgaacgaattctcatgaggtctatgtttttgtttttgttttttgagacagagtctcccctgtcacccaggctggagtgcagtggtgcaatctcggctcactgcaacttctgcttcctgggctcaagtgtagctgggactacaggtgtgaatcaccaatgcctggctaacttttgtatttttgtagagacaaggttttgccatgttgcccaggctggtgtcaaactcctgagctcaaagcaatctgcctgcatggacctcccaaagtgctgagattacaggcatgagccaccacacccgcggagatctgatggttttataaggtgcatccccctacctttggcactcattctttctcctgctgccctgtgaagaggtgacttctgccatgattgtaagtttcctgaggcctttggctggattttggacttgcatggggcctgtagccccttcattttggccaatttctcccacttggaacaggtatatttaccccatgcctgtacccctattgtatgtaggaagtaagtaacttgcttttgactttacaggctcatacgtggaagggacttgccttatttcagatgagagtttggacttggacttttgggttaatgctggaatgagttaagactttgggggactgttggaagggtatgattgtgttttgaaatgtgaggacatgagattttggaggggccagggatagagtaatatggtttagctctgtgttccccccacccaaatctcaccatgaattgtaataatccccatgtgtcaaggacaggaccaggtggatataattgaatcataggggtggcttcccccgtgttgttctcacggtagtgagtgagttctcatgagatctgatggtcatataaagggcttcccccttccctcggctctcattctctcttctgtcaccctgtgaagaggtgccttccaccatgattgtaagtttcctgaggcctccccagccatgcagaactgtcagtcaattaagcctcttttctttataaattgcccgatctcaggtatttcttcatagcagcataagaatggacttacatacttccccaagacctcttcattgctgggccatcacagtaccctgaatatgttcttaaaatcaaactttaaaccagttagttgcttttaagctttttctatggtgtcttgtgcaccttacatcaaattcaccatgtataatgaattaaaaagtataactcctagcaacaactcctaaagagtttggagacttcttctggtggcatctctcttgctcttgtaccctctctctctttttctctattcctctccccaagtgtctgaataataaaatttctatcaggagtggattaaaagatacatctatcagttcaccaatttagattctataacaggaatgacaggcattaagacattgtatccaataatgtctgggctaacttttttgttgtcgttctcacatcctttccactgattaacacaaataattgaattaagtataatttcataagacatgaatgactgcatttcatcataaatcactcataaattcttttgctaaattgttggttttcaatttaggataactgaaggataggaattttaccttcaggttagctataaccaaaaatatgaggaaaaaaaacatgatctctgccagaagatcactggaagagatttagtgtgagatcttccatggaaagatcagagcaatacagactggctcaaagagagcacatagcctcagacttttattctaatgtataagaaatggtttttatgtactttgtgttcattgatacttattttctttcttggcttcagccaaaatatgaatgtaccctcagctttcctttttcatggcaatcattgattctaaaggcctggcacagatatgttcttcgaagggtgtgacctttaccgtcctgtgcgcatcagctatctccccatcccatacctgcatccctttaccagagggctttctctggtagactgtccttttgcatgctggagagtgagctcttccagaggcagccctcaaaccatgatctatgggagctgacagatcctcagttgtgtcatcccttaggtgacaaactgcaccatccctggagcatctcatggtgaagtcctggttcccacagtggtagcttgctcaacagtgcagcccttattggctcttttccatcctctttcttgctttcccactcttctacccgtattttctctgatcacctcccaaataaactatttctctagaactcttgtctcaggcttaaattttttctgcaaaagggaatgcctttggatttctgtaaaagggtctgcttcaaggagaaatgcaacctgagagagaaggtcatggttttcacaaaaggctgtggttacaatgagatttgaggcttaaatccaggcttgtgtaagactgttatgtgttactagttgttaaaatattgagtgcttttatgcttgtttgcaaatagctacttctcccaactctgcagtggtcatgaccacttcatggtcatccattccttcccatgattcaacaactaaagtttattacttgccacaacaggggcttctaagaccctcattaaatgctatgggcaccaactgtttgaatgattggtgtgcttgctatgtgaattattaaatattttaaatattatttatgtttaatgtggtgcccaccagacccagatgtaacgtacagcttttccttggacagtatagagaagaccttgaagttatgttcttttaactcagtctttagtatttctctgcatgaaatccttcagctccatgtccagttgcaccgtggtagatttgcagggaagtggatggatgaaagagacaggagaaggaagagaggacagaacaatcaatacttgatgatgaacttctgggaaactgcgagcatttccatttgaaacaaatagagtgtttcttatacaatagccatatgtatttgtaaacaataaaatgcctgctagtgtacaatggattgcacttctctgatattatacttatattcttggctctgctttttttctggattcaaaatattcataagaaatgaaatatggaaccaaaagtcacacatacatacacacacagatacattttatagtagatacttgctgcttggcccagatatgttttgtggattaaattctaggccccatgctggatgccagactcactacccatgtttagacccctagacatcagacatttactgcctggccctgtgctcccagctgcccatccaggtggtaagttttatatctcgaaaagctttttcaggctgatttcatggtgaatatgtgttaatcacctcagggagttattgagaatttgggataaacttgattgggtgaacaagcagcatgtgtccaaatatagctattcctgagctgtatctttgatatatttgatgatgcttgaaaacagtccgatttacatccatcgctgcattataaagaacagggctgaagatttataagttgaattttgttgcaaatgccaaagcatgggccacagataaatcagttaccagaataagggtgattttataacctgcatgtgttttatagtttctcatgacacaataatcataaaattcaaaaggcacactcttgcaagtgtgaaaaggcaatttcagggttccttttggtttctgctattgcaaggcaggatatagatacagtttctcactatttagatttgctattgaagttttagtggagtgccaaagatttcagtcagcaagtgtcagtaaatgatatcaacacagctccaagttcaaggtggaatcgtttcttgaaataaagtgagcatttggtgcccagaaatcttgttttaaaatacaccaacttctcagttttggaagagctctttattttttaaaaatagattcttattatgtaagcatacaacttttcttgtatgttcctgttgctcgtatttgtacacatacacagtgaaagttatttttaaatcttttattcttatctgtaactgctgacagcatttgaggtgtggaaacttttaagactgaaaaatcaagtaaaggaaaattcaagcaaatgaatacagaaaaacattatcattaggagccttaataaaactgctgtttagcttgtcacgctggcacattcctgtaatcctagcactttgggaggctgaggcgggtggatcacttgaaatcaggggttcaagaccatcctagccaacgtggtgaaaccctgtctctactaaaaatcaaaacaattagctgggcatggtggtacatgcctgtagtcccagctacttgggaggctgaggcagaataatcatttgaacctagcaagcagaggttgcagtgagccgagattgcactactgttctccagcctgggcaacagagcaagactccatctcaaaaacaacagcaaaactgctgtttaactccacaaaagtcattacaccactatacattcactaaaattgctaaaattaaggaaaaaaaaaaaacagtagtaaggccaggtgttggcaagattgtagaatagctgaaactctcatacaggggtgatataaaatggtacaactactttggaaaactctctggcagtttctaataaagttaaatatgtacttacctctcctatggcctaacaattccattcctaggtatttacccaaaagagatgaaacatatatccatataacaacttgtaaaagaatgcttatagcccctttattcataaaaaccccaaactggaaacaacccaaatttccaccaactggtaaatgaataaacacattgcggtataatcacataatggaatactactcagctataaataaaaatgaattgctaatgcattcagtctagtgatgaatctcaaaattatagtgtttttgaagagagctgaagagacacaaaatggaccatactctacacttccatttatattaagtttaaagacaaggaaatattctgcagtgatagaaaccagaatagtagctgattgtagagtacaagaggactgattggaaaggagaacattccagagagaggaagtgtattataccttagcctggatgatgattgcatggtcatatacacttgccaaattgcattgatccatatgtttatgatttgcattatttgtatataaattatacctcaataaaatgctgttaacataaaaaaattgcccagcttctgagttcttgcttaataatattagtatcacctgttgctgttctacgttaactcaggagctaaattcaaattcagtgtatgacaaaatcttatttgtgtgaaattactgggacgtgtacttttgcatttaagaaaatgctccaaaaaactgaagattctcccttcatgttagaaacttaaaaataaaataaaataaaataaagatttttttgggaggaagggaatcttaagttaaaatgtcacaaatctctcctatcatgttagtcacttttttcttgacttggcatttgcttggttgccttaagcctttgtctatttttcagagttctgacagagttgagtttgataatttttgctggttttatcagtgttttcgtggagaaatgggcccttggggctccctactctgctgtttttgctgacttcaccaccaaccctcatattcttaactctgtatccttaatagggttgaatgggtttcaaaaggcaaggtaggcaatggatcatgatactaagtcaatgataggagctttgaagtgaaagaggtgtttctaacaaaaagtagatacacactctccacctacactcctcttcctccatcatatcatacaattcagaagcaagaagaaaacacaaactcatagactgaggccatccaccactacctgaaatgctgcacctcactcaacatgggatggggcttcgattgttatgatttaagcacttctgaaaacacactttctacttcctgtttggtcttaagtcttccctggaaaggtcatctatctccatgtatttcctataaatatctacctctcttattaagtgttacattcaaatgtgacaaattaaaatcaagtggaaatattttgtgttaatgataaggtaaagccaactgtgtatgtcagagtagaatatggcatgtgctcttatcataaatattacaggagctatttgtttgtcagggcttcatcaaaacatctgaaaattgcttgacttggaggagaatagactataatttccatgtctgccccaaataatcagtcattgacaacttagaaaattcttatcaataaagatggaatcaattttttctattccacaaaatgtaagcatatcattttgagacaaattttaaaatcgttttagacttgacaaattacatgaaagagacacttagtcagaaatgattttttttaatgaagtgaaatttaataagtgactctgaatgtctgttgatgtgttgggaagcccatctttgcttgaccaaagatttatccagtaataatcaaaacatctaagttagtcttagaatttatatatatttcccatcctggctaacaccctcctcagcatggcagcagtaggaaagatggcggccacattctctctatgggtacctgattctggaaggagcagagcagaccttattaccaaagaattgtgtttgtctgttttgacctgaagagtccctaaaagtacttgccttcgttttacctaacttggaactctcttagggcagaaaagcagccatgtagaggacattcctccaaaacatagaaaggtaaatgaacaagcctctgccacttagggcaaaagatgatagttgttataaacaatagacaaccctaaatactggaaggaaaagctggagaatgagttactttagagaataattgctttgaaaaagattccttataatagaaaacctaaaaagtgatgcatatgcccaggataggacctatgctcaaaagatttgagaagacactaagctttcaccttcagcttgagatcttaaggcttcacaacagcaggaaatgaaggctaaggcagagttgtaaacagccaggctaggagagggttgggtgtgtgtgtgtgtgtgtgtgtgtgtgtgtgtgtgtgtgtgtgtgtttgctctaggcatttagggaaatctgccaaaccactagctaaccacaagctaacaaaatagagacttcagagtccatacaacaaaatatatagcctttaaaaatagtccggaaaaatgagcaaagtgtttgaatagacatttatccaaagagatatttaaatggaaataaacacatgaaaagatgcataacatcagtaatccctcaggaaatgtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatggtgcagccactgtagaaaatggtattgtattttttcaaaaataaacatagagttaccatataattcagcaagttcacttccgggtatatatctcagacaattaaaatcagggactgaaacaggcatttgtacactcatattcatagcagcattattcacaatagacaaaaggtgaaaacaacccaaatatccatcagtggagaaatagataaacaaaatgtggtatatacttacaatggaatatgattcagccttcaaaaataaagaaattctgacacatgttagaacatggataaatcttgaagacatgctaagtgaaatatgccagaaacaaaaggacagatatttgtatgattccactcgtatgagataactagaggagtcaaatttatagaggcagagtggcagttgccaggggatcatcagagagaagtataagtagttattgtttagtgagtacagagtttcagctttggaagatattaaaaagttctgaagatggatggtggttggtgatgattgcacaacacaacattttgaatttagttaatgtcactcaactgtacacaaaatgactaaaacagtaaagttgggctatctatattttatcacaataaaaaatagtttagaaaagtcactaaagaaagaaacaactccaacccacagcaagcagcaaaaataaaccccaagcagtggcaagaatctggtttctggagttaccacataataatattcaaaatgtcttgttctcaacaaaaaattatgagtcatgagaagaaacaaaagagtatcccactcacaggaaaaaaatgaacaactctccttgaaaaagcacagatattggatctactaactaagactttaaatcaactcttacaaaacgggtgattaccagagcctgggaaggataatgggtagggaggtggagggggaagtagtgaggcttaatgagtacaaaaacataggaaaaatgaataagatctagtatatgttagcacaagagggtgattatagtcaaaaataatttaattacacattttaaaatagctaaaagcatatcattggattgtttgaagccaaaggataaattattgagatgataaatatcccatttaccttgatgtgattattatgcattgcatgcctgtatcaaaatatctcatataatacataaatatatacacctactatgtatccacaaaataaagaattaaataaataaatataaatgaatcaactgttatatatactcaaaaagataaatgaaaccatggacaaagaactgaaggataaaaaaagaataaagaaaaatgaacagaacccaagagacctgtgagacaccatcaagcataacaatgtaaggggagtctcaggaagtgaggagagagaaaaaaaggcagaaagaatatttgaagacataatggttgtaaaactctcaaagttgataaaaggcataaatctacacattcaggaagcttgatgaactccaggtaggataaatacaaagacagccacactaagagaaattgtaatcaaactgttgaaagctctagacaaagaatcttgaaattagcaagagagttgcaattaatcacatacaaatgatcttcaatgaaattaataactgatttcttatcagaaacaatggaggcaagatagcaattggtatatttaaaatgccaaaacaggaggaaaaaacaacctgtcaaccaagaattgtatacctggcaaaattaagaaaaaagtaaatttaagaaaaaagtaaaatatttccagataaaagctgatagagtttttcacaagtagacctgtcctacaagaaatggtaaggagatgccttcaggatgtaatgtcagcaaactcgatagtaacttaaaggtgtacaaaagaaataaaacacactactaaaagtaaatacatagtcctataaaaaggcctattttattgtattattggcttgtaacccctcttttttctcatatgatttaaaagacagatatatcaaatgatgaataaaaatctatgttagtttagtttacatacaatgtataaagatatagtctgtgacaaaaacaatttaaagaaagagatatggagaatataagagcaaagtaattgtatactcttgaagttaagttggtgttaaatcaagccagattataagtttaagatgttagttgtaatccccaggataactactaaaatattaactataaaatatacagaaaaagaaatgaaaagtatacttcaaaaatcaaacacaaaagaaggcagtaatgggggaattgagaaacaggaaagataagacatatagaacacaaatagtaaaaatgtcaaaagtaaatcctttctcacccataattacttttaaatgtaaatgagctaaactctccaattaaaaacagagattgtcagattaaaaaacaacaagaagattcaagtctatgctgtttacaacacattcactttagctccaaagatacaaacaggttgaaagtgacggaatgtaaaaagagatttcattcaaattctaaaagagaactagaatagctatactaatatcagtcaaaatagaccttaggtcacacatgctacaagaggcagaggacattatgtattgataaatggggcaattcatcaagaatataaaacaattgaaaacatatatgcacctaagagcttaaggtttgatatagaaaagggaatgagcctaggtcggtcttgtactaattcagtttaatttacctctctgagtttcattgtgtataactctgcaaatcctctttttttataacatagaaattccttcctacctttctttcttccttccttcttttaggaggcaagttttgagtacctacttttgacaagccctgtgctaagttctggagatacacatctcagtaattatagcccctgtaattgtagactttatagtccaagtcagtagctttcaaattttagtttatatgagaatcccctgggaggctgatagaaaatacaaactactgagcctcacccaatgtgtctgattcagtaggcctggagtgaggccctaagacctgcatttctaacaaacttccaggagatgctcatgctgctggtttgtggaccgaactttgagaactacccgtctaagtcatggattctccattttggctgtacattgacatcacctgtgagctttaagaataccaaggcctaggtctcatcttcagacttaaattgcttgggagttgcctggtcatctggattttttttaagcttctcacatgtttctaatacagaactaaagctgagaaccacttctcatttctggctgcttattacaaccacttggaaaggttttaaaaaaaaatactgatgtctagaaagcattatggattaatgcaatcagaatctctgagaattgagccccagcactagtattgttgaaaaacgtctagtgttgttcaactaatttgaaagtttaaccagagctgaactccatctaagcaaaggtaacatacaatgagtgaaggagagaggtaattttaaatgtcatctttttttgtttgtccttttaaattatcaagaagcagacaggaacataaatggaaaaccaagtctcccataacctaccactatagtatgtctattataatcatacatttttcctatccagtctttgaccatatgtgtgtatttttatatggatcatatatgtgtaatttgagattctgccaaaaaatttctttaagccacagaataaccttttaaaaataataagtaaaatgggtggcattgtcggattttctccatgttcactgaggaaagataacaagaataaacttgatctcagcaggataatttaggcttgtaactggaaggaccttcctagtcagcagaattaaactgctcaaggagaaaaagtggtgataaactaggatatggaacgaggaatcaaagtcctatctagaagccagatgatgggaaaatggccacagagagatgatctgggacttggcagggactgttccaggtagaatgctgaagaccgttagtggagagaatttgtctcttcatctgtatttcacttagaatctcctgtgtgtggttcaacattttgtggtggtttgtggatacactttctagtctaaaggaatagaactagattaatattttctattgtaaaatttagtatctttaacttagaacataatataattatgaaccgtataactaagttttgcaactcatgcagggggattatagataaccctagagcactcattctttatctgttctaagatagtcgggatatgagcagttgaagacattcctcttagttaatccaagtgggtgccaagacccatgcactggagagttgaaacaaaatacaatgagtctgaaatttcaagcagaagttcaagcgtctctttctattctgtcttgatacattgcattgaaagaactgctatggtttaattctatcagtgaaaataacagggtttgtgatgtttttaatttatttttccctccccacattaactttcctcatttgtgtttggtaaatttgcttcaactgctcaatttgcatgaggattaaatttcattaacagatgcaattagaaagtggaatttatagaataagtcttctttataccctaacctaattgacataaggattaccgatgtaattgactagaaatcctttcaagatagtcaagctgacatttaatagtgtttttctctataaaattaagaatgttcactacaatctacatataagaactaataagcctattccctccacccatcacctaaaattatagagctaggtcaattttatattcttgcagcaaaaaactcccctggcatgaggttgaacaaagtctagttaagcttgctatttttttccttttagtagaccctcccttgagtaaaaaaagatagagaagagcaaacggtcttcgctaagtgaactcatagcttagccaaagtctttcagagctgagtacggaggggctgcctcagtgggaagcagaaattaagacctgctcctccatacatcctacttgcatctttagcctcgtttctttacagcagttgtttgcaaccttggctgtacattgaaatcacctggagcaccttaaaaattgtaatgacaagaccccactgtaggattctaatatacttgggctgagatgcagtccacactatgtgagtgtgaaaagctgctcagcggtcctaatgtttggtcgtggttaagagctgctgctttacagtaagcagtactttgcctgtggccaggtaaggcaaaaatgtgcctggggactttgggaaaaagaagcaggttctctcagtaaaagctgtgctccggcagaaagccggttaagtgttccttgctgcctatttaagaagtaacagtgccaaggcaatcccatttgctctggccatgtgataattaacaattgatatttgtgtgaagccagcctgcctaacagaatggtgtgcagtctttcagccaaacagtacactggcgctcctctgtggacttaaaattgcattctaaaaaagtagatggcatttttaataagcaaaaccccagtttaaatataaccaactgaaattataagtaatttggtaatatgacttcatgtgggggtcatcttaacattaataatacctgaaatgaaataatttctaaaatatttctaatctcaaattactacctttggtgatattttgggtgatagactatttttacaaactagaaaagattctaaatcaggaaaagtacataactgaggtctggctttttgaagcacacactcactttttttatgaaatacctgtttgctgaccatggtgtaggccattaatgtcattacctctaccacttgaataaaagtgaatccttttgtagcttatagtgtgtaaacctatgagacttatagtatgtagatgtatgatactgacagccaaaacagtatgcatattatgataaatcactgggtaataaagtagccaatttggaaaattctcaattggagtagtccttgtgtgttggcaaataagacttgcatttatacagtgaacaaaaaagtttgcttaagaattaggagcaagtaattgattttttaaaaatgatgtggttctggtggaagtagtatagccctaccaagtagaaaaaaagcaatcaatttaattaaaaagtctcagctgaaaaaaaatttagttcccatctatagacaggggctctgtccttagatacagcaggaagattcaagaccccatcatctctctcctcccacttctcaacctcctcttggtgtgtttcattgtccaaactcaaaaggaagccaggaggtgaaggctggctgatgcggttcagagaagtttgtctcctggacacagtgcaatatggagaagctagaaagtaggtctgaaaacagagacaatttgactttttgcagatgacatgattgtatatttagaaaactctattgtctcagccccaaatcttcttaagctgataagcaacttcagcatagtctcaggatacaaaatcaatgtgcaaaaatcacaagcattcctatacaccaataataggcaaacagagagccaaatcatagtgaactcccattcataattgctaaaaagagaataaaatacctaggaatacaacttacaagggatgtgaaggaccccttcaaggagaactacaaaccactgctcaaggaaataagagaggacataaacaaatggaaaaacatcccatgctcatggataggaagaatcaatattgtgaaaatggccatactgcccaaagtaatttttagattcaatgctatccccatcaagctaccattgactttcttcacagaattagaaaaatttactttaaatttcatatggaaccaaaaaagagcccacgtagccaagacaatcctaagcaaaaagaacaaagctggagacatcacactacctgacttcaaactatactacaaggctacagtaaccaaacagtgtggtactggtaccaaaacagatatatagaccaatggaacagaacagaggcctcagaaataacaccacacatctacatctttgacaaaccttacaaaaacaagcaatagggaaaggattccctagttaataaatggtgttgggaaaactggctagccatatgcagaaaactgaaactggatcccttccttacaccttatacaaatttaactcaagatggattaaagacttaaatgtaagctctaaaaccataaaaaccctagaagaaaacctaggcaataccattcaggacataggcatgggcaaagacttcatggctaaaacaccaaaagcaatggcaatagaagccaaaattgacaaatgggacctaattaaactaaagaccttctgcacagcaaaagaaactaccatcagagtgaacagacaacctacagaatgggagaaaatttttgcagtgtatccacctgacaaagggctaatattcagaatctacaaagagcttaagcaaatttacaagaaaaaaacaaacaaccccatcaaaaagtgggcgatggatatgaacagacacttctcaaaagaagacatttatgcagccaacatacatatgaaaaaaaagctcatcatcactggtcattagtgaaatgcaaataaaaaccacaatgagataccatctaacaccagttggaatggcaatcattaacaaatcaggaaacaacagatgctggagaagatgtggacaaataggaacaattttacactgttggtgggagtgtaaattagttcaaccattgtggaagacagtgtggtaattcctcaaggatctagaaccagaaataccatttgacccagcaatcccattactgggtatatacgcaaaggattataaatcattctactataaagacacatgcacatgtatgtttattacggcagtgttcacaatagcaaagacttggaaccaacccaaatgcccatcaatgatagactggataaagaaaatgtggcacatatataccatgaaatactatgcagccataaaaaaggatgagttcatgtcctttgcagggacatggatgaagctggaagccgtcattctcagcaaactaacacaagaacagaaaaccaaacaccacatgttctcactcataagtgggagttgaacaatgagaacacacggacacaggaaggggaacatcacacactggggcctgtcagtggttggggggttagggcatggatatcattaggagaaatacctcatgtagatgacatgttgatgggtgcagcaaaccaccatggcacgtgtatacctatgtaacaaacctgcacattctgcgcatgtacttaaagtataataaaaacttaaagtataataaactttattatactttaaatataataaagtattatataataaagaacttaaagtataataaaaaataaaaaaaagaaagtgggtctgaataggcaaacagaaatatatggtatatctgtttaaccaacagctttcctctcctttctctggaaatgtaaccagctagaagactggagtagccatgtgactaattctgactaatgtggtgtaagtaaaagtggcaaggtaggactttaaggaagattttttttctcaagaggatatagaccccagaacctgtgttttgtcctcagtcatttcctccttcatgatacctgcaaaacggaggtgaagattgaggttccaactgccattttggactggatttaggcaaatttgcatttggatgtcattgctaaggatgggagagcagaaatttacaagaagtgtgtgcactagtgactaaagccaccacagcagcgctggattcctcttctgaatttattccctgtgaaggaaaattaatcattatatattaaaaaaatcaacagttcaaaagtttcatctcattatgtatttgctatcaattatataattaaagtatgatgtaggaatttttaaatcatcgcttttaaattttaaaaattagttctaagaccccaaactatgtgcaattttacaaagtatatttgactgccttacaacaggctactatctacttaggtattgtgcttacttcagatgaaaattgtgccttatcaacaggtggaaacaatcattaaatattaaaaatatttgcttaatgtagcaagtgaatgggtggacgaatcatctcagtttctatcgggttttcagcatgtgaacctagtgtttaccttgtcaaaaagttgattgtttctaataagcaggataacagatattctagcaccttcaaagtcgaacagagctgagaaatgaagtgtgacttatcctgtggaatgtaaaaaacaacattttttaggaagcatgtgaatatgaatgagaggatgatcatcatttaaatatcaccaaataaacataacatttctgttgggcatcttttgagcagttagattttccatggaatatgttccagctttgttttgcttggttggtaatcatagcactgaatttaataaatagatattattgaatttccttggaatgttcctggtgttgtaacataaatttagtgcttaactggctatgatatatggctacatatctatagtacttacaggtggtgaagtctgttttaggttttctgcacttcggttacttagcttgagctatcttgagattataaatcacttcttttttttttttttttcaaactacacattcatgacatacagcatcaacagaagatgatttattctgtgaccctactggcaaaagaatatattgatactataattttgctaggtgtcatttgttcttgagggttccttgtgttggtatgcaatagcaaattaatccagaattgcaaggtagaaggaaatataacagaactcgtaattctgatcctgagtcagttagctgaataacttgatcagatcacatctaatttttctcaatgagagcactactggcatctcaggccattgtgtgatattggcctgggcactggcctcacaaacactgcaaagcagtagcactttcagccagttaaaatgtcacggacttctgcagcagcctcttgatttgtgtgttccagaacttgagctccagggacgatgggccaagtttgggagcaagtactagagttttaacttaaagttaaaagcggaggggtgctaaaatgttgactctgatacaggtctgtggcaatttaattccatttccccctctgtcttgaaccccttctacttgaccactaacagtttttagcctaaattatccggatacccaagtcttcacttcattctcccctgtggacaacccaatgcctgggaacatgatgttcataagtttagtattctccaatacatcaagatcttgatggaaaatctctctaaaatagtaatgggaaaaatcttccctccaaaattccaattattttgagtgaacatcatcatgcatataaaaccaatgtcactggcatgcatcagaaactttaatttaacataggttagcaataatcattagtagtcgaaacttcattgctgatcagtagtgggatggtgcctgtgaatagccactgcactctagcctgggcaacatagcaagactccaactctaaaacacataaataaataaatactttaaaaaaatcattagtaggtggtatgttccttctctacttaaaagcaaccaatgttgaaatgtccatttgaagttgttaaaaatttttaaagacatgacttagaaattgcgacttagcaactaaagctgtgactttgaagtcaatttatactttaaagggaatctattatcagttaagttttcagatctcataaccaaattggaaatctgaagaagtcagaagttctaaaatgcagtgttttgaaaggacattgatatatagttgtgatattgtcttagcaacacatttttctttaaaagaagaatttcttcttgtattatcaatccttaaaatgggtcatgtattcttggaaaacagggtattcatgcaatctttaaaacaccgtctaaacttcaagtgaacttcaaacagcccaaaccaaatatatgctggataaagtgtattgtggttactggaaaactttaaaatatgaaacattcctattgctgttggtattttacctctgagaattttctagccaaagttctatttgaacagaggtcaaaaatcagttactgcgtgggcttttcttaagggatgaatttaatgaaagggcctagttattgcaacatatgctgccttcatttcaaaagatttccttaaagcataatgattaaagcctgtggagaaaaaaatttgtacttttcaaaagctccatgaagtaccccacagaaggaaaaacaaagttctgaatccacatatagaatgaataaatattccttttagcttaaaagtcataaaaatcattagttatttttgctcccttttattgaaagtgttttaagagttttaaaagaccagtgtacactgtatcaaatattcctgcttatttccaaagaaaagtgaactgctttattttgaatttttttttttctttacacagagtagggaagaattcaaatgttcagcaagtattcttaagcacctaagtcattgcactaaagtaaatctcatttgatggctctcttaaggtggattctctagaaccaaagactgagagacacttttgggtacaaagagtttatctggaaggtgatgtcaacaagcaccagtacagcggggagaaatagagagaaggaaaggcagcaaggcagccaatatggtgtgagttaacaagcaggttactattgtggacaactggaagctaatcccactggagtattggggatgagaggttataacacagatcttactgttatcccacatgaggggcaagggagcagaggtagttatccaccaacaggttttgattgatggatgcatctggtttgtaagggagctctcccttgaaatgctctttcattcaaccactgctgctcatcccatacttgggcctactggacaccagcaagagtgcctttaggcagaaagcttcagttgtttgcctcgaaagtcatcgtaggaatgatgggaactcagaaaatattgccaggacactgactacatctgccacggtgaaaagctgtctctaaaatccaactacaaagtaaacaagtatttccccaaaagataaatgttaatagtaaaatacatatcagaaattatccaaactgtctagtaatcagaaattaaaacaggattaatccaaattgaggggtatttaattatcaaatttttataaaactgtgataaagcctaatatggcagggtactgttggtactaagaatattatttttaaaagccacttggcattgtgtttcaataggtaaatcaatgttcacatacactgacctaatgattaaatttctaggatataagtatgaaagaaacgaaataaaacttgaagagagtgacaatatcctatgtgtccacaaaaatagggaaatgattaagtagattatagtgtatgcaatcactgatatttttataatcaataagattagggttgttaaggtaagtattagcatgaaaataaatgcttatactgtaacaataagtagaaaaatgatgcacaaaagtatacatgcattccagttgcagctatcttatttttcaacagcattaaaaactactggaaggaaatacatccaaaaggctaatagtgattaaaatttactaccagtgtcaattacaatgttttatttgcaaggaacagaaaatccaactctcactggcttgagcaatgaaatatatttcttcatgtaactgtgtaactagaaagcccaagggttgggcttcaggtttgaaccagccagcagctcaaccaggtcattaaaggtctggttgtttctcttcactcttccttaatgtttgcttcatgccaaagcaggctgtcctcttggttgtcattttgatgccaacagaaactagaactagaaactagatgcttccatgctcacactgagggtcagaatgagggcttttatccctcaaccattgaacaaaatttcagaggtcatcttactatcagctacaagcctgtcggtgaacccaaaactgtggctgggggataagattggttgtaagcagatcagggcacccctctgcaacagtggtggagtcaattcccctctaagtctgtggcttccacccagtgaggaaggtagagagtgggtgaagaggagacaatgccaatatctacggtaatatatgaatatatataggtatatatgtcgtttttgcatgtgggtgcatatatgtaaagatacatatatacgaacacacccatcaacagaggaaacacaactgcacttaccacgctgattaatttttttatttactcattcagctgacacctactttgttccagacactatcttagagaccccagaaacaacaataaataagacagttaaggtccctgatctcacgcagctgacacctactttgttccagacactatcttagagaccccagaaacaacaataaataagacagttaaggtccctgatctcacggagctgaaatcccagtgaaggaagacaggcaataagcaaatgagttcatgatcaggaaaaatggtatgaagtaactaaagcaaggtgccagttggagtaaccaggtgtattttgttttcttttgagtggttagaggaggactctttgaggaggagacatttaagctgagatctgtatgaaaagaagagccatccaggcaaagatcaggggtctggagcacacagagaagaaagctcattagtacaaaagggctttaaagtcaaagtaatcctgggattttggagaaatcacaagtcctgtgaagcagagccatggtgtatgaaaagtggaatggaataaagagagtgtggaatggtatgtaggcaccaggtcatgtaaaactgtggagacaatggttggaatttgggtgtcatgcaaagagcaaggagactcatttgaatgtttttagtagaaaaagggaaatacctatttgtgttttttagaaatctgtttgggaggccaggcatggtggctcacgcctgtaatccctatcccagcactttgggaggctgggacagagggatgacttgaggtcaggagttcaagaccaacctagccaacatggtgacactccatctctaccaaaaagacaaaaattagatgggcgtggtgccacacacctgtgatcccagctactcgggaagctgaggcaggagaatcacttgaactcgggagacagaggctgcagtgagctgagatcatgccactgcattccagccggggtgaccaagtgatactccgtctcaaaaaaaaataataaataaaaaataaaggatctgtttgaggatggtttataagatggcttgtggagagacaacaggaaattcaggcctgtacttgtctaggcaagagatggtgacgacttgaactaaagagtaatagaggattgagaggaatggaaggcctgatgtatactgtgtggagataatgccctatgtcctactgatggagaaagtcatggaataaaggctaactcaattattttatgtgagcaactggtgggttgatgggctgtgaccaagatgaggaaaacgagggaagatttggaaagaaagggaagaactaagaacactttatggacatttaaagctcggggtgtctgttagtcattagggctgattacatatttgctggcacactccaaaagtgaaactgaggggcccttttccaaaaagcaatgggggaagtgccaataaagatactaaaatagaacacttttctttcttctgcaatctctctcttgactggtaatggtatttttttaaaaattactatttaatgtcattctaagtaaaaaaaaattaaaattgtttattacgagttttaacattcattcttacattgtgcaatgctattttcagcaaataaaatgccattttaatcatttaatttatatacagaatcacaaaaattatacaattcacatttcatagatagtacatgcctatgttttttgttcttatcaagatagaggaactactgtacaaaactagtatcattgtttttattttacttcttgatacatgaacaccctaccagccttctgtaccttcagcttacttatgagaaaggaaggactggaaagaaggggaactctgggttgttccatctttctcactttttctatgtcattatattcagtgtaatggttggctaatagaaataacacataatgattaggattattggtgtttcatgttttagaatgctatttctgcatttgaagcaagttctgattctaatggaaagcatgacttttcatagatgtgagaacctggagatgtaacacttttatcatgtagttggtttgagcctcattgaactctcattgtggatccatggacattctgtgcacccgagcattgcaaattcaatatgtgagcagggcagcaaagaacaatggacatgtatcttgcacatatctcctctgcttatgtgcattctccattgttcgatcagacttcagttacaaaacacaagctcaaagataaaatgatggagaatttcaggacaatgactgcagaacattaaactaagcatgggtccttctgagtactgggccctgtgtgactgcagaggcctcacactcatgaagctggccctgcattcatgtggaaatgtgtaaaaaatagatattgaagtcgggagagctggtgaaaggtcatttttggagatgtaggcttgggaattattagtatttatatatttaatatttagggcatagacagggtgagaccacctacagggagtgtgcagatgaagaaaatttctcagaaaagaatcctagacactccagtaacacaaaatgccgtggacctgaaaagtatattgagaaggaatggccagaaaagtaggaggatagcaggaaagtccaaaattctaaaacccattagaagacaatagttaaagtagagggatatgatcacttatcttgaaagctactgagatgtcaagcaagatgagaaaggaaatgtcattattggatttgccaacataggggtcattggtgaccttggtgaatacagcctctctagaaaaaggaggacaaacattcaagtgaatattcaggagataatgaatggtgagaaaggagacagcaatgttgacaactttttcaagaactttaactaggaaatggaacagagaaatggtgctgtgtttgccgaaggatggggtatcaagggaatgatgtcaatatgtttggcagcaattattttcaatgctgcatactattccattctctgaacctattgtaaactatatattcatgagtgtttagtatatacacatacctctgttttgcaaagcagtttgtcatgctactaccatcaacagggacaagaggtcccaattattcacattctaattcaaagtgtgagactctggccaaatgatccttctgacctctctgtaaaaagaccaagttctaaatgactttggctttcactttgatctctgttaatcaagatttactctgagctcccaaaggcataaagagctttttccttctggtttcttgcttctctccaagcaggactttggagtatcagtgggtgattacagtgatagtttccttcatggctttcaggccatgaacaaatgaaaacagaacaaaaggccaagaattccatgcttctgtaagtctgttatttcagggtaattacacatttacatttttgcagctagcagctgatggacattgtgcaaaagggaaaaaaagataaatgtagatttttttaaggttttctttatgactttgtttttaaagactactttgtgtttgaaacatacaaattagagctcaaaagtttccagcaattagtttacacagcaaaagagaaggaatcaaggccaaagaacaatcttatttaaaatgctgtggttggcctggcatagtggcttatgcctgtgatcccagcactttgggaggctgaggcaggcggatcacctgaagtcaggagttcaagaccaaccaatatgggtgaaaccccatctctattaaaaatacaaaaattagccaggcatggtggcgagcacctgtaatcccagctactctggaggctgtggcaggggaattgcttgaagacaagaggcagaggttgcactgagccaagatcatgccactgcactccagcctgggtgacagagcgagactccttctcaaaacaaaacaaaaaaatgctgtgtttaagaagagggtatctgaggatcatggaattttagtcacagaaaaaaacagaaatactaagtgtttattattcttaatcagtttcatcacatgtaggtcctgagtcaaggacttgaatgaaaatcgtttattttgaagaagttcccagggaacagcattagaagtatgtcgaagggaggaagggaagtgatgtagtcaataaaggatatgttatcaagccattactactgtgggcaaccagagtcaatcccactggaaactgggaggcatgatcaaatacaagcctcagagtttccccactggaggtgcaagggagctgggatatttatccaccaactttcttgagtcattggttgatggttgtttccaggagacatcaactctcttgcacttccagcctgttaggccttaagcaggctctggccatggaaaaatcacttcaacagaaaagatataaaggctgatagttagaagtcgagtccaaattcaataagatggtaaagagagacacagctggggaatcaacagaggcctgtaatcggtatggaagggacaatagtcgttaaaacaaagctccctctgtacttgtttctgacactaatccaaatgaggacctccaattcccccttaggaaatcatccatttagtccaacccatagattggcttataaggacatggaggctcagtgatacttagtgacttgctcaagggtgcacagatgcagtagagaaattggacatcttgatgtattaatatgtgagtttgatgaacatgagtaaaatgtgtcttcaaatatttagacagagagaaagaaaatagctgtctgagacattcaagtgaagcatttcaaatggaaacttcttagcttatacttagccccagccagactcagaaacagatataggcactagactagacagcatcaacattccaacaggagttttcccttcaccgtggaagattattattgtgcccacagaaaatgtctgtgcatagacagagcccatatgactcttgcattttctttcctgacttagacataaatttggcaaaggagcatcatgcgaagtggacagaacgttccttttgtcctttgaactagacaagaatcaggcaatgaccctgccttagcactttatttagagatgaattcccccgctctagggttttggtggacaggtttatttcactgtaagtgggaaaattcctggctgtttctcacctcaccgaagagtgctaacagagggattcccattgatctgatttgtttgcactgtaaggctggattcaacttcagcgtgaaatcatcttgcaatctgaaataatcttgattggatttccgtttggattaacatcacgtaagagttgatatccactctaccatcagagattgtggtctatgctacttcttttgtccctttgttttatataagtaacgagcttggagatgtaaatcagtcaccattttaaactgattgatcaaactcagtaagaaataaaaccttttcatggaactcactcagccttcaaacatttgcaaattaactaagtcataagtactctagaccaatttataaaaacacagttaaaatatctcaattaaaatcatacatactcacatgttcaaataaactgcaataagcttctataaaattgcttagaaaatataatttctgttttaaatttgtaaattatttcccaggtcatcaaattaataattgaaaaaaaccttctaataattggtgggtatttctgcctaattttcattaaaagtggtagtttagtctgtcctcctgaagcacttaacctgattttatatcttaataaaggaacactatttaggagtttggggactgtgctatgctgtgaaagccattccttggagcccatttttgttattgatgaaattcttccagtctgggatgaacaaactgtaaagccataaataaaagaccaaggagaagaaagacactctgatcagacattcctaattctaaatatagtttaagaatctgtctcctgttcattttagcaaaaggtttggagataacatttcacactgacatatttccatacaatcatttaaatttattatttccagtttttagtgtaaatatacatatacacatagtctctctttatatataactaaaaatctaagctcatcctagaaatattttgggaatatgtattttataaagaaacagaatcagaatataatttgttactcatctctctttccaaaggcaacccaagttaatttcctggaatctctcctagtagtatttttaagcattcatttgtcttttatctagctggaattaagttaaatgtgggattgtgtttcatgccattgttttatattgtaagatattaaaacataatatttttaagttgtagccatcaatttaatgattaactacacaataattcatacattacctacatttctatgagtttttcaagtctacgtgtgatggtgagacctgcatttgagataaggggcaaaccgagtgcatggaaggaggtacagaggtaatattagagagctgaccttaatcctgtagagccaggtcatgaaaagggagtagagaacctcaagagaagagcagagggagaaagaatgtgagtttgacgacaagttgcattaataaaaaaccaacaatcaagtcatgtattatttgtagacatacaaaagataaatactttttaagagtcttgaggccggatgcggtggcccaagcctgtaatcccagcactttgggaggctgaggcgggcggatcacgaggttgggagatcgagaccatcctggctaacatggtgaaaccccgtctctattaaaaatacaaaaaaaaaaaaaaattagctgggcgtggtggcgggcacctgtaatcccagctactccggaggctgaggcaggagaatggcgtgaacccgggaggcggagcttgcagtgagccgaggtcgtgccactgcactccagcctgggcaacagagcgagaccctgtctcaaaaaaaaaaaaaaaaaaagaatcttgaaaataacaatgttgaatcataaaagcatttcacattttccttgatgaccttctaacttaagcaatcttaactggcaaaactaaaaaatcaaaatattaataattcccccacgatatgtgtcctagtttagtttataagtcttggcacttaagagatctaatgagaacttacatttaaaacatgttttaaaataaattttaaaagctagagataaatccatggacagtaaaccatgctagaggtaaatccatgggcaataaaccatgccagttctcttttctgtgctaattattagattatcaatgcctttatttttctcccctttctgtcttcctcttttgattttgttttcaatgttaaaatgccaaggcacttataatgcttcccatattaggttttcttctgaaaaccatttgtccttttctgtataccagattctcattataactgggtctgtgcgtgtgagctgtggagcctccacctttgtaaacaagcctaaaaaaattgcttctgtaactaataagcctgatgccttcagcccatagggatctctttcatctctgttctaataaaacttactagcaattaactcataatcctaacctctgtaagcctttgtaatttatttttggtatactcattcctttgtcttcactgcttaataccttattaagaataaggactatgcaaacttttgtgtgtgtctttcagacaccaacccagtatttggcacataatatacctgccattaattaatatttttgctgagtgagccaacttcctttggatgggcatgagataaccacttctgtataatacattctctccagggcaattaaagcagtttttcagtgtgtgaaggttgtaaatgatcaactctcaacagtccttgatcttttaaagcacaatgagtgaaggaaacaaagctgttgactcataaaaatgaattaataaaaagtaacctctcctaagtaagaaatggaatataaaggatgagtgttgagtgaccacaagggccataactggaagttgtgatggagaacacatgtgagttatttgcaagaagagtaaacatattaaagatgaaaagctctgtgcaaagaatagtcctaaccaatactgtttaaaggactatccagagtacagacgatagatggaattcttagggaaacagcctgtgcttgttcccccaattatttctctgggctttgtaaacactgcatatttagtgtttgtccattaccattcggggtcattacaaaagaactcagccttgacctggattcctgagaaataaattacagcttttcttattaccttccagtagaacttgaagcaataattcaaactctacgttaagtcatcatatatgatcacaagtgagtatgttaataacaaaatggatattcatatacagacccgagtaaatttctgatggcagtcacatcttgataggaataaatactgattcattacaaattacttaataaatgtacatctggattctcaagcattataacagatgatagaatattaatcttgtttgttttcagagcacttctttttctttaagttatacttgctgctatttacttcgccagaagactgattgcattattggccccaattcttcatcattactacctccctggatccatgcccttagacatgtaactttataattgccttctactcagcaatgtgacacattgcaaatgagatgttggcaaatgtcacatctacagagaaataaaaagcagttgtgcaattgggcttgctcttagggttgtcctctgacactgccatgagaaggataggcccaggctatccggccagaggaggaatcacatgggctagagctgagtatccacagttgtctcaaccaaggcaaccctagataagccaacagcaagtctaccttcacacatgtgagcaggctcagtcaaggcaagcacgaccatgcagtctacccatacaagcgtaagctaaacaactacttattgttccaagcctctacatgttgggttagttcgttacatggcattagtatgaaaatacctaactgatacaccttgatttctcaatattcaaatataattgcttcttattaatcctaagtatagaagcatatggacaatgactagaaagactttgagtaggtcccattcataggatgtgatatcaaattaaattaaaaatacaatgtatttttcccacaaaatgctgagaaagtttgaaccattctgtcttcatttttttttcctacactaagaaccaggtgactatagaagagtctagctggccttatattgggttctctaggattatgtatggagggagcatgccgtgccacaggggcccacatagggaagcaccaggatcatcaggagacagagggagcaaggggaaaaatgtgagcaaggtcttttattgttgtttccacaggaacaaataggcaaggtaatgtaaggcaggcttaggattggcttgtttgaataatttcagcaggctctggggtgtaggagctctctctattgtctggtacctggccctgggtgatggagcagtagaatattggccctgagtatgacagcctaatgagaaggtggtgggtatgtgggctctggattggttagtttgtatatgacaggtgttgtccttgttcactgtctccaggaattagctagccctcagtggggcagtgcttccagtgtcagcgaactccaaactggggtggccccacatgtcaaagcatcaaaaatacagaaaataaaaaggcatgactaatacaaccttcccttcaaaaatacactcctaaggcaataatatattactgttcttagagagaaaagttaagggagttgcactgtacttaaagtcatgtagttacgctgtgataatgatacaatgaccacaaaaatctcaaaatatttttaaaggaatcctcagtcttatataaagtttgcagtgttaacttcttgctatactgtcctctttcgagggttttctttccaatgatcaacattgattgatgtaggaccttcttagcgttctgctaaatatgtgggaaaaatacatggcgtgtttcctgaatttgtggaatttttgcaggggaagcaataagagagaaatagaaggcaatgtgaacttaatatgctttaataatgatttactgcacaactactgggtgctaggcactatgataggtgctgggggatttcagtcaaatgccatttatgctttcaaggaactcatagtttaatgagcacaaattatatgaaaacaaatgattgagctatggtgagcagtcaactctgttggaattagtcagaaagcttcagggaggagatcatcaaggtgggccttcaaggatgagtttgacacagggctgtaggtgacacttcgggcaaagggaactgtatgtgcaaaggcacagagtcaggaattaaagtgtcataagaagctacaaacatttcctttacaaccaggaactggggtgtgtgtgggaaagtggtaagacattaggctaatccagaagcaggttgtgatcaaggaggagctcaaagtctgtactaaggagttagggctttaccccactaacaataaggaacaattcatgagtcttaagcagagaaataatataaacaacctgcctgcttaaaaggttattcaggctttgctatgaaggactttaagttctctgagggtaggaattctatccatctttttcacaatctgtaccccagcacctagggcctggcacctaggatgtattcatgtagctgagaacgctgtgctacttaaatgttccaatgctcccccgtacttcctagttctctttgcagttagactggagccctgtgattagttctgtccagtggttataaccagaagtgacttggcgaccatttggatataggaggtgaaggtgaaaagtgaacctaggatgacatttgaaatcttgcttggggtggttcagaacaggttataaggaacaagtatgggacaattttggatgtcctgagttcaagatgactgtgagatgaagtttttaattagaatagagctaaatgttacaaggtttgacataggcaacagttactatgggaaatcaggaaggtaaagtattaaacatgtagcactttgtgggttctgctagagtgactcactatccaggtttgcccaggactgaggagtttcttgggatgcatgaaggactgtcaatgccaataccaagagagttccaggcaaaccaggatggttggtcatcctaagcctgctataccttaccacctgcaaagaatagctattgagtatttctactctgaattcagaagtttgtattcctccgaacctctgtatctcaactaccattcagttgtatggaaaatgaatccaaattggccagagtaggcaagaaagtataaattctgtaaaccagtgttgtgcgagaaccaattcacaccagctcacaagagctgattttactcatttcttcacaactctacatttgctgagtcatgcgaataggttgcagttggccatggtgggagaattgacactatggaaattagcaagttctacatattagagcttctctcccctatccccaaccccagaactggttgttaaacatttaccaggacacctctgccataagctgagttgaaaaggtttggaagacattatattgtggggatagcccaatgtagatgctattggtacctcaccctgcatccctttacctagggagtgcacttatcccccaggtgctgtgagtgttggcagctaacaactcacaggcacccctttttctaggaattgtcctcagccaacaggagttgccgtggctggaatacctgggaggtaacgccctacacccaatagtggcccgtagcccatgattgactcatagagtggtgtcaaaggtcaggctttttaccctaagttgggacagcaccgtggtaccattcatactccagaactctccaggatcaggctgagaccagtctccagctgtaactacgtccttgcctagctgcctctgcttccctatattgcttcccttattccctcatctgtttcccctgagagcttctctcaatgaatccctgccttatgttcatattaataatagccaaaagtagaagcaacccaaatatccattgatggatgagtggataaacaaaatggagtatatccatacaatgtaatattatttggccttaaaaagaaaaattggctgggcgaggtggctcatgcctgtaatcccagaactttgggaggccaaggcaggcagatcacttgaggctaggagttccagaccagcctggcccacatggtgagactctttctctactaaaaatacaaaaaattagccggacatagtggcacatgcttgtaatcccagctacttgggaagcagaagcaggaggattgcttgaatccaggaggtggaagttgcagtgagccgagatcacaccgctgcactctagcctgggtgacagagtgagactccatctcaaaaaaaaaaaaaaagaaaaggaaaatgattctaacacatgctccaacattgatgaaccttacattgatgaaccttgaagatattatgctaagtaaagaaagcctgtcataaaaacacaaatactgtttgattccattcatatgatgcatatagagcagtcaaattcatagaaacagaaggtaggatggtggttgccaggggctagggagaggaaggaatgaggagtttttgtttaatgggtacagagtgtctattatgcagagtgaaaagagttctggggatggatactgtcaatgattgtacaacaacatggatgtctttaacactgctgaacttaaaaatggtaaaagtgataaattcttatgttatttctattttatcgcaattaaaaatacaaaataaaagacattaaatagtttttttaaaaaacataaaatacaaaataaataaattatttaaaaaccctcatcttaggctctgcttcaagggaatctaacctaacacagtcagcccaggagaatttctatggaatgaacatataatctccagtacatatgccatgtgctaacaaacacatgagagaactttatgatctgtgtgctttcgttgagcagagaacgtccctttgattcctgagcttactggaatatcattacgtaattctcccccatttcctgctgcatacctacaagtaatctcaaaaatgctttcaaggagagttttcaattttgcattttgaactttggatctgccttcatttaactaagtgagagaaggagaaacaaaattccagtgtattagcatgacatttaaggtggagaaatgtaggcagcaggcaatcatgtggagcagcggtttacagctgaattctaccatttgtagctacttaacatgctgaaccattcctctctgtctggaaaaatcataaaaaggggcccgtcagcactctgagtcactgctaagaagcttatgcagcctcacacctgcatttaaatgagtgtttccggggcaaaaatgaaggacctcagagaaatgaaacggagcactctagcagagaaaaacgatattggtttctgtctgcatttgtaaattaactacaagaagaacacttctagaattagtttaattattaatagaaatcgctttgaacaatttttttgcttcacattttattttaaatgaggacggtcatagaaggtttatcattaggtggcaaaatttgatcatattcaaaatgtaaagaaacagccactgataccaaggtatggtgcctcacacaaagtaggaattctgtacctatggggtgaactcatcaattacgtcaaactcaaacataggtttcaaaaccaggacttgtgcatacttcatctttagtttcttctttctcaaattttactgcttagtaaggtatagcttacatagagtacagtgagtaaattttaagtgttatgttttgactaatttacacaaacacacacacatacacacacacagacacacacacacacacacacacacgtggagcccccatccatattgaaatagagaatttctagtgccccagcaaccctccttaattacctccccaccaagagaccactactatagatcttcctaaattttcacgcttccatggaagaattgtttttccaagttggagcaggagtaatctagtcatagtatcccttgattcttatttcaagattctcttttttttttgagacagagtctcgctccgtcacccaggctggagtgcaatggcacgatctcggctcactgcaatctctgcctcccaggtttaagcgattctcctgcctcagcctccttagtagctgggactataggcgcccgccaccacacctgactaatttttgtatttttaatagagatgatgtttcaccatgttggtcaggctggtcttgatctcctgaccttgtgatccccctgcctcagcctccaaaagtgctgggatcacaggggtgagccaccacgcctggccctcaagattctctttagcccaacatgatcccaagaaatcattagtcttttactgcttaccctcagaagggatcacccttgcactgccctcattgggtgctcttgcccatgccatggccagggtctcattgtgatccttggagcttcggcttacttttggggggcaaaatgcttccaagactctcagtattatagctctaggtccatttctagatgcatgtcctaggtgctgaactaggtcttttcagacattccttacctgccagaggtaagactttctctgtgcatgtcctggagccagagccaccatgctgtcccataagctgcggtctgatggcagaggcagactccattgccaagactccagttcactgacccttaattgtgcacagctcagaagaggtcacagtttggctcagacttcttgaatagcttctagaagaattgtttgaaatgagaagatgttggaaagaactagaaactcttctttcatgatctactccacacacatttcactccaataatactaaacagcttccagttcctggtctaccatatcggttcatgtctccctgtctttgatcacgttattaactctttttagaatatatcacgtttttacccctcttgacgtgatgctttttctttttccaagtctgagctgagatgtcatattctagaaccacaagttcagctaagtccctcttctctagggcctcatgctaatgagcttctttagcattgcttccactgtctcctaaatgtgaggtggtctctgctccttgccagctccaagtgaccaaatagtatctttttataaactcaaatgtagacactatctccatgaaatcttttcacctcttctccaatgaagcgctttgcttcttctctatgtatatttgacacttcattaatacccctcagtggtttttcatatttttatttttcccgttagattgtaaaacctccttcagaagagttttgtttgacattgaattccaatctactccagtgcccagctcattaccccagattcaataaatgctcgctgaatgaatgcatgcagagctgagtggataagcaagcctccttgattaatcacatcaattaaactgggtcaaagatgttttgttatattggttccattatctgactttcggaaaagcaatgtgacctacagagttgacatgcccttgatatggcaaaagatgagtttcatcctcaaatatcccattagcattttattttccctgcttagagtatatggttgacttattcctgtcacagacctaagtaactactaatattgagattttctctctaattcttctgacacttcttctttttcttttttatttatttattatggtttttttttttgcctaaaaagcgtcatctttctggatcacgtcaccgactctagcctttggctttctatccagggacatttttcacaaagaaacaaaactgtttagtgatggtagcagagttatcaacatggtaagtagggaaaaacgtatttgcatttaaaagcaaatcctggacctgtggcagagccaggcttgataattacgtcccttacattggccggcctgataaagcttggatattcacagtgacaagtagcaacccgctatagaccttagtggtcactcacaaataggaaaaaaatcttggaatgttaaattcgcagattagagaatccccttttcacattttctgcaaaatccattttgatgcaaattagattacagaaaatttaagattctcataaatgtacatcatatttctgttagtgacgttttacccttgcccctccacacctttgtgtttaggctcacacatttcaatttcaaaacccagaaccatggtattaattctaaaatctgagctactaaagctggggccctcaagtaagtacaccatggaatctgcgagatagaaattcctagcctcgcattttagtttaaaaagttttagtttgaaagtatgggggatgagctggtggcataagctgtataacaatgatatttttattaaatttgaaggcctaaaaatatcctgtagtaggggaaagtacttttacccaccataaatgttattaggtttgtgtaattgtgccaaaattgtaagggcaaaaatgatctgctttgctattgtctaaaactaacgccagcactatcaattaaaaaatatatatatatatatgatctcaaaaagggagatggtgtagaatctacttagctttgagcagtaccaacagagaattctcctaggactcatactaaatgagttgggttattattaattagtaggagttaaaacaattatcagatcatgtacagcactgttcttaatgcagcctgcctagggaccctgttaggagggtgtgtggccatttgactcttgctttctttatgtaatatcataatgacccaagctagggggattccaacaatgatatacagcagcttatacaaaaggggacttcatgtcattccaaagagtgaaagaaaaacaggaaagcagatgcgagagcaaaaccattccttactgaagacatcatgagtcctttgtttttctttttctattttctattgtcaagaatatttatattcatccaggcaagattgcatggggaggaatatcacagttgtacatttgttgccattgggttctggtttacaactgtcttgcctgagattataaattttcaggttaatgcagtactaatgcagaatttgttcatcctggaatttgtgtatatagcatattaagtaaatccaaagagacaagtagcatatgaggtaaggagtcctgggtttgagctttttctagtaaagtagccagagattgtagttagtaaacatttctgaatgttctacagtacataactgtaaaatagaatgataaatgaggtgacttaccaggccacttccaattttgaaattgtaagatttcattcagtctctcccaacccccaccaaaataaaaaacttgtgaaaccaagtctgtaccagactgacgtgtatcgaaactgtcactctggtgttgagataaatagccataactcttagttactgtaaaaaatagttgagagttatggaggatatgatttaatacatgcttattgaatatatacttcgtgtaaggctctgcactgggaattatagagaagttcaagtatatttaaaacacagcttcttacacagtacctggtctgaagaggcctccaggggaggtgggaagatgaaagaaataattttcaaaattattttggagaagggtagagtagctcaccatagtagtggtctgtctcttcaacaaatgacacttttaaattgctttgatttttgtttctaacttcttaaaaaatgtgtatgcaaccaggattcatattttattacttatatagccaatgttaggaactaaattgtgctcaccccatattcatatgttgaagccctaacccctaatgtgactttatttggagatagggactttaaagaggtcattaatgttaaatgaggtcataagggcaggaccctaatccaatgagactggtgtccttataagaggaaggacaccagtccctcatctaagaggaagaaacatctgagaagcatgtgcacagaaatgaggctgtgtgaggacacagcaagaaagcagctatctgcagaacaaggagagaggctgcaggagagaccaaacctgtccacaccttgatttttgacttccagcctccaaaactgaaagaaaatacaattctcctgtttcagctaccaagtatggtgttatggtgtggcagcccaagcaaactcatgtagctgatttcatgaactttcatgttttctgcactgtggcttttctgatgtttgtaattttccccattccctctccagtcacaaaactagaacacaatcttgggaaaggacacttgttcccacctcccatccccagcacaaaaatctacaaacacatatcggacaagacaacccacattgggccagtgtcttgtgaggggtgtccgacatcatggtaagtcagcaagggggagagactgcacttctaaagtgtccagtacaggctccaagagcaggtggcatttgagctaggccaggttaattcccatcactgttttgtctttgggcttagttgtgcacttctctcattttatcagggtagacagaacgaagacatgaacaatgttttgaaactcactccttcattcaaccaataattgaacactgggcacagttctaggtgactgagttacatcggtgaccaaaacagactcatattctacctttggaatttacactctagtagcatgtggagaattagacagtccttgcctttgaaaaattcagcatcttgtggggagatggtccctgtcttaatctgtttgggctggtataacaaattactgtagattgggtggcttacaaacaacacaaatttatttcttacagtactagaggctgggaagtctaagatcaaggtgccagcagatttggggtctgatgagagcccacttcctggttcgtagacagaagaccatcttcttattgtgtcctcacatggtggaaggggtgaaggctctctctggggtcaatctctctcttttttttttttttttttttttttgagacagagtcttgctctgtcacccagactggagtgcaatgatgcaatcacagctcatgcagcctcaaccttctgggctcaagcaatcctcccacctcagccttccaagtgactggggctacagatgtgtgccaccatgccaggctaatattttaatttttttgtaaggatgagaagtctcattatgttgcttaggttggtctcaaactcttggcctcaagtgatcctcccacctcagcctcccaaagggcagggattacaggcatgagccaccacagctggcccttgtggtctcttttacaagggtactaatcccattcatcaaggctctacccttatgacctaatcagctccccaaggcccctcctcctaatatcatcactttggtggttagaatttcaaaatatgaatttcgggtggggacataaacattcagttcattgtagtcccacttaaactgatggtttcaataatataataaatgtagagaaaaggaagcctgaacacggaactttgaaagggcctggtaggagcctgggaatgactcaactgagacatccttgaagaattcctgtttgttttttgtccagagagtgccaaggaaattcccagcacaatgtacctatgacaaattcggaagtcgtatgttgggaattaatcctgctttattttcatctcattatatgaatgtaaaatatataagaaatatcagttgggttaattttagctccttttatggaaatttaattatttatacaataaatttagttccttaaaatataaaatcgatgtcacctttttctttgctctttggtagtttttttttgttgttgttgttgctatttctattgctgctgtgacaaattaccacaaactcagtgacttaaaacaacacacatttattattttacagttttataggtcagaagtctgacgtagaggttacttggctaagatcaaggtgccagcaggtgcatttcttcctggaggccctgggggaaaatctgtttcctcaccttttccagcttcatagaccccttcctccaacttcaaaggcagcaagattaggctgagtccttctcatgctgacatgtctctggttctttcttcaaattccctcttccactctaaagggccctcttgattccattaggcctacctggataatccagaataatcctactttaattttttttttaagttctggggtccatgtgcaggacgtgcaggtttgttacataggtaaacatgtgccatggtcatttgctgcacctatcaacccatcacctaggtattaagcccagcatgcattagctatgtttcctaatgttctccctccccctccccgaccttccaacaggccccagtgtgttgttcccctccctgtgtccatgtgttctcattgttcagctcccacttataagcgagaacatgaggcgtttggttttctgttcctgcgttagtttgctgaggataatggcttccagctccatccatgtccctgcaaaggacatgatcttgttcctttttatggctgcatagtattccatggtgtataagatcagctgctagcatgcttaatttcatcttcaaccttaatactcacttgccatgtaacctaacacatccacaggtttccaggattaagacatagacaactttggggagccattattctgcctaccacatgggtttacttaatcaccagggagacaaagtagataataagcacaaagtagataataagcaaaagaagccaaaaaaacttctgtgtgtcctgcaacactaaagaacataaagaatcaaagagctttatttttcatctaactcagtttggtaagattccaatttagaagctaaggtaaaggaaaactgacttcctatggtacaatttaaattcagtataaattcagtgcttgcccaagtagaatgtccagctgtgggtacggagcaaaggtgtcagtaaactgtattcacacccagggcacttaagagacgttattttttgagacttgcaattgatatgctttgcactgtaggggccacgtgggaatttccacctgagaagcatttgttgttaagcacttttttcccctgtctttgcttcagattgtataccttccagggacagatatcagtattatacatagctctttgtatattttggggggtgactgagaaacatatttcattacatgtaacttgctggccatcccaaatattacagtaacaataaccggtacagcttgggtatcccatatctgaaatgctcaggaccagaagtgttttgaatttcaaatgttttcaggttttggaatacttgcatatacatcgtgagatatctcggaggatggaacccaagcccaaacaagaaattcacttatgttccatatacaccttatacatgtagcctgaaggtaattttatacactattttaaatagttttgtgcatgaaataaaggttttgtacattaaacaatcagaaagcaaatgtgtcactacactatctcaagcccatgtggccaatctttgaccactatcatccctgtctctgaatttatatgttactgatgagcaatcatcttcttacacttattcacacctaagtacctagtaaaaaaattgacaaaccattaatacagtaaaaaaaataatgtgttcaggataactaagcagcaaagtagcatcaccagattacttgtattttatcactattacccatagaggtatctgtaggcctttttgacattttcaacaatatctttacagagcagagaataagcaaaaagtaatgcatgcaggtcttggcttcatgtgggacatcatggggaacctattgttggcatttctggccagcatacgtgccattttattaattgttctgggcaatgcttacaggagggagtctggataagggcagaaaatatatattgcaactgaaggggcctgagagggtctttttttccccttggagaagccgaataaactgtgtgttgtgcacctgcattttgacggtgactcgtcacatgtgatcaggagtggaattttccactgtggcatcacatcatcactcaaaaagtttcagattttgaagcattcagattttggagttttggattcaggatgctcaatttgtatttctgtttttaatctagcagttacactgagggccaagactctatgttaaatgcccaccatatattatctgatttaaacatcacagtgatgctgcagggaaggccctgcagtggccattctcaatgctggctgcacattagggccccctgagcagctcatgagattccggaaacccaggctgcacccagtccagttaatcagaatctctgagggtgggatccaggcccctcattttttaaagcttccaggattttctatcacacagccagggttgagcctagattcatctgattccaagcccagatatttttgcctgctgagtaagtagtatagcccaggcctttccccatcttttgccccaactctctcactcacaggccctgccccccatatcttacacgcatacttagtttttaagagacagagtcttgctccgtcacccaggctggactgcagtggcaagatcatggctcactgcagcctcaacctcccaggttcaagcgatccttctgcttcagtctcccaagtagccaggactacctgcacaagccaccatgcccatctaatttgtgtgtgcgcgtgtgtgtgtgtgtgtgtatgtgtgaagacagggtcttgctctgtttcccaggctggccttcaactcctggcttcaagcaattctcctgacttagtctctcaaagtgctgggattacaagtgtgagccaccacacccagccccatgtaggcttttattcccagttacatttttgcccacaaaatgaaaattataaatttttgaagtccttagtataataccaatgataatctgacattgtttctactgaaaataaacattactgttattggcattttacttttgtttttattagattttttatttttatttttttaatggggtgagggaggtgtctttataagtaacagtgatagtaattttgcaatactaattttgataactaagaatgtatcattttatataccaggaattttatggactttgccttgcatgttttgtgacattttttcggggaagattctattatcaggaggaaactgaggcttactttctgcaaagacacagccctgacatttaagcccaaatctgtgttattttattttattttagaggcagaatcttgctctgttacccaggctagaatgcagtggtacaaacatagctcactgcagcctcaacctcctgggctcaagtgatcctccaccctcagcctcctaagtagctgagagtagagctgtgcaccaccattcccagttaatttaattttttgttatagacagggtcttgctatattgcccacgctggtcttgaacaccctgcctcaagcaatacttctggcctcaagcaatcctccacctcaacctcccgaagtgctaggactacaggcatgaaccctcatgcctagcccagatccatgttattttaggacatcagtttatagcttctgtttgatgtattctaaactcgaccgaaaataaaactctcttgagaaacttgttgccctcctgaaaattctgtctggaatgggacttagcaataggatttttaagtttggtccatggtgttcctgggctactccaccacgctacaatacattgccttcaatcagggcttctcaaacactcatgtgcttgcaagtcattggggatctggttaaaatgcagaacctgatgaagtaggttaggggcggtcctgagattctgcatccctacctagttcccaggagatgtgatgcttctggtccacaaaccacattttgagtagccacttagtgcctggtaacttaagttttctgagagcaaagttctgagagcactgttgattctccactcattgtagtgtctttttgcacattgacttgcaaaagctccttagtatatctttgaggaaaccaaaaaaaaaaaagcacttttaagacaatgacatcaatatgaactcagtgctttaagtgcattttataaatagcacagcagataaatcacctcttttagaaagaaaatatttaaccaagtgtaccttgtctccattagacactaagcacatctctaattcattcttagataacagagttccttacccaaattaggtgtttaaaaaggcatttcttaaaggaataaatcattttacaaacttttgaattgtttttaaattttgcatcccatattctaacaccgaggtgcctttttaaagatgcatctgtgaattttcattcaaaagtatatatagactacataacatatgcatcttaggtgtaatacaaagacatagaatatttaaaggcaattaatatgtctatacaaaatatttatttatttttttattatactttaagttttagggtacatgtgcacattgtgcaggttagttacatatgtatacatgtgccatgctggtacgctgcacccactaacttgtcatctagcattaggtatatctcccagtgctatccctcccccctccccccaccccacaacagtccccagagtgtgatattccgcttcctgtgtccatgtgatctcattgttcaattcccacctatgagcgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggagtcgccacactgacttccacaacggttgaactagtttacagtcccaccaacagtgtaaaagtgttcctatttctccacatcctctccagcacctgttgttccctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctgtgtcagatgagtaggttgcgaaaattttctcccattttgtaggttgcctgttcacactgatggtagtttcttttgctgtgcagaagctctttagtttaattagatcccatttgtcaattttgtcttttgttgccattgcttttggtgttttggacatgaagtccttgcccatgcctatatcccgaatggtaatgcctaggttttcttctagggttttatggttttaggtctaacgtttaagtctttaatccatcttgaattgatttttgtataaggtgtaagaaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcttaggattgccttggcgatgcgggctctttttttggttccatatgaactttaaagtagttttttccaattctgtgaagaaagtcattggtagctttatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacgttgattttgtatcctgagactttgctgaagttgcttatcagcttaaggagattttgggctgagacaatggggttttctagatatacagtcatgtcgtctgcgaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggctttggtattagaatgatgctagcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgtcatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggcgtggagacttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtttaattgatccctttaccattatgtaatggccttctttgtctcttttgatctttgttggtttaaagtctgttttatcagaggctaggattgcaacccctgcctttttttgttttccatggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgatagtctgataggcttccctttgagggtaacccgacctttctctctggctgcccttaacattttttccttcatttcaactttggtgaatctgacaattgtgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacggagatttggtcttttcacatagtcccatatttcttggaggctttgctcatttctttttattcttttttctctaaacttcccttctcgcttcatttcattcatttcatcttccatcactgataccctttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctacaggtcagttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctctcagacagggacatttaagtctgcagaggttactgctgtctttttgtttgtctgtgccctgcccccagaggtggagcctacagaggcaggcaggcctccttgagctgtggtgggctccacccagttcgcgcttcccggctgctttgtttacctaagcaagcctgggcaatggcgggcgcccctcccccagcctcgctgccgccttgcagtttgatctcagactgctgtgctagcaaccagcgagactccgtgggcgtaggaccctccgagccaggtaagggatgtaatctcctggtgcgccgttttttaagcccgttggaaaagcgcagtattcgggtgggagtgacccgattttccaggtgccgtctgtcacccctttctttgactcagaaagggaactccctgaccccttgcgcttcccaagtgaggcaatgcctcgccctgcttcagctcgcgcacggtgcgcgcacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctccccctgtctatacaaaatataaggagcaaaagaagactgttaagaggctaaaaataacctaaacatgccaaagaagtagagagaaaattgagggtgtttttaacatttattttaagttcaggggtatatgcgcaggtttgttacataggtaaacttgtgtcatgggggtttgttaatacagatgatttcatctccgaggtattaagcctagtacccattagttatttttcttgatcctctttctcctcccaccctgcaccctctgataggtcccagtgtgtgttgtttccctctatgtgtctatgtgttctcattatttagctcccacttataagtgagaacgtgtgagttggtttttaatttatttccctgacttgtgatacccattgtgaaaatgtatattatgggtttaaaaataataatggtaataacagaaatgttaaaagctaacatttcttgagcactttctatgtgctaatttgtactgatcactgactgagcccttgtgtagatgaggaagtggaagagttgagtgactgcccccactagcatggctgtgatgtgcaaagccaggactcacccaggttattcattcctaaactagaacacctctgagcaagttttctttgcacttgagtaaagcagatggattaatgtttgctagaaagctaccagacattgatagagagccaagtttgcaatggaaaatttgtctaaacctgctagtgttaactggtatgatctccccttgttttgagaccaggcttgttctggaagtgttgcggctgttttcttctacagctctatcaatcccttcctctttccctcccttgcagcaccaacaccttcaccatcatcacccttttatctcttaggtcttgatggcttccacattttaggatatctgatggtcctccaatgtcacttaatgtattttccattgggcagcatcttctctagcctcagataagaattaaagttctctcatgagactagtttgaaaagctgaacctatgagacaaagtataattttccaatacccataatgatggatattctaaataaagaagagtatatgacaccaacaccaagttttttttttaatcaaaagcaaggttgactcttggtattcctagaatagaggcttttataacagaccttaaactgccttaatttaaagcaggtgtataaaatacaaaatggtatttaaagaggtgtagagatattaattaaaataggcttgctgaaatgccagggatatcatcacttctgaaaattgaattaagccctgaatgtcaatggtgaattaacatgaatagacttatctatccctgtccaaatatattttatccacaagctgtgtaatacacgatgattaaccagaggttacagattctagctgaaacccaatcaaattcttcagaatcctaattgaggaatgcattcaggtcaaagaatattaacagaaaagcctctgtcatttaaagggcaagcagagtgagtgcttaaaagtgttcaaaattttgcttaattgttctcttcttgagctattgttcttgatgatttagaaaacctgtgtgctgcaagtttaactgctttaattacagtgatgtcaaatacataggcctttctatttaaagggattttaatttctgtggcttatgaaagagaaactgaaagcatagttaaaagtgaatatgttagttgagaaagttcctgttcttaccaagcaataaaattttcctaaatggatgtttgaaggagagctggtgttcagaggtgtggttcagttgaagctcctctggtagaagcccagcattttgtctgtctagtttttttgtccttagcattgcttacttttgtaaagccccagatatatataactcattgttaaagtatcacatggtttgtacagcaggatgatttgcattatatgaaggacaccgaaacacagaaaatgaaaggtctacggtgtatgacaaacaggacaaatgctctagcaaaaataaattctactttctctcaaaattagcatacttgttatttaaagaaatgtgccagaagagaaatacaagattttcttttcttttttctcattgactttaactctctctgaatggcacctataactaaaaatacatctcgggaatcaagtaaccctcttttatatacatccctctaaatctatggctaagttcaatgtttaaggttgtcaaagtggctcccatccaaaatcgggttaacatttgcactttgcctaaagtgggactcctagataaaattcaaacgacctttctggtaatcccagcgtgtgggttttagcatcaccagctggctccaaatgggccactgctctctctacaaagaggagggagccttcaacacaggggccatgcttgtccattcaactgtgtctaaattcacagatcagtgtttctctcagtccctagaccagcaacatcagcatcccttgggaacttgttagaaatgcagagtctcaggccttgcctcaccgaatcagcacctctggggttggacctagcaatgtgtgttttaacaaatcctccaggtaattctgatgcacacctaagtttgagaaccacttttgtaaatgtgtgtttcaacttgacactaaccaataattctaccacttaacattaacagctttcaattttatgatcctttgtgttggacaggtcaaagtgggtgatttcaactgcttaatgggtacagaattttattttggggtgttaataatattttggaactagatagaggtggtggttgcacaaccttgtgaatgtactaaatgccactggattcttcactttaacaatgagtactattggccgggtgtggtggctcacgcctgtgatcccagcactttggaaggctgaggtaggtgtatcacatgaggccaggagtttgagatcaacctggccaacatggcgaaactctgtctctattgaaaacacaaaaattagctaggtatggtggcatgtgcctgtaatcctagctacttgggtggctgaggcatgagaatcccctgaacccgggaagtggaggttgcagtgagccaagatcataccactgcactccagcctgagtaacagagtgaggccctgtctcaaaaaaaaaaaaaaaaaaaaaaaaaaggttactttgatattttatgttatgtaaatttcaccttgtttttaaaaatatgtaatataaatgaaactcaagtgttttagatatgccagtctaaagaaatctgcaaattaaacaatttccaattcttaatcattcttattttgagtacatcctaattctttttttacacatatgatatgatgcattctaattatacaattactaaggtttcccaagtaaacatataaaacagagtatctgtaaagctgtgatttgagtgcttttcatggaaagtttctcattagaatttcttgatcagccaaacaacagttttcaactacaagcaaaacaagggaaagcattatttggttgtctgtcattgctagggtgaagactataaaagaggcaggaagagtaaaaaccaggcttttaaaattaaatttcaggcaatatcttatagtacctccaccctcatgttgggcaattcaagaggtctattcacattgcattgtatgaatagaattttatttcttttgaaatgtaatatagaatattttattttataatatgatctgaggatgcctcctggaattgtgcaacacaaaggtcttgggtgttgtcctttctgggtagagggtttgttagctactgaatatatttgttataaatatcactggggatttttttaagtaaatttattttttaaaaaaccctaatcctatgaagtttcactaaatgtaaaaaacataaatcaattaaggcttgaagtaacattttattttactgtataaccctgtaatcccacacacacacatctattatagacataatacattactatatagaatactggaaaatatcgtaaaatacattaaaaaaacaatttcccttactctcagaactgagaagtaaaatctgttgtatcttgtgagagtatatatgtatgtgtgaacacatatcacacatatatagagtacagttaataacaaacagcatattccattttaaaacctattttcccttaccatatcagattttttttcttaacgagaaatattcttctacaatatcaatatcatttgaaggccatatagtatttccacttatagacgtagttcacttgattaattttgaattccccttaattgaacacacttaatacttcatttttctttaaaatataacaaccttacccctatattttgtgcttttgctgattacttgtcaaatatatttatttgtggtatctctttttatactagaaacatcaacctctttgtcaaattgttcttccagtttattgtatttttgttaattttgattttaacatgtattttatgtttggtgttttcttttttttttttttttttaaagaaaaaagctctcattcttttttaaaaaatagattcagggtatatgtgcagatttgttacatggacaagtttcataatgctgaggtttaggcttctagtgtacccaccacccaaaaagtgaatatcatatccaataggtaatttttcaacgttcactctcctctcatcctccccacatgaggagtccccagtgtctattattgtcatctttctgtccatgtgtacccatggtttagctctcgcttgtaagtgagaacatgtggtatatgattttctgtttctgagttatttcttttaggataatggcctccagcttcatccatttcatccattttactgcacaagacatgatttcattcttttcatggctgtgtagtattccacagtgcacatatagtacattttctttattcagttatccattgatgggcacttggcttgattccatgactttgctattgtaaacattttatgttcagtgttctctttcatagtgttgccttcctattccaatattatgtacaaattttcctatagtttcatcatcatggttttgttgtttacatttaacgctttatttgaacatcaatgtgatctgtgagatagtaaaaagacctaagtcaatttttccaaacagttaaaacatgtttttatcatttattaaataacacagtactttctccatggatttgcaaaataagattatccaaccaggagcataaacagagcaagttatttaacctctctgtgccttcatttcctcctctaaaagaagaaagccagtaacagcatctccctcaaaaaactgataaaaaaaaatccacaaggtgcctgacacggaataaacttcatcaatattatatgacaaccactagtatgattacaattattattagtgccctaatgctaccactagtatgattacaattattattagtgccctatctacccaactcaatatgctagtgtcttttttaggatatttacaattatatttgtaagtgagatggcctatgttgtctgtgcttacatcaattctgtcaggctttgaatgagggacttgatggcttcataaaattaaaaagttctgcatctgtttattttattactaaatgtagaatttatccttgttgtgatagattgacagaatttctctcaaacctttatgagccctaaacatttctttaaaacaacacttggaaaagtatttcaaggtctttcttaatttttgatctgttgttaaaaatttccctttcttttggatcagttttggtaattgctacaattctagaatgaattgttggggagcatgcctaaaagtagacaccaataagggagttgctctaacagtttaggcaggagatggttcccaattctaaatccatagctttccctaatatcgggcttgataaataacaacacagtaccccccatttataatgccaaaaccagggaattctcctgaatttctttctttcccttagcaccatttaccacagtcccacatcccattcctcagccaggcctgttgcctccatatccaaattacatccaacgcatccacttctctccatctccatagacctcacattagtccaacctccatgaaatagactcagttgaaatagcatcttaattggcttcctgcctccagttttgcacattggcagacaaagtgatcttccaaaaatataaattaaatcatttcactcccctgcattaaacctaatggacttcttttgtgtttcaaatagaaatctaaactccatccctctaagagcccttgtgacttggattagaatttgccctttgccccaaccacctcatcacagatcactgtgccgctctcttgctatgttccagcctctctggactctgtgttcctggagcaagccaatccgttcccaccccaaggtatcagcacctcctggaactttcttctcttctccagactttggtgtagcccctttttcttttatctaatgttcctaccccaatccactcattattttaccttaccccattttattttcatcattgacttcttctctgaaatgttcttgttcattacagttgtgtgtttattgctcttctacctgtaagcattatatgcattatttacatgtgcctgacacatgttttgccttcattaaatatgtattgcatgaatgagtgagtgaatgaatggatatagtcagaatgattttaaaaatgaatagactgaggaatttaagaattagaatttttaaaagttagatataaaaatgatcccccaaactgatatgaggtaatgcttatgttaaatagcttgatttagccattccacagtgaatacatgtatcaagacatcatgttgtacaccatatatatatacaatttttactcgtccaacaatttttttaatgactagaatatacagggagctgggagtgtgtgctctatctctatgtacttgggtgtgattacaggatgtgtaaaatgtagagatcatcaagttgtgtacttaaaattaatgcattctgtgctctttaatgcatgcatgttatttctttaaaaaataaaaccataaatacatgtttaaaatagccagagagagcacaaaatttaaataatatgtgtaacttaaaagcttccatttttacatagtctaggacctaatatcacaggcaaatttaaaatttctttgaaaatgagctttgggattctgtaaagatttggggctctaccatgtggttgataaacaaaattactctctttactcaaggacctaaatggactttaaaatgagctggaaatcaactctggcttcaaggaaaagggtatacccacagggcaaacttgttttgcctcaaaacatactttatcatgtaacgtcccattcctcacccaaattagatagccttacattatcatgtgacatctgttaaataactcaaataagaaaatagttcctgatatttagataaggatacttagatttatagggtattttcctgcataagacactaatgacttttataaaatgtttcataaatgtgttttgtgaaaacacaaatatgagtcagctggcatagcaacatgcacagtgtagcaactcaaacattttctgaataaataaatgaaggaatgaggataagaaataaaaatattagaggtaattatttgggttccagatagagctttattttaattatagtttcttaaatttgaatgaattcactattttaccataatcagaagactgcagcaatcatcaattgcacaacagtgatggcctctgtaatttggcactattagctcctgaaatgtattgagatgtataaatataagcatcttaatcttttcaatataccctagcaaactggccctagcatccctagggctttcggagctaaggggaagttaaatgcccttctcttattccctgccaaaataagaaaaactttattgatttgaaagtgttaatttcctccaacttttcatatatgcagtaggcatgtcaacagagcaaaaatagtcttagctattggaaatgaggctacagattttattaggttggtgcaaaagtaattgcggtttttgtcattactttcaatggcagaagctgcaattacttttacatcaacctaatagattgacttatgtcataactatacatttcccaaaaatacaagacatggttcaaacattaatatttgtgacttagagcatcagaatgaggagattaaaagtttgaaaatgctccagcacttggatgaggcaagaatagtgaggtacagtttaagagagttaagaattaaaagtctttatgccaagctaaatgtgtccttcaaaagctgtgcatgttatgactgctggctccaacgcatctatctagtcagtctctgctattttaaccatcttttttctcttcaatttaccacctattattaggccaagaaaacttgagcatctgtcaagagtaaaaatattttgaagttttcttcaaacacactgaattccatgatttacacatggttctttttttaagagatgggagtcgtgctgtgtcaaccaggcttaagtgcagtggtgcgatcatagttcactgaaatctcaatctcctgggctcaagcaatcctcctgcctcggcccactatgtaggtggtcagccacctacaggtgtcagccaccatggccagcttcatacatgtgttctgaagcaacttttttgaaagcatggtatacacatcacaaagggtgcacaggtactttagggtgaatatctgtatttgcacaccaataaattaacccttctaatgtaaacaattcagtggtttttagtatatttagtatattcatagatgtaaaatgagcatcagtatataattttggaatgttttcatcactccaaaaagaaaccccctacccattaataagcattcttccctccttcctcttcccagaccctggtaaccatttacctttctgtctctatgtgtttaactattctagaaatttcatataaatggaatcatataaaattatgttggtgcaaaagtaattgatgtttttgcttgtgaaagtaatggccaaaactgcaatcacttttgcaccaacctaatacctggtatgtagtgactggcttctttcacttagcataatgttttcaaggttaatccatgttgtagcatataacagtacttcattgctgttaattgtcaaatattactcaattgcatgtatataccatatttgattttccattcatcagttgatagacatttggattgtttttattttttggctattatgaaaaatgctgctatgaactttcaggtataagcttttgtgtggacatgttttcatttctcgtaggtatatacctaagaatgtaattgctgggtcatatgatggctgtgtttaacatcttaaggagttgcaaactgttttccaaattggctatgacattttaccttcccaccagcagtttatttgataaattcctttcagatagaattcataaatattttctcccattctctttgttgtctttttaccttcttgatagtgtcctttgtagcacgaagtttttgttttttataaagttcaatttatctatattttattttgttacttgtcctcttggttatgtaagaaaccattgcctaacccaagatctcaatgacttatacctaggttttcttctaagatctttagagttttagctcttacatttaggtctatgataaatttcaagttgatttttgcatatagtgtgaggtaagggtccaagctcattatgataatgatgagaagttttattttaaataaacatattttaatgtatgaaatttgctaatttaaagaaaaatcttaaataaatggtaaactataaatatctaagaaatgtatctcttttcaggttttctaggaaaatcaacctaggatttatattagtaaggaaatttatacttaaaattttacttttatttattttactttttatttatagaaggtaaggatgaaatgatgaagtgggatagaggttgacacctatatatgtgccaagctctttgtgaatgtaaaattctattttaaggaaaaaaatattgtgttttgaaggctaagaaaacatgtatacaagaaactaaaatggtgccattgggcaccatcttctttaattcttagttttaaaattcagggaaatactttggttttgataagcttaagcctaagtgttgaaaaattcttaagtaaggtttaaaattaaaacgacatcagtaattgttaataaagggatcaccaaaaaaggcttcactatagtcagttcattcacatcaagttacctagtcagtctgggttgattaccttaaaatgtaagaagcctgtattatgactttattttaataataaaaaggtcctttcagttctaaaaacatggctatatcatgttttttacttcttgagcctataaaaacaatttctttataaggactaggataaccaggaggcctagtaatatcaactaaaaaacattttattgatgaaatagtttacagagttttattgaccgtgcaggaaacattcagggactcttcaatcaattctcttagtatttccagtggtagtttgagaacattcccttggcactgtttctatatctgcaaacttttaagagacgtattagctgggcatggtggttcatgcctgcagtcctagctactcgggaggctgaggcaggaagattgcttgagcccgggggatagagtctacagtgagctgtgatggtgccactgtactccagcttggatgatggagggagattctgtctctaaaaggataaataaaacaaactagagatatattcacctcaagttttctctgttgaaaaaccaactagcttttaaggaagtttgtaacttccttaaaaacagttagttggcctttctctgtgctccaaaagcatttatccctttgtcctaaaaggatctacgtattttcctcttctaccagatcattagaagcttgagggcaaagactgtgccacattcataaacataaccctggtatagaaaatggcaataaaggcataaagtttgttgaatgaataaaaaacacaaatgaaaaagtatgtttatggtattggtagagctcctggaacattcatttgcatataggtgaatcaattattgtaggagaggtcgcttcagtaaatgttcagagttttcctgggattctatgacataaagatccacaagtcagctttgaagaaggcagctctcaagccctcatctttgccgtccattggatggaggaagggtggcatagcaacaatggttgtttcactgcttaacccaactccctgtagtaaaattccagaggtttcaccaggaagtccaactacactctggtttacatattccatagggattaaatgtcctgtgctccataggtgcattggattatcgcgcatccactaaaccccatagatctgtagattaccttagacctttctgccccagttactgattgagccacatgtatcaggttgtttaggtttccatagcctcccctgtgctcttgagagcttaaagccccttccctagcagagcttcattacacaaaaatggaactaccaacctaattaatgacacagccatacttctttctataagaaggacattttctgaagtcaaatactctacccctgagctgtacccgcaagaaggacattttctgagacaatctgaagaaagtcaccatctgttaatgacttttcaggaagaatttggggttctaactagataaccacatttcagtgttacccttagacatggcccagcttaacacatgagtgagcagagacagatctggatgtgagatgtgtgggtgggtacaagcccattctgtttgctttatttttaatgataaagcagtagagcttggaactgtggatattggctctattgcatacatgaaatgtgtaaatgctcgtctctttatttatttaaaagaaaaaataatatgttgaaaggcaccacaagaagtgcccaatactgtccaataccatgctgaattcataatttcttctatgtataaggaattgtgtgccacacacttagcctaaacagcaatcatataaaatgacatcaatgaccacaactatcaattatgatatttttattcaagtgctcaggtattagagcataacaattgcagagccatttcagggttttctgggggtgatgagtttaacaatggacaacatttgggtactgaacttcagggacattagccgtgtctgttagcaactctgcaagttgcttttgctgtatttgaacttacaaggtacaaaatatacctcacaaggggaaattcagaagacagtctaataggtggctcccttctgtgctaatatgtgactttcaatccatgtcataagattcttataaaaggtttagcatttgtaagtcctcatgtatagattgaaaagaaactatcagcacaaattcccactgaaaagaaaacttgattcttagttgttttgaaaaatgattttatttttatatttttctcaatattatagtaaggaaatgagttcatggtcttgtaagcatttataaagtatataaaatgatgaagagaaaataaattcctgtaaattgaatatttttataatctcaaggtaaggaaagcttttttatacatggcaataaatcagaaaaattacagtgaaaatattgatagaaccaaatataaaaaaattaaatttctataggagaaaatgccacatcatttgacattaaaccaaatgatacatttgaaaaaaatattacaacatatatatcaggcaaagggtcaataaacacttaagcagcccaaaaaaaggttgtttataaatcaataagaaaataaatcctacttgaatagggggattatagccttaacaaactctttctactctaaaagacatgtgaatggccaataaataagaagatatatttccaataactagtcattttaaaacacaaataaaaacagtaacaagatattctattatttttcagcagactatcaaagataaaaaaaaattgtcaataacccatgttggtgatctcacatgctgtaggtacgataagttgaaatatcaatacctttggccctgcaattacacaccaggaatttatcctaagtaaattatcattcaagtattcaattatatatatatatacacacacatatacacatacacacacacagatgctcattgaagcattgtttataataataaaacctgtccaatgatgagaaatatgttaaataaattatggtgcatctatatagtagaatactacagaaccaaattaagagggaaatatatttctatatttataaatattttatcagtatatcagtaagcagtcaagttacaaataaatatgtttactttgattctagttatgtaaaattctgtgtgtgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaattaaaaattgtgttagccacatttcaagtattcaatagccatgtgtatctagtggctaccatattggacagctcagatttggaatagtcccagcatcaccaaaaatttctgttgacagcactggtctggaaagatgttctccaccatgtttttaatggttgcttctggctagtgggatctggagttaatttcatttaattttctaaattgcttgaactttttatgagcatgcaattaattcatattcagaaggttctgtcatctggaaaaaactcacctatgattccaccatgtagaaataagcattgttaatattatgttgtatttccttgcagtctttgttctaaatgctcatagttgcacagaatgacaatatgtacatgtttttaatgttgtatttatatctaatacaccataagcattgtatcttattctttaaagctcttcataaacattactttaaaaagctgcatactgttctgtctaatgtccttaaatgatttttgttatatatgttgccttgaatgtactaaaatatttaagaattttgcaaatcagttgggtttgggaaaatcaaatttatagggaagacagtgatttatagttcttttgttatatgtagaggaccatctaatacatcacgctttggagatgctttttttgttccaaatcactattcaaaaccaccttcacaaaacataatagctttagaaatcaatgtttttgataaagtgcctttattttcaagtatccactttccctactgaatgcaacaatgcacagacatctttgttattatccaccttctgagatttatccaaaatgtgtcacctctctttgaatccctttagaaaccattctttgatgaacatactttatttggctctcctggacaacattttgataaatataaaatgactttaacacaagaatcaaagggaaaaaaatttcagaattaaagaacaatgacctgaaatccatggaagaggagcacgtgtaacaaatttacttgacatcttgctctgcaagttgcttttgctgtatttgaacttctctccggaataaaactgaaatcaggggctttgtgttctataccataccctggtacataaaacctttccaattacatttatgttctcctaggagggatggccccaaaggcacctcagactttgcatatcaaaaaccaaactcataatcataatcataccctgtactcctccccaacagggtccttctccagatctccctgcctctcttgactacaactcctttctctcagttacgcagttcagaaaccgagggttgttactgacacctccatttcttcaaccccaaaactgaatccaacatcaagtcaagctgattttgcctcttacatatctctccaaatctgtcccccatattctagcaagtcacattccatccttcccccgtttaaagccatttggtggcttccccttgcttgagggcttagaatgccttgacaagaacaaaccttacttccttgcagaatctggctccttacctatacagcttcatttcacccaaccttctctactagcttttaattttctcatccttgctgctcttcctcctaccacaagaaatttgcataacatgctactccactgcctgaagtgcttcttactaaaccctccttcatctaagactcttctccatctttcaaatttcaactcatcatatgcttgtttagggaagccctctctgatttcattaattatgttagactcacctactaaactcttttgcacacattaatgaggctgtttgattaatttaatgcccgtttccttgccagaatgtaagcaccaccagggtgtaagcatctgtttttgttcactgatgtagctccattaactagcacagtgccagataaatagtaggtgctcaataaatatttgtttactggatgaataaagaccatgagacagatgcccccaagcacaaggaaaatgctgagtcttctacaaaagaatcttggagcactggtcaacagcagagcctctctaaagaaacagattcccccatgaggagaaagctgcataagtcatcaaactttatagtgaaatatcctaattacatttccctttgagttggactgtactgtatgtactgcactcagtattccccaagaatagtttgtatctgagatatagagcccaggaggctaggcccaacaggactattcttggggaatactcagagtggattctatttatgtatcccagagaaggcctaaggagagagatcttgaaagcattcatgatgcaatctcctgctgggaagaagaaagccagatgggagctaaaaattgatgccaataagagatttggagcaatgctgttcaaactgaggccttttcctgtttcccaggagcatagagtcatccttctactaagttttaagacttacagaccacctgtaaatgtaactggcagtgtgctgaagccagcttgtaccagttcatgagagccaattgttaaatgtttgctaaatttgctacagattgatacacacagccattatgataaattaaataatttaaacttaaagctaaataaattatactaaaaatgcaggtaatgaatactcaaaactcatcactttctaattattttattaaatgttatgattaagtatgattttgaggctatttatagtcttgtagctctatggtgaaattgtgtgctacttgatctttttttcaattctgaattcagtgagatcatcagggtggcttgaaattggctatgttgggagtatttacaccatggaaaacagtaaatgctaacattcggggatttggaggcttttgttgttgttgttttgggttttttggttttgttatttattgtttgttttgatttgttaaaagcctgttgttgaacatttaccggcataccacaagaggcaaccaattcatggcccaatgtaatctgtctttttgtacttcattgttgaaattacctagcaatactaggaaatcttaggtcgaagtggaattgtgaatcttccaatcgtctaaaccacatttcttctaaactacatttcacaaaaacatattgggtgggactcgtttgagaaaaaaaggttatatatatatctttttaatcccatatcatatactgctattttttaagtacctaagatagtgtttggtataaattaaccatatagaaaatatttgaataaattaattataggagtcaagaagtataataatttgagttaattcttgacaataggatgatttgaattctcttcatataaaatgggtggcattataattcatttcaaaatatttcatgcattaaatatcttcttaggaagatgcaagaacacttgacttcccagttttcaaaggattttaaaaatcctctgggaaaatattggttggggagagaaatgatggctgtgaagagggagatgaagagaaaaatgtgaaaaaagtgaacgagatttgagaacaaaaggaaaaaataattgcctaaaaattaatcagtgcaggccaacaactaaaagaagtgactaatgtcctgggaatatttactgcttttttgtaaaatttttttaaaattaagagagctttacactccttaaatttcctttctattccctatttagaattgtactggctgggtgcagtgtgtcacacctgtaatcccaacaccttaggcaggcagaggtgggaagatagcttgagcccagtggttcaagccctgcctgagcaacacagtgagaccccattttccacaaaaaggaaaaaaaaaaagttagaattgcactaacaattctggtgatagcttttacaatcatataacataactaacaatagacacaatcacataactcacaagacaatttttttcttattgaaaattgaggtcttagagatgacaactttggtcttcatgtataatgtgttttgatggatcaatagtaaggcattttagaagacattttcttactttcacctcaaaagaagcacacacacacacacaaaggcatattgaagacggggcttatttaaatgcaactagttattccttataaaagtagacatcaaaccttatcaaggctttgaattgttaagatctttatatccctgtgtttctgatggtatattattgatttttatgtattatagaatatagttaacccatgtgtatctagagtaacacaaaaggtatataaataaaacaaaggaaataaatctgaaaatcaaatagtatttactcttagaatatttttataactttcagcaaatacgtattcacatctatatttagctttatagataaattacccatttacttcaaactccttcagttacctgtagtgaactggtgggaaattttctcgctccttttaactcctacaatcatttataattttaagaagaaaaagaggccgggtgcggtggctcatgcctgggaagctgaggcagatggatcatgaggtcaggagtttgagaccagcctgaccaacatggtgaaaccccgtctctactaaaaatacaaaaattagccgggcgtggtggcatgtgcctgtaatcccagctactcaggaggctgaggcaggagaattgcttgaatccgggaggcggaggttgcagtgagccaagattgcaccacggcactccagcctgggcgacagagcaagactctgtctaaaaagaaaaaaaaaaagaaaaaaagaaaaagataagtataagctaacatttatttcactgcattttttcatagcattcttaaaataagtaatcatgtcagactccacaaaaatgtattaattctttatgtacatgtgatacattagagtttgaggatttaattttgatcaccacactaatgatataaggtgaacagacattgctattatcattgttaaagctttgagaatatgagttgcctaatttacaaagctagttaaatggaagaaccaggaactgaaaagatctagaaatgacttgtcctttagcactctttaaattaagcttcccatggaaaaatgaattaagggaaaaacaaaattaaagtgcaaatgtttagaatataggtagtcaagtatacacaaaccatgaatatattcctaaatgtgcacacaaatatacatactgatcgacaaatctcaaagtaagtaaatggatatacatacatatactaaaatgttcttgtctctataagagattaaagtattcagtatgttccccccatattgtgtttcattttcatttgtagaacttttcagtgtctggttcttccatttaactagctttgaaaattaggcaacttgtattccctgagcttcaacttagttttccctcaaggtggatgataatagcaatgcctggtcaccttacagcattagtgtggtgatcaaaatcaaatctgcaaactctaatgtgtcacatgtacataaagaattaatatatttttgtggtgactgacatgattgattacttattttaagtatactaccagctattaattttttttcaagtactcacaacttgttatgtgcggctctcagcccttaacatataatgattcatttatttcccataataacctttttaaggggacactactattatcctcatcccacagtttggaaaactgaggcacagaatgattaacaaaattttttaagttcacatttcttcaaacgacagagccggaactcaaagccagacagaatgcaggctgtctggctgggcacggtggctcacacttgcaatcctagcattctgggaggcagagatggacagatcacttgaggccaggagtttgagaccagcctggccaacatagcaaaaactcaactctactaaaaatacaaaaattagccaggtctggtggtgtgcacctgtggtcccagctatttgggggctgaggcctaagaatcgcatgagcccaggaggtagaggctgcagtgaactcagattgcaccactgcactccagcctgggtgacagagaaactctgtcccctgcccccaccaaaaaaaaaaaaaaaaaaaaaagaaaagaaaagaaacagaatacaggctgtctgctgttttcctccatgtgtcaaaagctcacagcatagatgatggattttcttaacaaagggaacatcgtgtttgtcattattaataaattgtcatcctccttttttgatatgtttgattttaaattatgctctgaggttttagaagcccctttgacacatctaactatagcacagtaccatggaaggaagtagatatcattacaaaataggaaaacttaaatctcaccaataaagaactcatcaactagggagatgctgcggactcattgtaaaagtgtctgtgcattctattaacaaacaggcgtcattatgatagctagaagcattgaccttggatgaaagttgaggggaatataatgcttttcatgctttgtcgggggtttaaacaggaaggcacataggatcctaattgtctgctttgcacacaccattacccctcagggcatgtggattttttatgcattgcagtggtaagggctgtgcatacaaattttgctggcagacaggtggtagcatatgtcaaaaagactggggggatagtttaaaacatggctgaaaagttgtctatactttagaatttttaagtttgacaaatactgactcaatgaggaggaaaaagctaactactttttccattgactagttttcaaattgctatagttcatgcacttttattttcagcaaggatgattgtacaaataatgattaaaattgaccatttagcttcgactctttgctaggaaggcaagcacttccatgagaccacctttctttcctattttgatttctcatatgcattattttatatttttaacaaactgcctaaaatatcgctaaacaaggtaacttgaatgagtgctatttaagttttattctgccaattgaactatttgcactattttatataaactgcatcaaattggatatactttgtaacacggtgtgatatggagagggcttagagtttaccatcaggtgtacttggattcaaatctccctttacaccattttataaaactgagcaaattacttcatctttcagcacctcatgtgaaattggaataacaatagctatttctctgtgttagtttgcagattaaataggtggaagaagatacagaacagctggtgtggtagttgacacagtcactaattagaagaacttgttgttatatgtatcatttttatagagaactgaacagagtcagcactttgggaggccgaggcaggcggatcacgaggtcaagagatggagaccaccctagccaacatggtgaaaccgtctctactcaaaatacaaatttagggggtggttggtggcgcgtgcctgtagtcccagctactcgggaggctgaggcaggagaatcgcttgaaccagggaggaagaggttgcagtgagccaagatcacgccactgcattccagcctggtgacagagcaagactctgcctcaggaaaaaaaaaaaaaaagaatcttagtagcctatctgatgaaattctttcaattatagatcccatagaatacatgaagattaatcaatattgagataacatttccttatttcctataatcacttctttaatgttgtaacaggtgtattcaatccattgatattctattggctcactcacagaggttacctaaagagagttcccatatagtcctaagaatgttttccggctatggaaatgcaagagagcacaccaggaatgactgtccaccagtgatggatgagactgaacagataaatgctgcagtttccaggctacttagggacatcctaagatgtgttcttcattctgtctccaaatggcactagtgttttgagcctcagttgcccaaaatggtaaaccgctaaattaacacagtctttaaagaccttcttccctccttgtcttacttccccactcctcactgtgctttctgcaatcatctccaaaataaattacttgtcctcagatctttgattgggtcagcttctggggcatccagacaaagatcctgtctgccaagcatgtgtattgcaacctgggaaactattagattggtgcaaaagtaattggggttttgccattacttttgcaccaacctaatagctcaggcaatgcaactttttgaaataggtaatagcagcattttcccagctctgaagctgtctctccacattctgagcccaattttcttggtccaaggactgtggatactttatttcaatcccattttctgcttcttctatggtcagcctgcctgaatgccctccagcagccccttatctttccttccttcctagctctcgaaactgcattaaaccagaccctgagcttgttcctggagatgaggaaaatctaggatgctatttagggatgctcctttaactttatttatctcttctctctgactgcttccaagaacaaccaaacttttagctccatgggaactccagggaacttttagcttctctgtttgtgaaccaggagaatattatctggatgatcgccttcgtgtttcttctaatttttttttgttttagacttaaatagtgtgttcactttagctcaatcaattcaagcctgacagcttcaaaccgctttatttcagatgaagatgcatggctaagctaattatattttctcttcttcatcaacagttttctatacttatacagtgactttataaattcatcattattccatcccaaaacaaatatgaatactcttgttatggtaatgccactgcgggatatgaaagggcagtcctctaccagctcgtttttttcctagtatgtacccatagttgcttttctttgacatagtcagtctgttctccttctactccctctagttaaaaaaaaatagctaaaaaatatttaaagattttccatctgttacttgtgggaaagaaatacttaaacaagtaacatcctccgagtcttttgctctatttagaagaatattcacagcaccatatttcagagccatcattgatgcaagtggataggtgtttcctctataaaggcttgctggctgtgtgagccgcctaagccactggtacaccctggtgaacagaatgatagccttcatcacactcatatataaaagaaagaaaccttgaaaatgagaggtatgaggataagcattgattcaaggggaatttgttagtctgtgttttattttctgagatgcaaatgttgaattcaagggtttgatgggaaaccagcctggacgtaaatttatacatttcctccacaatgaaatttgaataaagcatagcaagtcggctctgccttcaaagaaaaggtagctttatcactatgaagctgaatcacacgaatctcacttaagtataaggaatccatctctttcatttccaactgttgtactgagtgctactggaaagcctcttatatgcttgatgattgataggaatggatttgagttccatccatataactgtaattcagattgagaatattgcattaagtgcagggaatcaaattaacctacacaaatcattggataagcctacaatccaataaagatacatttcatgagtatgaaaaaatgagtaaggtatatcttctgcacgaaaaatgtttctggtatcaaaaataaaatctaaaggtcatgaagagatgttttattttgtagatacttggcatgcaaataaaataacctttttaaaaagtggtattaaaaagtaaggattcaaaccagcatttaactctttttttaaatcatcctttagcctgtgtttattccttccattaattttgaatattttaaatgatataatgcagtaacacatgctgtaattgagtccttgcttcttaggtgtagaacagtctttactttcttcagtggccaattacctgaaaatgggaatcattaacatgagctttaacaagagcaaaactcaactttctttgcaacagacatgaagtaatttaatcacaaatcctgatgattgagagaaaatgaatttacttagtcagacagtctttatttggtagcacttatgggaacagaaatgatctagatttaactttaaaagtggaattcaattatagctgccaggattctgagttggtctggttaatttcagctgtggagatacatctaggatattctgcaggtatttacctacttgagtaggtaaatccttctctggaaacttcttaggaagttgagtctataagaaatactcagacataaagctccttggtagaataggtttgggagataaggtggtttgcatgcaagttgtctatcagtttgtgttattgttgctattttgattttatttgtttgtttctgaaacacagccacccatttcccaagaactgagaatgtcatactctggaaaacaaccactttttacacatctgttttcatcaaattccttctacctataaagtcctctaaaaacttgatgcatttgcagtttgtccgtccagacaatcccctctttgtgtattctctgaaagtctgaaaacaactgaggacaacttgaaggtacaagtgtctttctcggtctaccccttgcgtatcaatatgctcaacaaagagctgcattcaaaaatagatacgttattgagtacaggtcaaataaagagtgaacttgtttcttaaaggagaattctaacataatcaaggttagtgttgataaaaatgaaataaatgaagaaaagatacagttttaaagataaaatgaccagtgctggaaaagaaagcaaagcatagtttaaatcaatgtgctccatcaccgaaaaaggacgttagtaagaaacttggcttgttacatactttaaattctctgtttacattcagaactatatggttttaaaatattgtggtttcttctgagtaagtgtttctcaaatctaagtgttcctttagttcatacacagaaacctttttaaatttttttttcccaaatgttaaccatccagatgtagaatcatgtggtgagtcctcaaatacttacccttcagattcaatcagcagcatcattttaccagcctgtttcatccacctaattccagacatcacttctaaatacttcattataaatttctaattatataaagaccaatagtcttttaaaaaatataaaacacctgtaatcccagcactttgggaggctgaggtaggtgcattagctgaggtcaggagttcgagatcagcctggccaacatggagaaatcccgtctccactaaaaatacaaaacttagccgggcgtggtggcacacccctatagtcccagctactcgggaggctgaggcaggagaatcgcttgaacccaggaggtggaggttgcagtgagctgagatcacaccactgcacaccagcctgagcaacaaagcaagactccatctcaaaaaaaaaaaaaaaaaagaaaagatatatgagcaacaattactggggaaacttttcaaacaaagatttcagagagttggtcatgtttcttataaattcttagtggaaatcccagaagctcttttccagaattgttttctactctgagcacctactctgggtggtctttacttgcctcgagttcctttatcttaaggatgattcaagagaatccctgacccccaaacctagtatctgcaattctgagaggtggcgatctttaaccaatcatctgtttatcaagttttgagcaaaagtattttgaatggacatgagaattaggcagtaaaataatgtagactgaacaaaaaatgcttgggggagaaaaaagccggagaatgagttgtgtggctatcactggaaggaaagaaagggtccaatgtatagatctgattcatctccaaatattttcccactaaagactgtggaagtaaatatattgatggactctgtaatcactgatttaaaacgtgtgatttataattacaagtttcaggtgatttctgagaatgctttttctcttctgagtgtaccaaaaagaaccccacaaaattacaagtactaatatgttttctctttgaaccttgtctcaatggtgttcaaaaactttgatgcaattaatcaattcataaaacaccttgttatcaagtttaattagccttcacaaaacattcattcttcccgaacattctcctttaatctttcgttaatggtagagtgctaaatgtttcccttttttgctattattgtttatttaataaaacttttgatatagacctctccttttctgggtcatgcaaattgatgttttagtgatagcatttgatctttctaggaggcttgatgtacttgataaggtttcaacttgttagtgaaagtgagatttcagttatattaggcagagctttgaaatggggttttctttcttcataactttcctgaaaaggtgacttttcatgcagccaaacagagaaagttttattaactaaagagagaattaatggcaccaagtaaagtaactcagctggaaaggttttgtttgttttctttcttggttgtgtgtggtttatttaaacatctactatttttttaaacatctactatttagattttttttaaacatctactatttcttcataaggatgctgtatatcaaaacctccaaaaagaggtcagaatagccagtctaagtaatcaggacctgttggcccagtatttagctaaataaataagaatgtaagtgtactcctggctcagaagctggccagcaaatttgctaagtgattgatttgatgctaattttctgcatggacttctcatttccttcagggcctgtcctatgggaggaaataacttcagccaagctgactgagccctattttaggtttcactttgagctttgaatgtttggaaaactccctttcccagcaggactacatctccaaaggatttccatttatgatgacccaaagaatgcaacttgctctaaaaagactgcagaagttccctatgtccaaatcccagtacattccgaggacagaactgaaatcaacatatgcatggcaggcactacgattttgctcacgctaattctgtgtctctttgcatcagtactgactgttggagcaggtctacgctgagagccagggctgtgtttcttccctagtcctacgtaggcattgtcatattttaatttcagaataaccaccttctttgtcttagtgcattcaggaattaaggagaagaatagagatttttcattgcaatacacaatttatgggatgattgaaggaaatagagaaccatgacacataaaaatgtgtgataggatcacagaaagagcacttaactgcaggctatagtcttgagccagaaattgtctctccactacctctgggcaagttgcttcatctctctaggccatttgtggaatgggagccttaaactcctacaattttctagtaagaataaaagcaactttgttttgaaatcattctaactcaacagaagttgaagttatgctatcacgttggaatctctagttatagactaattattttcaatatttattacccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggtatggtggatggaaattgctaaagcttatcatcatgatctgaatccttgagctatcatactaatgcctgcaaaagactgaatttttgtcatatttagcatgtgttaaaatttcacctaaaaataattcagctgccaagtataagtgcaattaaaatacttctaaataatggcatcaacttaagaattatggagatttttttcataaagaataagccatttggccgggcacggtggctcatgcctataatcccagcactttgggaggccgaggcggacagatcacttgaggtcaggagtttgagatgagcctggccaacatggtgaatccctgtctctactaaaaatacaaaattagctgggtgtggtggcgggcacctctaatcccagctaattgggaggctaaggcaggagaatcgcttgaacccaggaggtggaggttgcagtgagccaagatttgccactgcactccagcctgggtgacagagtgagactgtatctcaaaaaaaaaaaataaataaataaagagaataaggcatttgatatagtttctttgcataacaaaatacaaataaaaccacattctatttcatctaaacactttctcccaagtcattctctcttagcctcatccctatgccacttctaagtccgtgtcatttccagctctctcctaggggacagacatcttcagccctctttaaacttcttaatccctgggcagcaactagcccaccataatccatgtagtagttactcagttaatatgtagactaatgaaaaactaacagtttaaaataaaaattttagataataatgaaaataatattaagtaagaacaaataatatttattcaattacggattagaaagatgaattagatatggcccacccactgaggagctgccatttcactaggagcaagcctttcagatatttacaaaaatagctagaaaacaggtataatgtagcaaacaagaagctgtgaacatctaggacccctggattcaagtgcaatgctttctctagaaacgtccaattgtcattgaaagaatactgaaatgaacatatttaaagaagagctttctttttccatttttatagtttataaaatactagtgatagtccttctccttcatataacttccttcaagagttgagaatatgaatctaagaaaactttgagttctgcatataatatatgtgccttacagagcttctcatgtcatgcatcacaactacagggtcacttcatgtcagtgtgcattgtctaagtattgtgatctacaattttttaaccctcagtgctctggtgattttctgagctacaccagatgtgttggcctggttccttccttcctttctttcttttctttcttttctttcttttctttctttctttctttctttctttctttctttctttctttctttctttctttctttctctctctctttcttttctttctttctttctctttcctttctttcctctcttctttcctttctttctctctttcttttctttctttcttctttctttctttctttctttctttctttctttctttctttctttctctttcttctttcctttctttcctctcttctttcctttctttcctttctttctttttctctctctctctttcttgtttttttttttgatggagtctcactctgtcgccaggttggagtgcaggtagtggctcctgcactccacttggctcacttcaacctctgcctcctgggttcaagccattctcctgcctcagcctgccgaatagctgggactacaggcgcatgccaccatgcccagctaatttttgtgtttttagtagagacggggtttcaccatattgaccaggatggtcttgattgtcctggtttctgtgtcattagtgattattggcagggatttatttctaacacttatgtaatattgactttaattcttataatgggatgcataaaatgccaaccagttttaatattctaatgtctttagaaactactctttccaagtatgttgtaaacagaatctactttctctctttataagccaagttacccatttatttctatagtatcatttatacttggagagatttcagttcaatgaacattgtctgtgtgacatatactttattttgctgtatatgaatggatagttggatggataaattaatacagaaaaaacagattctaagtgtttgcaaaatatttttaaaatatgtttccccaaatgaactatattccttttataaaaagtgaccaatttatgggatgcactaaatctcaattaaaaacatgcaataaatggcagtggctttcagggaagcttttgctaagagtaaatatatttatattacacatcaatctgcatatcttaagttgcattaagcctttgtgcagtcctatctaaaatatatttaatttcctcttctctgtgggttactagccactaattttccttagggatttttatctccaatccctgtaatattccctctcaggagtgcatctgtagagattttcccaggggctacttgatgttcccagtataattaatgaagctatggagaatattttgccttccctggctgtgatgttctatagagtattttcccccacactgaaagtgctcagccagaaacttaagatttgcaagtaccactgttaccttggagcatcacgtatcacagtcacacagggagcctgttaaaacacagattgttgggccccagccccagcaggtctgggatggagcctgagcatcttcatttctaactggtcccaggtgatgctaatgctgctggtccaggcaccacactttgacaatctcttccttagagaagcttgggcacagtgttgccagatcttgaattttcttctaaaaggagctgcaaaatccatgaaaggtgttaaatattggcaacagttgtttaaaaacaccatgtgaaccaaaaaaacattaactatggtctgagtaagacttgggagcttccatttggcagctttttggtctagattcacattaagtaagaaaaacattgtgctaaataaaacctcaggtcctgaccactgaatacaatgggggaagcacgtaacattatcttgcagagcagaatcagcactctccaccacatttgttcattctctaacttccaaaccattcctagagccctctgggtgcctaagaaatgtgaccttttagcacagcatttttcagtagacagagaaccatctgcccccttaatggtcattgtggaaatttttcagaagttttataataggccacttttttgtgacttagattggatcctattcttaaccacagcatctctcatcccctataaaggaaagagagacagaataatataaaaagaaaatcttttggatgtctccaggttccatttttaaacatgtaacttgaaaattagagaataagggagacaaatcatgcctttgggccaaatttaaaagtcaagaagaacacaatcactacacaatgtccttacaacactcaacccattaattcaacaaatgaaaaccaagcaaatgagaaattactcctggaggagacaaatatgggttttttttgcttttttttttttttttttttttttttttttttgcctgctgaaaaaggtaagactttgttgcaaataaaatatgttcccctgaaaggccataattttgactctttttgagaaggaactaagtggcacagaactcatactcatgagttctgtaatttgggccccaggaaggaacacagtaaacgggagagagcactagagaagatgtctataaatgagaaatgttagcaatactcttctgccaaatggatatgagccttcaagcccgttgacagtttgggtacattcttcatccataaaatgaagaacttggattcgttcactcatttattcaacaacattttgttaagccttctgcaatgtgccaagtcctattctagatactggagatcaagcagtgaagaaaacagataaagacccttgccgatgtggagcatacattctagtgtgggagacacaataagtaaaataaagaagtcagccacgcagtgtattaggaagagagtgatattgacaaaaatgagatagggatggagagtgcagtggaaaagggcattaaatagggtggtcagtgtagccatctctaggaagtgacacttaagcaaagactggaaggaggtgagggaataagtcaggaggatgtctggagagacagcactgcgcttgcactacagcaggtgcaaaagccctgaggcaaaagatagtctggtgtactttaggaacagccaagggcaagcgtgacagcagctgggtaagcaagattgagggaaggtagtagcagagggaactgaggaggcaactgcaactgattttgctgtaggatggcataggcttttgaaggactttggcttttactgtgagtgagatggaagccccgagagggtttcagctgaggacagatgtgatttgacttaacatttaatccataatggaccgcatgggggaggggaaataatggaagcaagcagattcgttaccaaactattgaaatatttaggtgagttgctaatgacttagaccaacgtggaatgtggaggaaataaaaaggaatccaaatttgcatgtatgtacacacacacacacacacacacacacacacacacacacacacacacatattataaagaaggaagtgatggcatgtgtttatggattttatgttgcatgtgaaagaaagatgcatggaatcaaagacgatgttaaagttctggcccaagaggaaaagatagaaatatcatttactgacatagggaaaatataaaatagaatataattttttgtttagaagtatatagcagaagttcagttttggttacgttcagtttgagattattattaaatactcaactgggtgattttgagtaggtagttggatatatgagcctggaggtgagtgccaaatataacacgtaaatttgggggtcattgggtatttgattgtattaaaaagtcatcatactttttaatgaagctggatgagatcagccaggaagtgactgtagatagagatgtccaagggctgaatcatggacagtccaacataaaaagaatcagaaaaacagaagctgagaggaggcagccagttaatgccatgctcatgggaactgagccagattatttaatgttttactgaaatgtagcatacacagaaaagtgcacagtttcttactccataccctgatggagttttgaaaaaggaatatatccacctaatcaacatccagatcaagaaacagagcataaccagcaccctagatatccaccctactaacacctctatatcggcagttaacatgatagattagtcttacctgtttttaaaatatctgtaaatgaaatcatacaataaagtctttttggtctgacttctattattcaacattatattatgagatttatgagattcttctatattttctgtgtaattgtagtttgtccattctctttgctaagtagtagccagtaatttacttacagttcatgggcattcttgtagttgtacgtttagggctgctacaaataatgatgctgcaaacatctgcctttcagagagctagatattggagtgtaatgactggtcatagatctttgtgtgtactgctttgatagatactgtccttttctcaaacttgttgagccattttgattttttaatattatttcacacataaaagaaaaatttatcagaggatctctgtaggttaaattattacattttgaagtagctgtcatgtcacagaagaaatgcgctctctaaaaatatgttatataaagtgaacattagtctttaatgtttgtaattttagattcttccccctctgtagctgtgagtatcttggagagtctaattcacttatttcaaggatatgagtgagattttctggaagttttcgttaacttcgtctatatcagtttcttgtgcacaatctagataacacaccagctctctgaatttcctaactagctctcacatctctttcctgctccccattcttcctgccatcttgttaagcccttgacaggtctcatggatagtcattacctacctatttcctgaaattctctcacactttgctctacaaatctgcctgctcatctgcataagaatggccttttaaaacaacaaactcattcctgatcatattttaaatcattttcattctctattacctgcaaaatgaagtttctgtgcatttagtgaacaaacatttattgagggcctagtatgtgccaagcacctcgctgggcactgaggattcatcagtgacccaacatagtccctaccctcaggtactgatgatccaccactttgactgttgcaccattctgttctagcagctcctaactacttgtgattcttctacctttacaattgtaatattaatgcctttataatatggtagtttcctagactgcctttctctcttttgtccaccaagaaaagtcctaggcctcccgagggactcagcatcaactcagttcatccatctctcgctctatctcatgacttccatgcatagcccattgttctttcatctgttgttctgtgaaccttgaacatattttcaattacagtcattacactgtaattatcaatcagtgtgtcttataatctatcctgtatttgcgagctgatgaaagtcaaaaacagtagtttagtctgttttgtgttcccaggatctagcttagtgcttggctcaataaatgcgagaggtgtgagagaggaaaggaagggaaaggaaaggaaggaaaggggaaggagaagggaaaggaaaaggaaaaggaaaaggggaggcttttgaactcttgaaaataagtgataggtcacgtacaatcttagagtcatagtggcttttaacaccatgtgctgcaatcttttcatttagagttgggagaaattaaggccccttagcagattggttgcttaaggcttttcctagaataattctctctccagcttgccaggattctcagtaggaggacccaggtggcattcattacgatggcttccattttcctaatcttttttcccaaagctaaccttattcccactcagagttactgtgactgtcacttccctacccagcagttactccacgctttcttaagcaaatgaaaaatagcttctatttaccaaatagttgacacctttcaggataaggaaatgagagaagatgtcacggagaggggaatttcttttaagcaaaagaaattatagtctatgggataaaggtgggaaatagaaaagaaagagggacaagtgaagggttctgctaaggccacctccgggccattcatcaaaaacttcaggaattttcttagagttgccctaaaataatagtattagctatttaaaagtgacctcaagagacatgaggttcttatatttatttttattctgggaacatatgcattgaggtaagaattttgaaacacttgcgtatattctgtacaaaatgtgtgctttatctcgtttctattttgaatttcaaacaaatttatgatgagtaagcagtagctgtaagtttgactttaaatgaaaaatgattaagaaaaaagaaaaggtggtgccataaattgtgttcagcaatttgttttgggacataatggaaaactgtgcatgacttccttgcaggtagaatacatgtgccaaaaagatcactgtttgcaaacatgaaaagttagatccatgttattgtgttttgtgagatcatcattacctgctattcctgaccttattatattaaaaaaaaatgcctgtgtcatcttaggctattcttccacccaatcataaaaaggaccaaattcttactgtgtcaatacattgcactatttgtcttggaattttatactggtaggtgtcctttgttggagaatgagatttactctacattctgcacattttggatatgtgtcaggcaaatgaaggatgcacaacttaaacttttatattgtgaaaacatcgtctatctggaacatttgtttaaaagctcataagtcaaaagaaagacattcgtattaaaaagatttttattaaaaaaggggcaacttggatttcagtctctcccttacacacacagaagcagcagcaattgctattctggtgactgtggaagaaagcacccctgccttctgtctcctgggtgtcttttctgcatttgctagacaagaacttttttggagccagagagtgctcaatggtgcccacataaaaacaattaatgtcaaactgaagggaaaatgtcaacgctgagacatagaaatgactgtgatttcagactgtgggttactgttagtacaagcccacctctcccctgaaagagaaaacagaaaactgcatcagcaatagcatctcttctttccttccatccactccattgcagagacaagctactcttctgcatacctccatctgcctaccttctgatgcctggcagctaagtaagccctgattgcattaccggtgtgcctagcctggaagcaagaacatgagcaccacaaaaaaaaaaaaaaaatcaccgtgactttttggaaggaagaggagttctaagaaaatctggcttccttgtttaaatttctccctccacatataaaatattggtgttggcaggggaatactgacatactttgagaaaggcaggttgatctgtttcacctactaccttgatattggttgtcatctttagtagttaagccaaatgatgcccaatgaaaagctggcactaaggattaaaaatactttttgaaaataccttgctagtaattttcctgataactatattataattttcattcattcaacaaatatttacaggcataatcagccaatgaaaaggtgaaatcagaagagggaaattaaggaagatattacaagaaaatatctgagagctaaacaaaagtactggtcttaaagtctaaatagcaagtacaggaatggagtagattcaggtaatgagtaggaaactggaagatgacagataaatgaaaaagacttaatttttttctctccaaaaaaaagttaaagtagaagggtggggataaatgtaccagaaatgtattatccaaatataaaccatgctaaaacatgtaagattttcaaaaactgaaaaaagaacttaaaaagataaatatatacttgttattaggaatgttcccttcggaaagccatgtgggttatggtgttggaactgaaacaaataatctgatatattctaatatatggcctagcagaaaattatagttgcaatttcatactcatgtaaatttttattatatttgttttaaactttcagaatcaatttatatgcaaataaagtcataattatgaatgcggaacaagataaaaactgaccatttattttatttattgatttatttttgagacggagtctcgctctgtcgcccaggctggagtgcagtggcgccatctcggctcactgcaagctctgcctcctgggctcacccgccattctcctgcctcagcctcccgagtagctgggactacaggcacccgccaccatgcccggctaatttttgtatttttagtagagacggggtttcaccatgttagccaagatggtctcgatctcctgacctcacaatccgcccacctcggcctcccaaagtgctgggattacaggcgtgagccaccgcacccagccaaaaactgacaatttaaaagtgagtttaagctaacgagagttggaagtaaaaggaatggcaggtaaatgtcctcctatcataaaggagccaagggatactatttttaatgagtggatcaagagagtttgagtatgttgcttgagattgtagaggtgacagggaggaaagggcacaagtgatagaactctatcacaagcaaggagaaagggcaggtgagagatggaatcagagatttaaagcctcctcaatcagagcaggatattatagtcaaattctaaaatcagtcaaggaaaaacattatacacgcacacacgcacacacacatgaaaaaagcattacacacccatatatataaatagaaatgtgtaagtaaaccccagaaatttaagaatagaaatgctgaaaatagttgtcaagaaacagaactaggacgtagaagtgatcattgcctttccaacccctctgaacaacttttaagaaactctgtctctgtttcatcgataaataatagttttttaggttactatcatttaacaagcatatattacacctgtcactggtctaacatgaattatcccaattctctcaaaagccctatgaaataaattctattattgcttccattttataagatatatgaatattggaggacaaatttaaaaagacttgtccaacatgattctgtctttgcatttggcctggagtaacagaaaaccaaatcaaacaatagctgagacaaattaaggatttttaatttgtgttttgttcagtttttcttttcttttctttttttctcatgtagccggaaccctgaaggtagtgttgtgggtgccactgcctggggtgggcattgtgggtggtaagagaatttaccaagacagtgataggtaaagaaaggcagatttattagagaaagtttgaagatatgttgcaaaggtgcagtgggcagcacagcagagaaggggctgtctgcaaagaggcagggattggagggaagtttcatagggtcatgatggaggggttatgtgcagaatgaggtcatgcttctggagttactgggactacgtgctgaaggagctatttgggaacagagtgttgtgccagcgggttgtctgtgattagccatctcagattgttctccccaacctagggccctttcctcattgttgcttacttatcttattaggactccacaggtggtttctggcactgattcaggagctcagggataacaaggctgagtgaggcccctatgattctcgtggcctttttctcatagatcgagatgcctctgtagctctagcctttccatttacattccctacagtaaaaggaaaagagatctatatcaggaaacacattttcccagaaccctccagcaggcatctgcttacatgtgatttgccatgtggcacatgttggtcacccagctgctaaggacattggaaaatggatatttttttttcagttgaacatattattggcctgagcactgttgggcctctgttaggcaagaaggataaaatagatatgagatagcatttggcagaaggtcccagctagaaaatggtagaattgtgttctgaaatccaataaattataaccatgataagctagaacaaggatctgcaatatgaaagtcaggaagagccattaaataaactgatatcaatattttacttttaaattagaagacaagaaaaaaaaaaaaaactgtgtttaagagtcactattccaagaccttcacaggcagtgagaatggtcaaagatggaacaatcaaggccaaagacaaagaatcgttcttatagcagaggaagaactaacgggattgagttaccaagggcaaaataccctcttcatttgaagagaagaatctagcttgcaaaaaggtttaaaataaagttggaaggtataattaaggtaatttaaaacaaatttatttccaaatgagaaaattatatttcagcagaattctgtcattaaattataagttaatgaggaactacctgtgcctcgttcactaatcagttttcaagtaatgcagttttaagattgtcgaactgctttcataataagcagataagcagcatgcttaatgcccaagaattgcgattgctcccctttttctgtttcacatacatcttactaaggaaattagcagtgcttttttcttttaaaatccttttttatgtgatctcttcaaatggaattatttttgtaatgaacaacgatatcaattataattacagaccccgcttacatttattgtctatggtacacagcaccgaggcagatacaaccaaagtaataattaacactgagactgctaggattcaaaggcataatagcaagtgttttcataagaatgacatgagactgttggaagaatcatttcaggaatgtgagggattgacatgaaatccacaaaaatgaaactttgggggttctgtatatgagcacacaattagcattttctcagttgtacaaatgaataatgactcaggaaactaggaggagggaagggaggaggtctccccagtggatgctaagaatacacctgagactcccagtgatacagctgcagtcgtctcattgtgaaaacttcaacagaaacaaacatctctccgttcttctactctgtgccatggacgttgctctttgggggagttttaatttttcccgtggaagaattttctttaagttcattttcatttcatttcaccacgttaaacttttcccatttggcagaggaatgtcaagaagactgggacatactagaactggcagcctgaactcttccttagagtatcaggataccatttagaagaatattgcttcacttacctgaaaaaaagatacttgaacaacagttcttcagaatacagcccaaaacatcaaccaaagcataataagtatgtctacatagccaacatagatgcccaaacccttacacaaaagcttctgtactttattaattggagagcttgctagtcccatgttatatccaggactcctaatgtttgtaaactattccagtatagttcacattacaacagaaatgcataaagccagtattacaagccctctagccaagaatggttattgaaacttataacaatagaggagatataaaaattaatttcaaaagacataaatcataaagcatggaagtcagtctctttcatttacacattcacttatgcagtcaactcagtgattatgaatctattacctattttataaaaaagaatgcgaggcagaactatgagatcccacataagttatgaaacaacacacaccctttccttccgtctgctttcccacaggactcctaggtaatgggcatatgccatgtttgctatactctcccctcttctggtcattgcttccttcccagatccaattacttggttgtcgtggacactgctaggttcttacctgattgattgttcaagaggtagaccaatcagacctttcccagcattcttgttactgaaaatggaggaattagccagaccttctctggtggtgaaagataccatatgtgacaactcttggtgaagttggtggccatggggaagaacccgtcagtaaggaaaagaaaaatgccctcaggaagagagcagagtaatagcaatcaagaaagcccttttgcattcagtctccaaattcctgatgatcatgtatttattataaatgcattttttggctgcagtttgtccagtttttccttcaattacaggaaacgacccattgcacttgatactttctcctatttcttaagttagtttgagttgtgcttttgtcagatgtagcttaaagacatttgaataacatgatctgaaaataattatgcatctttccttgatttgagtaatattattatgctagttgtcctaatcatgacaatattgagtcctaatatgtttcctagctttttgttagttgggtttttttgtaattatgtatgattggcaatcatttctcttttggtataagataaaaacgagagcactttgactatgatataagatccacagagaaactataccagaattttttccaaaattctagatgttcagtatagtatcaaaagtgcagtcagttatcagatagtcctttctgattttaacaaaaggctttccagctcctgtaccatctttcaccatgaaaagattcttcactgcgtcattaagacattaaatgctcagcaggatgaattctgatgcatgccagtagtgacagaaatgtgttcagccaggtgaggcaacactgactgaatcacacaatgttcctccttactcacatcacacactgccacccccttatgagtagaggtaatcagaatgacaccattatcaatgacagcaataggagtttgccaataaataaaaaacaaatataaaatattaaaaaataggacctttacatgtctcaccaatattaaaatatcttgtttaaaattattatatgtcccagtaacttttaaatattaattcaatagaggacgagataaatagtgaaacacagagaatttttagggcaatgaaactactctgtgtagttaaatctccccaactctttctaatgctgtacctttttctggcgtgaaactagcctctggtaaacatacaaaactgtatcttgccctcagttatagatacttttaccaatgcagaaagttggcatggagctagaaatgtctaaagcttggccatgagcctacaaaatattataccagaaacatatttttgaaaccagtggttattattcttagtttaaaattatctattttaaggaaaattgatttttaatttgttagatagttactgtgaaatgctcttctgtgtcggcataaagcttggtgagcaataattttgcttctctcttgcagctattctgtactgtctttttaagtcctcctccaacatatagagttcaaggtctcagtatttctcacctggactactggactattacagcttcctaactgagttacccttctttggattctcagcctcaaatccatccttgacctggctgccagataatctgtctgatatgcagcctagccctggcatcacattttttactaatttatctccagacacctaaatgctctttatcctctgaccacaactctagtttgttgtcgcaaccccctccctcttttctaattcctattagactactttttgtttgctctaactcctgccatgttagctcacctctagttcttttcccagttttctctgctcgggattccctcttttcttccccatcactctatgttccctgctcctccagttccatcttgaatgttactgtacacatgacagcgtattatcggtgccttaagtcaggaagcaaaaaaaagacaaatcaaacaaaagtagaaacaacaaaaaaacaggtggcaaagcaattaaactaaaagacattatttcactttgggaggctgaggcgggtggatcacgaggtcgggagatcgagaccatcctggctaacatggtgaaaccccgtctctactaaaaatacaaaaaatagccctctccctctccctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagtgaggagcccctctgcccggcagccaacctgtctgggaagtgaggagcgtctccgcccggcagccgccccgtccgggagggaggtgggggggtcagccccccgccctgccagccgccccgcccgggaggtgaggggcgcctctgcccggccgcccctactgggaagtgaggggcccctctgctcggccaccaccccgtctgggaggtgtacccaacagctcattgagaacgggccaggatgacaatggcggttttgtggaatagaaaggggggaaaggtggggaaaagattgagaaatcagatggttgccctgtctgtgtagaaagaggtagacatgggagacttttcattttgttctgtactaagaaaaattcttatcctgttgatctgtaaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacataaacactgcagggtcctctgcctaggaaaaccagagacctttgttcacttgtttatctgctgaccttccctccactattgtcctatgaccctgccaaatccccctctgtgagaaacacccaagaatgatcaataaaaaaaaataaaaaaaataaagacattatttcattgaagagggagccaagtcaactacaacaatatcagatgatgacctaggtcttgtgtcatcttctcttggagaattttgtaggggtttcagcccagaatgtgttgtgtgtttcaaataatcacgcagaatggaacttctatatttttttgtagacttgctcttttccattatcttggaagcctagtgagatcattgctttctggtatgaggtagggattatgattaggagattagtgagatattgacagtgttgggagaagggagaatattgcatattatgtggccttgtgactacatggtatggagaatttctagaactgtagttaacagttaaagataccagatatagctgctttggcatgagtagtagagcaggaagattatgtttgcatgttctgctggaaacatatttgatcatattttaaatttttaatgactctttatctgtttataattcaaggaaatagtaaaatgtgcttagttattgaagggaaacagagcaattttctatttatacaaattttaaaaagcagaaaaacctttatgtacaaagaacatctcctttggaaaagagtagtctctcagggacttgaatttacttatgtcatttttacccaaaaaagggataataatacaaaacaaaacaaaaaacctttggcatgcacattgaactaatgtgtcttcctggaagccaagctaaaagcatgtgtctaatgactgtgcagtatttaagctaatgcaagtgttatttacatttttcaggaatggacaaatgaggttttcagtttggcaacaaacctgctggcccaaaacatgtccagggatgcatttctggaaaaagcgtaagtcactctaattttattgctaagggcgttgcttcttctgagtcagtttcctttctcctttgtgagtcttccgtttatgccatactgacttctcacattgataaacacaaattttcctttgggatttattagagaactgatacctcccctgttcagaattggaagacttccaagaaagattgctctttcctccaagctgcacatctgtgttacacctgggctaagttcgcatgaatgtcagtgcttttgacacacaacaaagagacacttccaaatcctggcagctgtgctcagaactaaaaattattaatttcagataatcctctgcttctacatctgtgtgtgtcctctcaattattaatctgaggaacagcatatgttcctcatttctgtagagttatagatagatgctacaatacctttcctgactacttaaatcaataggctgacatcctgattccatcccatgtagatgatcccagcaagtattagtaagaaaagagaaaggatctaaaggaaagagaagaaggaaaataaggaaagaaaagcaaaacaaattgccagatcactctggaattgccacagcccttctaaaaattgtttgaccaaggaaaataatgacttaggcaagatgagcagcaaggaaagctggttgtgttcattttggaagctgtggttggtcaggaggttaggaagtctttaaatcaaaaccacaagtagaaacattaataggtggtcctctattttgtttaacagagttctgtcttccctcttcttatgtaagacatacccatcattccagacctaatacctcagccacattcctttattttactcttctatgaattccttttgcttttagtcaatacctcaggtcttcatttaagggcttttttatgggatcgcctcctctcctgagtttgttaacttaaggactcttccttcatgcctccacctcttcccttcctttcttcctctatgtttttaccttgtctttgattttatcatccttcttctagaatatgttttccagacaatgtttctagaacattcattcttccatgaaatgttagtgaaaggggacacagaggtaaataacatgttttatctgaaacatagcatgttattgctagttggctaatcaatctctactacaaatgtctattccagaaagatgtctccctatgaatagctactatggacatgtcttttagtgaacatattgttaatatttttgttgcacacatctagctttgggattgctgggccttagcgtgtgcagcttcctgaagtagaattcccaatgtatgcatccatcaacagtgacctagagttctcattctgagaatgaatatataagcaaacaataagcaaaatatggttagttctcagaaacatgctattgagtgaaagaagccaaacacaagagtatgattccttcatgtaaggtgcaaaaacaggcaaaagtaatctatgctatttgtagtcaggataacagttccctttggcagggcgtttgggaagggcttctggaatgctgctaaagtgacaatgttctatttcttaatctgggtgccaactgtggagacttgggcagtttgtggaaattcagcaaaatgtacaaaggcatgggcttttttgagtgtattttattgttcaagaaaaaaaagcttttttaaaaaaatcaaacccttgtttttctgcttctccaacagctatactaaacttaagctgcaagtcactccagaagggcgtattcctctcaaaaagtaagctttgtgagcatttctcattattcattttattttcctcaaagatctgaatccatgccatggctctgttttgtttctccagcagcctaagtgggagtgtggaaatgcgtggtagccctgtcctccctcacacatgtctcatgtcagtgcagctgctttcctcatagacgtctccccggggcttccctttcctctggcattattttcaagaaataccaaagcaggaagtgggtggaggaagtggagggacccttgctactaaggccgaaaggccatctgagattcagatctgttctaggagtggaaattggccgacctcagtgcctctttctaccaagatggctgtagccctcaagcagggtttgcaacctcagatgctaactggagccaggcagggaatgtaaatgatgaaacaggtcaggaggaggaggaaaaactaaagagcaaaccctgtctaaaggagacaacagctcatctccaccatatatcctgtgggactggtgagcacctgacactagattgtctaatgtctttatagaacccataaacctaaattagtatattaaattgtccagtacttaagttctatttttaaatcaaattagtaacgaaaaaaagtccatctctaggtcatatccagccaaaagtctttaacttttgacttacaagctactagaaagcttctgcgaatacacaaattaagccaagcacagtggctcatgcctgtaatcccagcactttgaaaggccaaggcagaaggattgcttaaggccaggattttgagagcagcctaggcaacatagtgagactctatctttgcaaaaatttttaaaaattagccaggtgtggtggcacatgcctgtagttctaactactagggaggctgaggtgggaggatcacttgagcatgggaagtggagactgcagtaagctgggatcatgccactgcactccagcctgggcaacaatgtgagaccctgtctctaaaaaaaaaaaaagaaagaaagaaagaaaagaaaagaaattaatttaaaagtaaacaaattaaaaattaaatttattaataatgcaatgtacaccttggggcaatgggtagtagcagcaaggggacagaattaataaggatgtttattttagtgcttaatattagagattatttaatgcaatattttttaattgggtcagcaccataatcctaaaatactgattttatactagacaccttaattttaaaagcacgcagttgatctttcagaagacagatgcaaatgcatggaggaatggttatcttttagttctttaaatatgaataataaatagatttgactgaatggaatattttgagttggcatcatctgttagtgctgtgatccatgtgccatttaaacctctctcctttgttgtgttcacttcacagcatatatcgcttgttttcagcagatcggaagcgagttgaaactgctttagaggcttgtagtcttccatcttcaagggtgagcatgtgtgttatgctatagtttgaatgttcagcccctccaaaactcatgttgaaacttaatccccaatatgacagttttgagaggtagggcctttaagaggaaattaagagcttccatgattaatgggttaatgaattaatggattatcatcggagaggaactggtggctttataagaagagaaaaacagacctgagctagcatgttcttccccctcaccatctgattccctgtgccacctctgccaaagtggagagtccccactagcaagaagacttttgccagatgtgccctctccaccttggacttcccagcctttgtaactgtaggaaatacattttgattcctatatattatacagtttcaagtattctgctatatgcatcagaaaacagagtaagactgaaaattggtaccaagaggtggggtttttgctgataacaaatatctgaaaatgtagaagcagctttggaactgggtaatgaacagaggctgaaaaaagtttatagagctagctagaaacagccaagacttggtgaggcctcttttcactcctataaccccagtatttcaatctagaatgacccttgctttttgtagataaaaaagtcacctaatcaggtaatatttttaaaatagtcaaaaaaggctaacattatcaagatgacaatttgaaatgtggtttcaaacttattaacaataaacccttcttgatgttttttttaagatattagctaatgatagtgttgagttaggaggcgagactcaactctggtggtggggtatgaacaccggaccaaattaaggaccagctaaaacagggggagcggaagcagctttccataagatatgtccatgtcagtttaccattgccagggcaacaccgaggaattaccaccgctttccacggtaatgatccaatgacccaaaaattgccactcctatcatagaaatttctgtattaaccaccccttaatctacatgtgattaaaagtaagtataaatacaacctcaaaactgcctgagctgctactctgagcacactgcctatggagtagccctgctctgcgggaacaggcatggagctgtaacactgctgcctcagtaaagttattttcttctaccctaccactggctcgtccttgaattctttcctgagtgaagccaagaaccctcgcaggctaagccctactttggggctttccagccctggatcagtgtgaagccgttatgtttaggaagatatttgaaatattaatttcatctcaccttagcattttaaaatgtttagttttaagatgtataagctatgtaagcaattagtatgctgctatgtgcttataaataaatatatttacatactttacagagctgtgctcagaaagtttttactgagggggtgcaggatctaaacagtttggatctaaacacctactttgctcatacggtggtaaagtaggtgagaggacaagcatgtaacatgctttcatttttatgcctgacacacacaaggtacatcatatacattaaccacctcaaataaaataatttgctttcattttgattcatttctacatgactggctctaaaatgatttgttactattgtttctggaagtccattgcataaaatttttttctcgtgcagagctctcctttcattatttttatctgagtatctaagcaacaaggaagcctttacctaagggtaacatgactttataggaagaacctttgagcccctcaaaatgtgccagcaatgttcaagttgcactgaataagtttgcaaagccattcttagacttatgattgaattataaaagtattgagtgctatggttaaatttatcagccaattattgttgtgaagacttttcaaaacagcaaagttcattaacaactttggtgggtcacaagaaagaaataagagcacctcttcactatcacctttcttctataggtggaaaaagctaatgaggctgcgaaaagtgagcagagctgtggaaaggctcccccaaaacattttcaccttcattttataaagcaaaataaaatgcttgaacctgcttgctattgcttttttgttagatgctttggaataggaaaaatataacaattaaggtcctgtccccgacttcaacaaatatttcttgagctcttactatgtgcccataggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatttaacttatgaatctagctaagggaaagaaggaatagaaaattaaatgtatgaaccaattccccgtaaattgtaattttctaaacaactggattctgagcagtcaataaatacacattgagtaatctactatgtttattatatgttcaaactttcagaccaatgtcaattgcaggcaaatttaaaaggaaaatgagattcaaataacatgagttatgtttaaattagaaaaaattatctctaacaaattaaatgtaatgataattatctgaagttggagaaaactttaaaaaacctctatgctaaaactttgaaaaattattattcatagtaaagtataatttacttggatgacttatagaattagaatgctttttaaaaatctaaaaaccaaagactgtttcagagctaggaaataaatgtttctgtgaactgactatgatgtatcaaaactctgttttaaatctctgtgataatttcattcctacataacaatgactctagaaaatatccactaattagcaaaaaattttggccatattcacaagaggtattttaaacaagccacggaagaaaagggttatataaatcatagttggttctgcgtaaatgggagcatattttgtagccaagtcatttaagctagatttaattgtgctctgtaaatagatatattaccagaaacacagtggatgtcctgttgagatttctttttaaaacatgatattactgcacattgttggggataaataaggcacttgaacttgtatcctggctgacgtgatccactagaataacatattcctttagaagatgctactctttagaaatcacagttgctagcctgaagttaccctaattgttaaaaggtagtactgtatccaaagagagagacaaagcaattactgtccttctgttaacaacccaagcatattttccagtgagacccttgaaaactgttccgtgttcaaaaaattaccactttacccacaaactttctgagaactgaaaatagtttatttgcaccaaattcccttgatttaaggcttattaacttgaaaagagctcagtgacatctggaattgtataatagtcttgccacagcactggcatacggagttgcattttaacgaagaagatcaggaataaacccatgtatttgtttcaaataataaagtttactgtagttggtgggcacacatgtaatacaaagagaaattaattattttaaatttgaagaattgtataaattttactaaatactatgaataaaatgtataaaataacttctgtgtgtaacttattagtatgttgcctttcttctgtgccttacatcctgaatataaatcagaagcaatcacttttgtagttgtgattcttaatatgactaatatcaaaattctactttaaaaccaaattaagtattccgttcattatgagtgatttacttgtagttatttcatgtattccatggctaattcaatgttttatttatagtttcagaataaaaatattgacagtatattgaatttctgaatttactgggaaattgtccatcaacttgtcaagaaaaacaagtctatatgtggactttattcattagagtctgcttcagtgaattaatatattttaaaataacattttttctgatttttttccgaaatttaagtacccatttctcatataattattttttaaatcaagaaatatataacgaagaaaatgcagaccaccgtcccaaaactaataggaatatttagtgtactggtttacagtataaggtatagaattaagcaactcagattcaaaatatagtcattgtgacctcatcacacccatttgctcaacccaggaccttagacaagttttgtaacctcctagcacttgtgtgttcctatctataaaagtagtacagtaataatgccaactgcatagagttgatgggattacatgaaaatattcaagtaaagctcatagaactatgtttgatatactgtaaatgctaattattattctcattttgagtatttttcatatgcatatattggggggatcttgtttttatttttaatttggcatttggatatgacattaccaggtctatggaatctagaaatgcaaatgccaccagtactaccaccaagattgttaaaatcttttcccttttgagattccttgtatataagcatggtattgaaacacttccattttttcaagtttgccagtactttgcagtttctaaaataaatgggcctcattcagattactaatttagattatactagccttcttaagtcatccttcaaaaaggccaaacaacaacaagtcatcactgacagtgcgttttgtattgggtgcctgatgtgatggaccacgtcctggattaaaacagaagacccaaggtctggtatcatctcctgggttcatccagcaaacactgattaggtatctattatataccaggcaccatgctgggaacacaaaggaattaaataagagattgtcatgtcactcaaaagctcatagttcagtagaaaataagaaatataaaaaataaaggaaaagctgtgaaatggatgcaatgatgaagatagataaagggagactgtgaacacaaagaaaaagtagtgtcatgtctagctgatgtggtcaggaagggttcacggaggaatatttgaacattgggcaggatctttagagtattagaccttggatttcctcctagacaaacaggaaaaatgaatccgtgccattcacttcaccaagctgtgagattgagaaagagaaagtctgtgaattagctttgtgaatttcagtcttgtttaagatgcaaggaattagggattatccatagcttttacctaaacatctcccctatagcctttcatctcagcatttaatgatgcttacttattttaactcctctttatggaacattttttcttccattttcacctactaaccccaaagactttggggtatcctcatcagtcaagttgggcaagagaaaaatgagacaaagaaaatcagctgtattgaaatattttctttcttcaatatgctatcatccaactcgcaatgaaaataatgttgtgtttattcagattatctctttaatttgactcctcctaattcatagctggtacataaacaatgctaagattttagtaaagcatattgttctatcaaattatgtgtcaggactcttacgtaaatgatgttagttaaatttgatatttcaaaggaaataacagcacatgcgtgctcgctatccatttctccacacttctcaataaattacatccattcatttagtaaatatttatttatacctactgtatgtggcacactggaaatagagccattaacagacaagacacatatcctagctcgtgtacatctgcagattagcaaagactagacagaattgtatagctgggagcacaatacattgagtgttgaaatgtgagacatgcaaggtgtgatgtgtgcacaactggaagacaaaatccagttcaaggggaaggcaaggctttccagaaaaagaagttataaatagacgggaaggaaaagagaggtcagtaagtgaaggatgacaattattgctatccttagatcaaattaatttatgtgtacgttgagtgaagttggtgaaagggggaatgaggtgaactctttttagtagggaaaataggagaacacccttggggttcataaaatccagtaaagctggaggcacttgagttggccagcagtgccattgagcatgttcttgcaattgattttaaatatttctcttccttgtgtctaacagccaatgagtatggtagatagggtcattttcatctattaaaaccatttacagagctcctggtgtccacttagagagagggtggtactgaaaagtgagcactctccggctaaagagatttctctctttctataaatcaagaggacttttggaaacctgcttgcaggttatacttgttccctttttatgaatggcaaaatactaataaaacaattcacaagaagtccccactgctcttggatttgaccgcttgtgcttatttcaaagtttgtgcccaagtagcccaagttataatgatacaacacatctatgtataatgattcatgtattgttcggttgtctcaaaattctgttttgcaaaatagattttttctatctctgtaaatggatttagcaaaggaaatattacttcattcattcaatccacaaatacgggtcttctgctgtctgccaagtggtgagctaagttctcctatctgtttgcaagtggtgaacaacttcagacaataatttttagacatttgtataactgtacatttcaaaacctatgaaaatagtcaaaggaagggtgtgttcttttgtttaagggcttgaaaaataaaaataatcacattaacacatacctgaaataggaagactgcatgaaaaatgtctttcctgttaacaaaggcttgaatacatgcttccggtttccatggcagcccaaccaaacagaaaaataagtcatagaagtggccttttatatcaatgacttgcttcctaaacaataggaccaggagcagtcagtgaaaaaataatgactggtgctgtcctacttatgaaaactgttttacaacttatcagattatttaaaccagagggaacatagtttgaaaataattgacacaaaattggaatttatgttttcattttgactatgtctgtctctagggtcattacttaaaaaaagaaaaaaaaagattcaagtaggaaaaaaaaaaaaacctaaaaataattctgtcaaacagactatctttcctagatctaacttgctttagaaaatgtatataggaaattgcattaacatccctttagcaggagacaattcttaaacttaaattaaactgaaaaagccacagaaaaaagggtttgacaccctaaagccagtgtccaaatgaacgctacggttgacctcataggtgtgttatgaatgtttaccctgacctcctagaagaaaaggaaaaagaaaggaaagagagagggagaaggtgagggaaggggggaagaaaagaaaggagagaaaagaagacagagaaaaaacagggagggaggaagctggggaaggaaaaagaccatttgctgactccgttgttttatttcccagaatgattcaatacctcaagaagatttcactccagaagtgtacagagttttcctcaacaacctttgccctcgacctgaaattgataacatcttttcagaattgtaagagtacacattttaagccatatctttttcagcttgcattgattctcaggtggctagagcaggacttggagtggtaattggagatggaagaacatcatacactgtgtctaaaagcaatattcctgtgtgatgttttggataggatcacacaatcttgcccctgaggtgcaaccactgcttttaatgagtacaagtttgctgtgatatattgctggaggtagttgtttttgtatgctcagataactttgtatggttgaaggattatgggtagaacagggagtcatcttggcttagcagaaatagactcatgtcgcaggaagaactctggattgggaaccagttattttatctctctgagccacattagcgacatgagaagtttggattactaagaaccctctcagctgaagaattatttgcttttctgttagaaattataaacttatatcaaggcattacctttttttgaaagattagaagaaaaaaggaaaaaaaagaaagaaaccaaagcactaaggcaaatgtggggaaagtagcagtttacctttcttaaaatactgaaatccacatgacagaaaatcaatacaaaatgtggtaaacaaaataaggatttcttcaaatggaagacaggtaaacagtactgctgaaaatgacattgcatattcttgctttgtgctgttcattgccatcatatatttactgaacatctgcaacatttgtaccactgaatttgtctttagatggtcaatacaattgaaatgggaagtttgaacaatatgttgaggaattatactctcttgttgaagcctaactgtaacttttaaaaacactcaaacgggttgtttactttaagtaatgacaataaatacatctttaaatgattacagatatatggagttggatgattaaatcaaaaatttactgtcataataaaaaaacctctgtgttcggtttagagtggtgcacccttatgcacatgatgcagtgttttcccactgtgggttttcttacccatttggtattttgcaagagcattgggttttagcggtagcaattgcacaagatatttgtagcccatagaggtatagaaattatggtggagaagcacagtgttttcagggcaagataggagtttcaatatagcattttcttatcaagtataagattttatttccctagagttaaatgcaaatattagaatgaaacttagtttaaaaaattcttattgcttggtttttcattgtttttagtggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggtcagtactttctttcacaccaaagggaagctcttgtttctgattgggggtagtcacacgctgggagttaggaacaccagtgatcgttaggttagtttcctctgtttacaaggcattcctttcggtctgaaatcacttggtggttcagtgcactaggtttttctttaaactttggtgtgtgatttttttgtcattgttgttatatgtatagatgcatgtaacatatttttaaaatgtctaatcctttattttgtttcaaattcacgcagtgactgaatgcatatttcatacaggaaatcactatctttaggttacccttttgtctttttctagtaagttctgtgaagtggcccacaagtttttctaacgttctaaaactgaagggaatatttagtctgtgagacccttatctttttccagtatatactatctgataaatactatctgataaatttttctacttggggaaatagtctaaaatttggctgtctgtgtaaaaaagcctagtgttgtaaatacaaaacaatccaaaaattgatagcccaaagacagctctaagttacctggaagtttttaagaaatttatatttttgattctgggaaaatgaattgccaaaataagatcatgaagatgtaattactgcaaattttcaactatatgtggcagcactgtccctgaacaagatcttccactgagaagactaactctcatctggattgaaatatcttcaccaagaaaattagtgtgttatcactgatgttattgcagattgcctagatattccatagggaggaaaataaagtacaattaaccaattattgaaaagaaatcaattatatattaatatgcaggcattttctaaagtaacagaaatagctctagcaagcttatggtcatcaataagaatgattatcataaaagtaaatttaaaagtcttttaatccattgtgtttaatctggaactggtcctctaaattgaaaatgaaatcatgaagtataaatgggcccaggcactgtggctcacgtctgtaatcccaacactttgggaggccaaggcgggtggatcactttaggtcaggagttcaagatcagcctggccaacatggcgaaatcctgtctctattaaaaatacaaaaattagtctggcatgatggcgcatgcctgtagtcccggctactcaaaagactgaggtaggagaattgctttaacccaggaggcagaggttgcagtgagccgagattacaccactgccctccagcctgggtgacagaggaagactctgtctcaaaaaaaaaaaaaaaaagaagaagaagaagtataaatgtaaaatctaaaaatctattaatcatattctacatgctactagttgggaatttttagatgcaattttttagttttcatttgttttcttggtgaagaactttgcctttgttgttgttatcattttcactgatgctgtgaaggtgagattagttaaaggaaacaactagcccaacagtatgtcttggcatggccaggcctgcccctccaaacctacttaaataggttgcccttccttccctagtacacaagagatgagatttccccttatcatgaagcagggaacatcttggaggttttgcccatgtagcttaggagttctcttctaaaatccaaacttctccaaaaataacgaacacattgttataacaaatccaacaacacttctaaaaatcagttagcccacgacactaggaaaacaaaaagcttttctgaaaccagtgaagcactccaaagtgtaagccttttccttttctccttccttcacaccacactgctgatggcacaggcttcagctggtatccaatgcctccatacatcatcctctgatgacttgcacgatgtagagggtacaaagagaaaaaattgtgatagattactgtaaaaccccataatcctagaaaaactgattttgattctaatggaaattaagatgatgtctcctagcatttgcaaaattatttagtgccattttatgaatttcaaatcgaaagaggcacacaaaatatttaaaaatttaaatatttttaaaggcaactttatctgtttttctataccttaatatgacattgatcacaaaacctctgtgtcaaccttaatagcagtataaagaagcaacatagaataatggttccacttttgagtttcaaagctgagatccacctcactagtttcatagccttatgcttaacttctctatgccttaattatttcatcttcaaaattaaggacagaagaattcttgatacgcttttcatagatttgaattaaataatacctgcaaagcatttggaaagaagaatctgggcctgtgtaatgtgataaataagtgttaactcttctcaatgttttgaagtgtagtatgttggttttcattcctcaggtgtcgttgtccattttttctaggagatcccatgatttctgggccttaaactttcttctgttttccccagcacctagaagatgcacctgctcatgatgaaatccttaatgtagacttgtagttgtgatctaatcagtgacccaaagcatttgtgccccaacttatcacttaagaatattgcctagtggtctctgtacagaaaaattttggctaatgctgtctctacctaaagccttatctagcacgtgggaaggacagaggctttggagtccaacggctagaatatggctaaagggccagccacctgctaccgtataacgtgcatcctcagtcaccccaggggactccagcacccgttcagaagttctggctggctgtatttgtagctccttcttctctagaatccatatgaaagaaattcaactcttgaggagttaaaagtcaaattacaaagaccttagtagggtcacttcagctttaaggcatgtacacaaaaacggactcatgatagctgccttgttttaggataaagggagattgtgcctgtttatgtttagttcagcgcacactagtcattcagtaaatggcctaaattgttattaacactgtttaaagcaggccaaatagtactagaggaagcacacagtctctggtgttctagtcttacaaactcaaacttacaagccaacctacgttaagtaattcataacttcagtatttaataaatcttcagtgaaaggcaagaggctacacacagtgacagacccagagataaaccctgtgcccctagagatttgcactcctcttaaaagtgtatatatatataattatataattatttattatataattatatataattatataattatttattatataattatatataatatacaattatttattatataattatatataattatatatttattatatttattatacagttatataataaataattatataattatatataattatatattatttattatctaattctatattaaatataattatttattatctaattctatattatatataattatttattatataattctatattatatataattattatataattctatatataattatttattatataattctatacataagtatttattatataattatgtatataattatttattatataattatgtataatatgtaattatttattatataattatgtataatatgtaattatttattatataattatgtataatatataattatttattatataattatgtataatatataattatttattatataattatgtgttatgtataattattatataattatgtataatatatatataattttttattatataattatgtataatatataattttttataattatgtgtaatatataattatttatcatataattacaatatatattattaacataatatctaaatatattaataatctaatatctataattaatataatatataaatattacttcttgaaatccaacgtgcacctgaatcacctgagccgttgttaaaatgcagattcgagatcctgcatttctaacaagttactgggtgaggcagaagatgcttagcaaaggcccacaccgagtagcaaagctctaagaagtaaagagaaggcgcattaagcatgaagataatgagatttcttcctgtaggggacagttcatggaagagataacatttgggctgaattgattttaacacagatgagctacagactttaaaactttaaacttttagtcaagtagttaatacatttggatcaataaacacataagaaaataagtagggaagtttagtattacattataatttattcttctgctgctttcattttaactgttttcagatgtgcccaggtgttagttaaattggtgttgatctcagtgctgatgtggaaattgagtcttatttacctgagaaaggcacttccatatagcctatacttgttataaaatgctaagcataagatacacacataatatacataatagaatataaacatatatataacatatatatacacacaacatagatatacacacaacatatagttgtgtgtgtatacacatacacagagacacacacacagtctctgatatcaataaacatatcttaaagtaggtgttaagcaaataaataatatacaaacctgacatatgctgtttagcttttatgtacattttacataatttttacataaaagatagacttgaaattaaatgaaaaatttttagtgtcaccaaaagcccaaatgccaaagccgaccatagtttagctgactaaaagtgtgacacatggaagtatgaaatgaaactccagaagagacaatagactttgatcttctgaggacctgctgtaattagcatgtcagccacatctccatgctggaatttctgttttgggagatgtgtatattggttataaataatcagaggatttctgtgcagtctaaggccaaatgggtcatgtatgtgggttccagaaagagagaatttgaagcttgtcacagaggatactattctcctgggagtgtggtttatttttactatttaaaaattacacattgaaaaatgccatggcctctggtcagcaaaagttttttcctttccatcttgtttgcactgtagacttaaatattcctggcacaggaatatgcaatgacccctgcctcttccaaacaaaatgttcatgaatatcgtactttcaagatcagtgtctccaaaacagttattttttatcacttaaactcttcagatgaaagacagtgagtaaaattagcatgaaaaatagaatagctctataggtacctttggtaacagaatgcagacttcaactgatatatctataaatgaagtccaaattttacttaaataaactgccaaaccaaaagaaagcagtaatttttttcatgcttttattctgtggagatcaggtgttcatgagtgtttgttaaataattgaattaatgtagcagattataatagcagatgtttcaaactacattccttttatcatcagttcttcctcctaaatttttataaggtatactatacaaaagcgtccccactttgttgtaattaagtcataaaaatgaagctctataatcccttttagtgatcactactcgctgagttaatagtttaatagttgaaatgaactcaagattataatggcgaagcaatttggttttaggcaaagttcagatacagcaagtgctttagctttttttcctttaaatagacctaagccaataatgattgtatcagtaggaaaaaaaaaccctattgcattttcaatatagttttatttaaagtattatacaattaagctatattctctcactgtcaacaccaagaaataggctgagagtgatagaaagagactggacttgggaaacttgaaaactgtagttttagttgagactccttcagttgaaaaacggcagaaacttaactcaaactaaagcactgaataaatttgcttgtgcatataagcaaaaagtcaaggtgttaatggtttcaggcatgactatatccaggagctcaagtcatgttatcgataattgtcttttttcatctctcatcattttctcatactggctctagttcttgggcagattttcctgaatgataagacagccaccagcagcgccaagcctatagctcaccagtcctagtatacagaaatcctttttactcatggttcctgtgaaagtcccagaatccagggcatggcttcggtcactcaaggccacttctaaattagaatcacagtgtcctgaaggatgggataaaaataaatggacaggcttaagtcatatgactccccctagagcccataaggggtcaactacctaaagcacaaaccacacggaccgacaattggagagagatggttccctaaaattcaaccaggatgtgcttcctaaaggaaggaatagtggtctcttggcaaatgaaaagagtagatcacactaaaactagttcagaaatcattcattcattatgactttttatttggccttataaagccatttaacttctttgactagccctgctccctagttttctcaactttgaaattatttcctgacagaattactggaagaattaaataagatgcttttgttaaagaggttacatatatttattgttgttggctaaattgtcatttacctgaactaatgaaaagtgatcattggcatttatgccaaattattttaaaacatttatgagtctagaagtgagactcagagccttgggctgaggcattcctgaacattgctgtttctcatctaacagccttatttaatgtactgcaattaaggataagtataataatttattaatgaaacttgaaaaaaatatggcatgtcacatctgtgcacaaatggtcctttctgactcaatcattcttttctatacctttttattaaaatggaattataattatagtcataagtgtaaggatgtacacttgactcttactatttacttcattatcacttcaatttcctagtaaattttttgaatcatatttttccagcaccatttcgctttactaggtagaagttataaaaactaatgatggtgatgattataatctctattctccatccttgaaagatcaaacatgccctaattaaagaaataggctggcatagtgtcatgatgaagccagtaaacctcaggcaagagacttgacttgtgtgagcttcaggttcttcatctgtaaaatgggatgagaccagcaatgtagcagacacctgtgctattcccatgtcccttggcaatcatggttccaacccagccacctacacacttggcaactcttcagggccttctatcagtccatccacagccaggctacaattcccagggactgcatgcctcaggagtagttgaagaataaataccttatcttccatgccccttgggttgcaaagttctgatgtgtgttctctgctttctcccagagttcctcggtgagactgagccctaactgcccacagctgtaacctgcctgatacccttctccttcttagctgcctttccttcttgtctcacttctcttctctactgttgtttcatagggtcaactcccaaaaaaggtgcttgcactcaaatccttgtctcagatcctgtttttggaagaacccaaactaagacaagcacttttctataaatggccttaagggaatcaaaagtgaaagatgggtaaggtcagagttgctgagcattgagagaaaaaaaaatggaaagaggctgtgcctcatcattcctgccaacctatcacgttattgtcttcgttgtttccaatcacgaagccctggccagtggcctccaatcatagatttccagtctacaaaggacttagccatttagcttagtcaaactgtcagtttattagaagaggcagtttgcagaaatggcaatgttgggaccaagaccatgttttctttgtcccgctactccagacatccacctaggcactccaacaggacttgcttagaaaaaagttgcaacacagaccatttagaagttagtgatcgatgtctatagcagtggtttccaagctggtcctagacatagcaccctttgtttgtttcttctaacaaagtctcgtgagaaaggccaatgtgtagggaaaagctttaaaggtgctgtcttggtggaatagaggggagcctggagtacaggtgatggtggctgttgccctatcactctttctcctcctgacctaccccattctctgcagggatgtctgcccaaacccagggatattcaggatactcagtttaaaaaccactcctctgaaggaaatactgactagtttaaagatctgcctcacaattaaggtggcatccatttaagtcattttatatagattacctacaaagtagttgaggaaacagaaccgacgtgaatcaacaaagtcaacacaaataagatcaattttctcccaaaagacaaaaacagaggaaaactatatgatgtagccaatgctttcatgccttaattaagttactacactgaaaaagctgctgaaaagctactctaggattttattgatcgaaatctcatttaaattcctcctattgactctctaacctctgcggaaggttacagaaaaatggcattgtcgtccctgagtgcattccaagttcttcttaacttcatgtttggtatgttcatagacttctctgaaatatttcagattgcctaagaatgaaaaaaaaatttttcaagatcgtcattgtggatctattgttcattggttgacttggcaactccctttgctttcctttccgttattacatttcctttattcccagaaggcagggcctgggcctgaggaaaggcaaaggcctggcctaggaattctgtttcttttctcctttatttcagtgacctcagtgtctgctcaggcccacagctctggccagaaagtcacagccctgtctactcacagctgaaatgtcctttgttcagaaaataaccagacaggaaaaatataaacagtaaaaggcaaaatcaaatgccagtccacaggatagataagtgagcttggtagcctcatcaaccccatagtctgctgagtcttgttaaaacttctttccttcatcacacctttcagaggtgccttgccatttcatgggagagctattgggacagagcagagaatggcttctttccccctagatgtgacctcccagcagaacacagcattgacaattgttggctagtatagctttccccttgtcagcagggtctaggagcaggttgcagtgcgtgtggggtggggtggaggggactctggctcagtcaaaactgcctggcaggttgtactgtgttgggagggagagaggccacaggcgtttggctcctaacttcggcattatccagggtcttgtcaatagtcaatgtgatacaacagataagtgggagggaaataggtcgaatgcagaaaaaaaaaaagcaaaccacagggaaaccagattaagtgagggatggaccttccaccctaacccttaatagaaaagctgaaaaatgtaccatagtagggaatcctgccaggaagtggacagtgaccaaggatttcaaaaatctcttatggagattctggaaggtctgtcttaactctgaatcactacagtctctaggatgccagctgtgacagcaaagattatctccaagctagggatagcattattttaacaggagagttaattgagaatgatggacaaaatcaagcttcttacctaagcattctaccttatatgtagaaaatgagcccaaaaaatgcttctgaacaatgtggctatatgtctttgttgagggttttcccagaagccaactttgaaagaagattcaagtccatagagtttggaaggtgattccaggaagtactagtagggcagtagggagtgtgaacgaggaagagaaagcagcttacaaaaaaatgtgttgtcaaggcagtcattcccaaccacagccattgttggaggatgctcttagaaagtgttaattcttaggcctttccagcctgcaccacataaagtcagccatcaggcagagatgcagatacaagtccagcccagctgtatctcctggagcaccagtacagtctgctatgatattattaccagcaaaacactattcacgatactataaaaaggatattcccacctcactttgcagctttaacaagaatctccagcatatcaaaaaagagatccttcaaagtacctgatgcttattgaacgcatttctttattctaacatatacctaatgcagttgcgtggacactttaacaatcatgtattacccatctaacttatgaactgctagaaaggggaacaaaatccagataagatatttgctctcaaggagcctataattacaaggagaaaattctaatatcacaaataattataaaacaagttataatgtgattcacttccatttcttcatctagctaatattcattcattcgtaaatatacttccattcattcatctagcaaatatctattgaataactatgtgcgagggaagcttgaaggaaaaggaaagttttgtttattgacattgtggggagtttccggaattgctctaagctctttacctgcaaattgccatggtacatttttcagcttttctatttcttgtacaaaacctcagacaagtcttcaagtgcatattattattcccattttacaatgaggaaagcgagtctttggatggtccagacatttgacttgttatactgtttgggaatgagttgagaggtaagtctaaaaatgtaacatttgtgacctgaatggaagccttcatgctattcttgacttactcgttggtttatttactcagcacacagttttttgagtcttgctacctgtgtcaacccttgagtaagacaatgaaaaggcaccattcttcacctatctgggctctcaatgtagtagaacctcctctgtagtcagtacagtggggaaggatgtgctgaaggcatctgaagaggaaactggcattccatgctgtgctttatgctgcagagcagagggccaaatgagagacaagaggcacttagggcactaaaagataacatgttttaagtagctcatcagaaagcattaatgagaacataattatgttctgggtctgcatttatgctagactatggaagagatgtaaataaagtgaaggccatggtccttgctcatacaacgccaatgtccaatttgatcaaggaacataacattctggtgaaggagctagaacatttttcctcccttgcattacggtcaggaaccactgtggagggtctcctctcataaagcactgtgacagtgtactcataaaaggcaatggaattggtttcctaccctctgagaacctctaattttaaatgataaatcagtacttatacaaatccatgttccaaacacagctctaaagctgtacttaagagagacaggttctaatctggattctgttcttatctttctatgtcattttaaaggggctatttaatctctcttgggacaactttgcttatctgtcatgttaaataataaaactgtcttctgcctaccaaatagaatgatgaggagtaaataaactcacagatgtgagaatactttgaaaaacggaaagtgctaaatcaaagtaaggtgttattattgagaattttcacacaaaaccacatcaaatagtacaacttaatacagggaaactgcaagcacacagaaagctgtgagcactgcgtgaagagctaatctgcaggagcttttgagaagagtacatagccatttaggggccattatcacaccatatcttggagctgtatttgcacatagttatggtaatagcacagtttttgcaatcaagatggaataacaatatatgacacttttcaacttaagataaaataataacacatgaaaacaggtgcagaacatactgactccagatttaggggaaaaatggtaaaataatgaaagaagccagtgaagttcatgtaatgtacaaaagcacagttagctggccagtgtgataggaaagtttgtgcccgggcaaagataactgagaagggaacatttagattatttcttaaaataggcaaatagactttggtgagccatgggatattaatgccatctgcacttactttctctgagctgatctagcagaattcgcaagggccaaagcaccaggaaaaaacgtgagccgagaaattgcttttcagtgctgtgcttagaagtgatttaaggaggtgctaaaccactgggctggtagctttccagtatgctctggtattattgcattaagagtgaagattgagcaatgatgaatggattctcaaccacctaatcccagtgacatccaaacatctgagtgccagatcctgcctaattggcatttggcacagtagaaggaggctggtgtccatgcaagctggcagacacattgtccagttttcccatcttgactgtgattattctacgtggatttatgggccatctgtcttccaaggcaaaatttgtagatttttctgtgctgcagagctctgaagatgttatttgcatgtgtttagctgtttttattttttaaagctaacctgcatattttttgcaaagcccacaaaacaatgtcacttcttgtgttcagcatttctcttgtcctcatgttggcatgacaagttttctgttatatttcatttttcttcctaaaaatcagattcatgggttgagggataaaaatgctagaggacatctttaaattacttgcagagattagaatgtaaattaagtcgggaaaagaatttggaccttgatagacaaattcaaatcaaagagctaatcctcacgcctctgccagatgggtcatttgtccaccggagctcagcttctttacacagaaagattaaagtaacacgttttagagagataagtaaatcatgggaaaactctgccttggtcacatttaggattatttttaggaccaatgcagagtgcccagattgaagccaactgccaagaaggcaggatacctttccttcccatcatccatgccccctatccaggccagtgttaggaaagttatgtggataagcaccatcaaccacacccaccactatctgtctttccattgcccaggcatgatatccagatccatttcacaccaaataaccccgtgccctcagacaagttgctaacatctctaagcctccgtgtactcaactgaaaatggtaatttaaaagtacgtctctcataggatttctatgcctggcatgtggtcaatgctcagtaatagtagctcccattattatgataattattgttatttaccttcttctatcactagatgatgtgtgatgtctacagcaagcagcatagcatcatgtttaatggcatgaaacacaaagactgactgcctgggctcaaatcccaacttactcacttatgaattgtataaccttgagcaaccttatctttgcttgggcacaaaccttgagcaagctacttgcctcaggtttcccatctataaaatagtcataaaagtacccacttacagagttactgtgaggataaaatgagttaatacttgcatatagcaagtagcatatcataaaagattgttaaacaatatgctggaaatattttaaatcatgaaactcttctaaggctctcttcttccttgcactttcctgttatactctttttttttttttttttagtactgcatgtgtaagcatggcctgccacatgttctttccttgatcctttttcctttagcacttggctactgctgccttaaactgcttttgggactagctcaggagcagttccatgctagttctttgatgccatgatgtgggcatttcctagctaaccatccagatatgcataccgagcagggaagagcctcagtgggggcccttccagagaccttagcaatgtgccatgagttgtatttagggattagtttttgactatgccctatgtacttttttcttgccctgattcacagagctcatgcaaagtgtaatgagagaattacgtgctgaggacttgctactgagctcagaaatttcagttaaatgaggggcatcagcttgtgttaccagaccttatttaaagttacattcagctgggcacggtggctcacatctgtaatcccagcactttgggaggttgaggtgggtggataacttgagatcaggagttcaagatcagcctggccaacatggtgaagccctatctctactaaaaatataaaaattagcctagcatggtgatgcgcgcctgtaatcccagctactcaggaggctgaggcaggagaatcgcttgaacctgggaggcagaggttgcagtgagccgagatcgtgccactgcactccagcctgggcgacagagccagagtccatcccaaaaataaataaataaataaataaataaataaataaataaataaagtcacattcatgaactcagtggaaagtgagagcctattaaattatttcagatactttacttgtgaacctaataggaaattctaccagggctgagcaaattcggaagctaagaagagatggcactgatggagcaggtggctcgcaatgtgcaataccttgaagtacagccaactctgctgtcacttaaggattgatttggcttattctgaattattctagtccccttttccagtctattttgatagctttgagcatttaatgctgtctggttagcacttcttctaggcagaggtagggtgtaaggataaaactttcaatctctctaagactttgttaggactcagccccccaaatccctgtctttcttccgcatatttgttggacttcagggtaccgttagtcagtgccagcgaggcctcttggttctgttctgtgagctgttcattgcatttcttcgatgttttcttcttagtccttcctttgtagtgtcatttacggctgaatttggaattgccgtttttagttgtctatgatacaatatcgtttgagatatctggttgccaagatgaagcacaaaaccactcacaatataaattaatacataaatgttaatatttggggacaaaataatcattttttcaattaatatttgttgagcatttacaagccaggcactgttgtgagttctaaagatcagcagtgaactagagaaacactgcctgtctgctggacttcccactgagtgcctgcatctctttgctgacagctctctttagctgccagagccccctcttcccaagggcgcagttggccaaagagtattggggaattatcccccggaagcagtcctcaaacagtgactgatgggacttggtataaatactccagctccctccccccttaaatgggatcaccttcaagtacatgttttgtctcatttccttcaagggaaacacaaactaagacactccatcctcatgaaactcacaatccctggatgaagagaccaaaactagcataccagcaaatatatctattagtacaatgacagatggtgataaatgctatggagaaatataaacagcatatgagacaggagtgccagcaggagagattgctatttgtatgggctactcaagaaagacttcatgttgtggtaatatttgaggagactctcagtgcactcaaaacaagtctctctctctcactctcaatttctattttgaaataacctagagtggtggctaagcactaagagccttccctagtgcctgggcatcagagagggaatctggtccaagctggtagcgctgcattacctcattcttttctggtcttggtcattgaccatccttttcataaccacagactcagctccatctttgccacccttgagtggaccgaggaggaactctctaaggctcaggcccatctacttagacacttctgcttcaataggttctggctgcttgggaataccagcagcaactttctggaacaccttctgggaaaggagccacagagcttctctcttcaggacatcaggcttgtctgcggtttctcctagacttgaggacaaggaagcctcggtatgagaatgtcctcaggaccaagcagaagaatgtaccttttcattcttctttctctgccatccctttcttccctaaagcaaaaggtcaaatgctttgttgctgcttgttttggaaaagagtaagagggactggtgaaggataaaggaggaaatatgtcaactctcaaatatgacaggattgaacacatgatttattttatcaccttagaatttagttctagaagtctccttattttttttagatttgatggtataatttctatggcagtgttttgaattcaaattgcaactttacatgacagacttagggtacagaattacaaatctggacataatttcctggcgattgaatcaagtatcaacatatctgatgaccaccatgacgggagttggacaagtcaccagcactcagaaaatcaaaggtcagcttgactcaatgttcactcctttagaaacgtagggagttgactgcttcttgcacgcaccaccgcacctgttccacaaaagcggccttgtgagattggcaagagaagccaagatatccaagctatttcccacctaataagtacctgggagctcaagcttcctctgtggctctgatggcactctacctgggagaagatatagcaaggagaacctgacagatcatccatatggtgccatctgtggtaagagattagtcactgcatacttctcattagaaaaaatataaagaaagccagggaatcccatgataagtcccagccaggcaaagcagaagaccttctgctcttcccatctgattcaccattacctacaaatacaagatcaaagataaggaacgtaagatctgacttttaaacttaatcaacaaaaatatctgcagtatggtatagtagaaccatggaacttcaggataaatatggtagattgaacatattcaactaactgaactttcttgaaaccacaccaaaactccattaaaagagacttttaagggcataatctggcaagggtgagggataatagataagaaatgaccattacataatttaggtatctggctatatgtttacagcagttgacagatctgagaacctgatcattgatcatccgtgtgaaaacctggaaccaatccaagttattttataaaaaaccttaaaagtctcagaaattgatgatgtttgtttcctctggaagtgggattcaagataaggcataaaacaaagaggagagttgacagctacttaaggaacaatcagaactcccaccttagagggactatttatgtatttattctttggagtcaggaaaacagagagtgtgaggatgacacaaagcccagatgaaagcaggctacaggccgggcgcggcggctcccgcctgcgatgccaacactttgggaggcttaaacaggcggatcacctgaagtcaggtgttagagaccagcctggtgaaaccctgtctctacgaaaaatacaaaaattagccgggcgtggtggcatgtgcctatagtccctgctactcaggaggctgaggcaggggaatcacttgaacccaggaggcagaggttgcagtgaggcaagataacaccactgcactccagcctgtgtgacagagcaagactctgtctcaagaagagagaaaaagaaagaagaaagagagacaaagaaagaaagaaagaaagagaagaaagaaagaaagaaagagagaaagagtaccattttgaaagcaagaagataaagtaattgtaagcatatgaaaaaatgctgagacctcctgcattcttctccaatcttgctctagaatgctggcatccaggccttcactctatcctggcaagagattagatagaagttctcccaagaatctaatctgcctaagaggaaagacctaaagatatcaatattagggattactccgaaagatacaaaggaagatccctctgcagtgatgccttaccaactctcatacttttcaagcacagcaaacacatccagaaatccaatcagctttttagtctgccaacttgaaatatgaacagataattaagtgttactagacatatgaggaaaacttccttaaaaacaggaaaaagcagggaaaaaagtaactttgtaggaaataatgactatatagtgagaattcgttaagtatacacatatcattaatgtccatagaaaaataaccaaatatattatgtccatgaaaaagaacagaatgctaattttttcaataaatgtcagagaacataaactggctgttaaacacaaaaacaaagcactccaaaaaaaggtggaaatacaattgaggaaatcttttagagagtaaagcaaaaaaattagatggaagattggagagaaaatgtataaaagtttaaaatccggtcaggcatgttggctcaggcctgtaatcccagcaatttgggaggctgaggtgggtggatcacctgaggtcgggagtttgagaccagcttgaccaacacagagaaaccccatctctactaaaaatacaaaattagccgggtggggtatggtggtgcatgcctgtaatcccagctacttgggaggctgaggcaggaggatcgcttgatcacctccacctggaggtggaggttgtggtaagccgagatcgcaccattgcactccagcctgggcaacaagagcgaaactcagtctcaaaacaaagtttaaaatccggacaaataatattccagaatgaaaaaacagaggaaattatcataataattcatgtttttttccaaacaagacaacagctttcagactgaaaggtttcaaagagtgcccagcataggggatagataaacctatgccaaagcacatcattgtgaaattttaagaaacggggaccaaaagtgctagaaattgccagagggacaaaaaccaaaacaaaacaggccacacacctgtttttaggatggtgaatcacaaagtcttcaaacctcttaacagagctaaaagacagtggagcaaatttttcccacaaaaatcttttaaaaaaaaatccaacccaaaatactgtgtccagcaaaactagcaatcaagtgtgcaggtgtaaagaagtcatttttagacatgcaagcctcaagaaacttaacattcatgaatgctttctctggaagctactgaccaatgtgctctaactaaaattaaaaaattaacaattaaaggggaagacatggcataaataaaagagatttagcacagaatagaagtgaagaaaacagaaattaatcaatctagattggagcagataaaaggctccagaaaagacttcaagagaatctaaccaagagaacacttgttatatttgtacatattgcaaaaacatttagctaaccgggggatactttggagttggactggagatatatgcaaaaaattaagcaaatgataaaacaagataattaactatagggaaaattttaaaaaattgtgcatgaagataaaaataattgttaggttactgtatgactcaaccctgaacacactgtgtagtcatgataacataaagactgaacactgtaactaaattatagtattactgtctctgaaagaatgagagtaatgtatacatgtgctacaggagtagagataagaaagagcaatattctcatctttcatggtggtaagtcaaaaatagcaatacatgcgtattattttgagatacagaagtaaataccaaaagcttctgctaaaagatttgaaggtgtttgcttctaagtaaggagacatgaggaagcgtgtttctattaaccatcctagtaaaagtggtgctggatggcagccatagaataattctaaatttagcagataacccttggcttctcgaccatgttgtttttcctattcttgtctcctgaagtggtatctgcacatcaagagcaaatcacacaggtggcttcttagctccccttggtgactccacacactggagacattcagcccctccctactccttccttctaaacttagcccatcggcaatcaacgctgactgatttttcttcatcttcaaccagacttgggcagcagaatggtagaaaggaaactggagcagagctggatcaaaatgaattgcttctttcagaagagtcctgaaatttacatccccaagaaggttcctatctggccaacatgaaattagtgtgtccactaactgattgcatgggctgcaactccaaactctttcgtgttatatgcactaagaactacactaaatgaatagaaacctgaactgatcagcaacaggaatcaaggatgaattttatgtgccatgtttttaagttcttgaaaggcaatgctctgatggacacatccttggttatttccaacccttgacacatagagatgcaccctcagtaaaaacgtgttcattggtaaccaccagtaaggaataccctagctccagggtgcgttcaaaacattttgctgttgctggagaaatatgaactgaaaacatcttttcccatgtacctgaaacaagagagtcaacccagaatgtctccttaaaagtaggtttttagaagctaatagataaagggatccgaacctgagaagatgagagaaccactccacaatgctcttctagaccattcttcctttctgttctccagggctcccttttctggatacagatcttcctcattcttaattgttgcaaggccaatgggatggccctgagtgtagaggaggcatcagagtagcccatagcccagtaaatactcaagggcctttgtatgcatttgcaagcatgatggcatccagctgagtgtcactggatacacttcagggttttaaagcatgattttaaagcatccctggaaggtatcattacgtcatagcagaattttgaattgatgtctttctgacatctttaggagcattgttttttccattccttgagggatttacatgttttgtacttcagctggaagtggtacaaacactatgtttgtttatgaagacttttaaatgccattatatgagtgacatgtccaatggcatactgatttattattaacaaaatatataaggtaatttatttttagcctttgtcaactaactttatccttctgaactcaatttctctttctggtgattttatttcagaaaacagtagcattgcttttactgtttcataatctcactcaaatgtgggacattttgttttaatttagctagaaataattcctaatatattagcctgattgaattcatagacttttagagctagaggagactgaggcatccatatagtttactcatcctataattaaggaatttgtccctgaccagtgaccactggcaagaatggaagaaaactggatttcttgtgctgttactaagttttttagaaaagcaatgtgttttgttatcttaattctcaaggtttttcattcttctatgtgcctcagtggaccagagtggatcagaaaaaaaaattgtaaatttttcacaaacagtgcaagtttgatagaaaagggctaatgcattttagtcaatggcgacaataatattccagctgaaggttatatggaagggatatcctcagagtttgttctctgccccaagtctttactagtcagaactattttttaggctaattcattatgacaaaacatctgtatttttgcaaatactcttgaccccttagctgacacctacaagattacaaactgactgctctttatctttacattttattggctttccttgactttgacatatctctgcctaatcatttaatgtatcaaaaatcttcagcatttgctccttttgttagcaaggcaaagctttgggattgaaaagttgatccctggttcacagttacagttccctgattgcacagttattttattgctatgatatgcatgtgtttacaagaagctcactggtagtctacaatcatattctacccaaactacccttcaaactcaatctttgttcttattcaagtttaggtaaattccttcaccagggatttttaaattctttaatataattataaattatcctcacactcactcaccaaactattgttgtttgttgattttaatgtatactaaaaattctgttaaaatattttattccaatgagataataaaggtagagaaaataaccaaaaaggttatggtttaattgacctgtagggtattaactagtctgtattcaatttagtaatatctgtctagtttgtgtttttggtttttggtttatttgcttggtttttgttgacaaaaatatacaaatacatacatacaaacacatacacatacaaacacatacatatatttgtgtatatatacttatatgtatatatgtgtgtatatgtgtgtgtgtatatatatatatatatatatatatatatatataatatatataaaatcagtgtctcatagcctcctttgacctggctttgacaacttccggattaaataaaacttggatacacattctttgcatgttccaaattataccttgaccttgattataatatcttcatttgagtatgacaaatatatgaagtgtacaccttcacttttctatcctgtacccaaggcagacatcaaaattaatcacaggcatggttcagaatctttctcaacacaagcacccagaagacattaacaataaatggaatttggagctaaagttaaaatccatttgtcatttctgccctattggcctatgttgttgttttttcttgcttttaaaagttgctgatcaaaccaaaggatgtttattcttgcatttcattcttgttcttctttcatgttcaataaaccattgtattagattgcacagttattttattgctatgatatgcatgtgtatacaagaagcatacacttgccagttttccataccctgtgactcccccagtatgcacactcatccagcagttacattactttcctttcctggcccctgaagatacttgcatttattgcctgtcttttaaggaattgttatagttagagattgggttgtgtgaaattgccttttgcataggtgaaaaacagcaaatattacaaatttcatatcatttgacctaatcagaacataagaatcaaacaaaatgctgctgtctttggtgatcttccagtttcaaaacaatttattttctattttgaatcccaataatcatccaaaagaagtagtgatttagcacccactgtgcacaaagcatctagtagacaccagggacgacaaagatacatgcacattcagcttttaaaggtgctcgtgcctgggtttcaaggggtgaatggccttattttctattagacggtgagctctttgaaggcagaggctgtgttttactgtgctttatttttctgtgcatttatcgtatggtagatgttcaataaacctttgtgaaattagtgaaaggaaaagagataggggagaaggaaaggaaatagagagaaaaggagaaatagagattctggtgtgaaaagcacgtgcccaggcccagctcagcggctcacgcctgtaacctcaggactttgggaggctgtggtgggaggatcgcttgagtacaggtgttcaagaccagcctggggaacataggaagacccctgtctctacacagagaaaaaaaattacctgggcatggtggtgcatgcctatggtcccagctactcgggaggctgaggcaggaggattgcccgagcccaggaggaaggtttttcttttgcgaaacagctcctctcatcaaaagagccaaaacaaactttccttcttattttttattcttggacaatagtaaaagcaatttagctattgagtttccagaacttgggaaaagcagtcatcggtcaccttgagaaatgtattgaatgtgaaaagatttttactgtggtaaataatcagtgctagctttgccatttacaaatggcacatctcttagcaatcaagaataaataatgtttaaatcagtaaaaattagaattgttaaatgttgtcattttactgataggtttggcagtaggggagaagagaaggaaaacagatacttttatataccattggtgaaagtcaattgctaggactttaacagaaagaaaattggttatgtgtattaaaatcctcaaaagtatgcgaagtctttgaatcagaaattctatttctgggaattcatcctgaagaaataattaagtatttatacaaagatgtaaccatcagagcagtcaatgcaatgtcatttatactagtgaaaaaattagaaacaactttaatgatcaatgataatagaatattatttcatattatactgctatattttatgatataaaaatatagatagttgcatattttatgctatagttaaatatccgcatagaatttatttttacattaaaaatgttcataatatattgctcagttaatacaaaggttactaaattatatatataattatatgtatgtgtgtatatgcatgattacagcttcataaaagaattatacacacacacgggtatttttctgggaggatacacaccaatgttttagcagtagttatctctgaaagaaaagttagggatgttcaaaacaagttttattttttctctctgtttatctcatttcccaatttttctttaatgaacatattccacttttatagtaataaaaactgtttcaacaagaaaaaaaaaagaaatgctaccctccgacatttgttggcaacatatttactacccgcaaatatgttgtttgaagctttgattgtcaagattgaagaaacaaattgtagtgatagaccaaaatacttaagatgatcctatgtatctatgaagattatgacaaaaaattgtctcaatacgtgtatcaaaacatccagttgtacaccttaaatatgtagttttttaaattatacctcaataaagttgacaaaagaattttgtcaatatttagtattagtcaactcagaaaggttacaacatagaaaaatttctaaatagaatctgagtaaactaaattacctgtgtcatatttctgccatctgaagtaaaataattcttaatatgagatttaaagatcttttttcatgagcattcaaatttttattttcaggaaagactcatttgtgggcatctttattttctgtttcagagaaaaatatcattatttgaaaacaccttttttttttttgagacagagtctcgctctgtcacccaggctggagtgtagtggtgcgatctcagctcactgcaaactccacctcctgggttcaaacaattctcctgcctcagcctcccgagtagctgggactgcaggcacccgccaccacacccggctaatttttctgtatttttagtagagacgaggtttcaccgtgttagccaggatggtctcgatctcctgaccttgtgatctgcccaccttggcctcccaaagtgctgggattacaggcgtgagccaccgcgcccagccccaaaaacactttaacattattttaaataataaaaccacttgtaaattatttatttatttatttatttatttatttatttatttttattttgagaaggagtctcgctctgtcgcccaggctggagtgcagtggcgccatctcggctcaatgcaacctccacctcctgggtgcaagcgattctcctgcctcagcctcctgagtagctggattacaggcgcccaccatgcccgggttaatttttgtgttttgggtagagaggagacttcgccatattggccaggctggtctcgagctcctgacctcaagtgatccacacgcctcagcctcccaaagtgctgggattacaggccacttgtacataattttgattataaagtaacatacattaataagaaaaaaaattgaaaaattaccccaaattctattacacagagataagcactgataacattttagtgccgatccataaagttaataccagtcttacattggaaaacaggaggttggtgtttatttaaatcctctgaaaatttggtggggctcatgtaactacatgttttctctattgtctgtgacatttggaaataattgtagtgaaacagaataatcctacactcttatttatccatactaaaatgtcttctaccttggacactacaagatatttctggaaaaaaaaaaaaaaagaggcgacttgacacccataaaagaatgcattcacatcctttctaacttcatttcctccaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacaggtatgaattttctagttctttgttactttagccagtctcaccaaatttcaccaacctctactttctgttgttcggaagctgaagtgtgttttcttccatttcctgcgaagtgcctctgagaactctggggttccaccactaaagcctcccgcctcccataagcagtcatgtccacatgtgtatgaagcaatagcatcatttctccacagcctaagtttttaagtcttctaaaatgcaaccacggctgacattttcagatcaatgggatttttgtgtaactgaactcattcttcagtgtacttgaagccatgtccagtcctacccggttctctgggctgtgttcatctacatgacagctccgaagttcttaagtggtggctcatgcttgtaatcccagcactttgggacggcgaggcgggcggatcacctgaggtcaggagttcgagaccagcctgttcaatatggcgaaacccctgtctctactaaaaatacaaaaaaaaaaaaaaaaatcagccaggcgtggtggtgcgtgcctgtaaacccagctacttgggaggctgaggcaggagaatcacctgaacccaagaggtggaggttacagtgagccgagatcacaccactgcaccccaacctgggtgacaagaatgaaactttgtctcaaaagaaaaaaaaaagaattaagtaattgctttttgttcaaggtaggacagggctttagacaaaaacaaattgacctgtgaatgacaacttatactttattgtaaatattataataaagtaggataaaacatcaatgtgtttctaatctgatcttaaattaagccttgacctatttggcagtctggtgaagtgtatgcacccttctcagaatgctaaatgcataaattaagtacctagaattaaagaggaaataaatttcattgaaatatttttataaaatgttatgatatataaccttgtgtatctcagtattaacacaatttaaataagtataagtaaaatgttgtgataatttgcaacaattggaatataatacacagatcttgctagtgacttgtaaactacatacttaactgaagagaatgttaaattttgtgtagaggttaaaattaaaactgtaaccattctttctcatccaagttcaaggaggttcatggaatatcactttaacagtctagatctttgacatgataaaattcaaagaagtataatttttaaaatctgagcacattatagaatcttacatttatcctatatttaggaccacaaaactcaaaaatacttaaatatatgtccggttgaattttgggtattgtgtgtgattttgtttaagtggaagtcacaatatagagtagattttttacgaataatcttttgagtccaaaataccttccaactgatatatttatattcattacattctattttatttgtcatataataaatgagtcagtaataccaaaatgattgaatgacaagactgattggatatacattttattttttcaccttctttcagagtatattaatttttccctttctgactatcactagggttttcagattttatgtatgttcattcaatcgcggctgccattctccttttgagagaccaaattgtctcaactttggttagtaggagacatttttaggctatcatctgtgtcctcttgacatgacctattaatctttgaaagtgttctggcacatagagatcttccagactcaccttattcctttctgctccagagatggaaacagactattctccagtgagccctggttctttttgatgggaaagaaaaagtatgagtaacagcaatttggaccctgaacattgcctggactgtttcagtgaacaaaggaagaaaagataatttttttttgtctttttaaggcacgagttcacataaatatttctacttctacctaccaatttaaattattattattattattattcttgagacagggcctcactctgttgcccaggctggagcacagtggcatgatgatagctcactgtagtcccgatctcctgggctcaagcaatcctcccacctcagcctcctgagtagctgaaactacaggcacgtgccaccacacctggctaattttttatttcttgtaaagacaaggtctcactatgttgcccaggctggactcagactcctgagctcaagcaatccttctgcctcagcctcccaaagtcctgggattaacgacatgagccactgtgcctgtccccaatttaaattatttttttaaattatttttccataagttataagggtataggtggtatttggttacatgagtaagttctttagtggagatttgtaagatgagatcctggtgcacccatcacccgagcagtatacactgaaccatattggttgtcttttatccctcaccccctgccccaagtccccaaagtctattatatcattcttatgcctttgcgtcctcatagcttagctcccacatatcagagagaacatacgatgtttggttttccattcctgagttacttcacttagaaaaatcgtctctaatctcatccaagtcattggaaatgctgttaattcattcctttttgtggatgagtagtgttctatcatgtatacataccacagtttctatatctactcattgactgatgggcatttcagttggttccacgattttgctattgtgaattgtgctgctgtaaacatgcgtgtgcaagtatctttttcaaatagtgacttattttcctctgggtagatacccattagtgggacggctggatcaaatggtagttctacttttagttctttaaggaatctccacactgttttccatagtggctgtactagtttacattcccaccagcagtgtagaagtgttccctgattgctgcatccatgccaacttctactgttttttgattcttggattatggccattgttgcaagagtaaggtggtatcgcattgtggttttgatttgcatttccctgatcattagtgatgttgagcattttttcatatgtgtgttggtcatttgtacatcttcttttgagagttgtctattcatgtccttagcccactttttgatggaattgattgttttctccttgctgatttgtttgagttcattgtagattctggatattagtcctttgtcagatgtatagattgtgaatattttctcccactctgtgggttgtctgtttattctgctgactgttccttttgctgtgcaaaagctctttagtttaattaggtcccagccatgtatctttgtttttatgcaattgcttttacccaaaagcaatttttggtcatgaaatccttgcctaagccaatgtctagaagggtttttctaatgttatcttctagaatttttatagtttcaggtcttagatttaggtccttaatccatcttgagttgatttttgtataaggtgagagatgaggatccagtttcattttcctacatgtggctagccaattaccccagcacactttgttgaaaagggtgtttttcccccactttatgtttttgtttgctttgtcaaagatcagttggctgtaagtatttgggtttatttctgggttctctattctgtcccattgttctgagtgcctatttttatgccagtaccacactgttttggtgactatgcccttagagtatagtttgaaatcaggtagtgtgatgcttccagatttgttctttttgcttagtcttgctttggctatgcgggctattttttggttccgtatgaattttagaattgttttttctaactctgtgaagaatgatggtggtattttgatggagattgcattgaatttgtagattgcttttggcagtgtggccattctcacaatattgattctacccatccatgagcatgggatgtgttttcatttgtttgtcatctatgatttatttcagcagtgttttgtagttttccttgtagaagccttttgactccttttttaggtatattcctcagtattttttttttttttgcagctattgtaaaagggttgagttcttgatttgattatctgcttggtcactgttggtgtataaaagagctactgatttgaatatattaatcttgtatctgaaaactttgctgaattctcttatctgttctaggagctttctagaggcgtccttaggattttcaaggtaaacaatcatatcgtcagcagtcagggacagtttgacttcctcttcacttatttggatgccctttatttctttctcttgtctgattgctctggccaagacttccagtactatgatgaagaagggtggtgagagtgggcatccttgttttgttcccgttctcaggaagaatgctttcagcttttccccattcagtattaagttggctgtgggtttgtcataggtggcttttaattcattaaggtgtgtcccttgtatgccaattttgctgagctgtgctctttttagtaatcttgatacctaacagattatacatactaactcattttctttactgaaaaccttataatagtattaagaaaattttcaatattaatacaaataataaaactacaaaatgtagttcaaatttgtgtatgcagtttttaaattacatttcactaaaaatttacaatcaaattaatttcttcttctaaattaatttcttctgaagtcattcatatgcccttcctatgtataacttgttaaacacagatgtggtaaaaaatttggctccattgtgtcaggttagtttaaatttgagggtgttggcatattaacagctaatcagactaaaaagatgatgtgatactttcagctattaggaaagaaaagggtttaccttttttatgaagaaagaactctaatagctgtctccaaatttctgtacaatggttttgtatcaacaccatctgattcatatacctcgtttctggtcaattatctcttcaattatttaatttctagtactgttagaatccacatattttcaaatactcagtttttaaaactatattaactatgttaaattgtattctcatctaaggggttttgtttttgctgttgttttttttttttatcttgctcccttttctgagctctgtattattataccaaggtttgcattagataaatctgtaaccactcaactgggttcttcttgcctgctgcctagaaaaagccaatacactgagaacagcaggtgttacaacagagaaagtttacttattgcaaggcagtggagcagaaggatgggacatatttctcaaatcagtctctctgataatccagaagctaggatttttcaaggatagttaggcagcagggggttgggaagtggttagggaatggggaatgctgattggtgggtcaggaaagaaatgacatgggagtcaaagctgtcttcttggactgagacagtccctgggagaagttaagtctgtttcttggcatgggtcacaggatgggtggcagtagttggtccatgagaattcaaggcctgaaaaataccttaaacaccagtcttaggttttataatagtgatgttatatataggagcaattagggaggttacgaatcttgtgacttcagtcctaaaccataattccaaccttgtggttaatttgttagtcttacaaaagttgttttggtccccaggaaaggaggggattagttttggaaagggactgttatcatctttgttttaaaatcaaactatatactaatttcctcccatagttatcttggcctgtactcaggaatgagcaaggacagttaatttgtgaggttagaagcaagatggagtcagctatgtcagatttctctcactgtcatgatttttgcaaaggcagtcaaatctacattctcacagtattaccttgccccagtaccagccatttattttcctgcaaggaaattaaggagaattccatataattagaaacaaaactatataaaaatataaatacaggctcttgaagttttgcctgaaatgctgttttgactcatgggtcaaaatttggttttacttcacatattattggtagaatcattgttttaattacagatgaaactaatgtagaagtcctgtttctcagaagcctttggataaactcaaatttctatgatataaacattcaagctaccccaaatcaattaagaatgttataaaataaaaatataaccaatgcctaatccaattgaatcctattaaatttttaaattaatatctagaaaataatttagtttttatactttacagccattttcagaacaagtaaaaactgtatttatagaaacattatttcatataaagagtggtggaaaaaagaaagttttcctatttaaatgagtttaagaaatgctaggtgcaaaggaaggttagcacctaccgtaatgtgttttgaatataaaataaaaggatcagagtctcacagtcatcaactcttcatcctccttgtcaccacccaacttattttcttggagcattttaaggactaatattcctgaaaaatgctatctaaatccaaataggaagaatttcaatattcaggatattttctttgagcatccaaagggactgtaaaaattaaatatacagaatgaaaccaatcagtttagcaatgcattattattatgtctatttctctgctcattattgcccctttgttgaatatcaagatgcccagaagtaaaaataaattgtatcattgagagaaatagatgcactgaatgagtggtttttaattatcatggtcactttttggatttggggtgattttggcagtaccctcagtactgattatgttttaaattattgcttttccttgaggaatctgccctatgactcaagaaaaagaaatcttcctaggaagaaacactatgcagtaaatacaacctatacttgtgcacctcttcataaaccttcccatactcccaactatttgggagataatggcttcagaaacactggaaaggcaaagcaatctatctccggacagctaatatcttcattcagataagaaagaaaccattagatttgagggttttgctatccccaataatctgatgaattaaattatctgactgaatgtttctgataattattcaactcctctcctcatgtataagttcttggctgaagaaaagttctaaaaatgatttaagacctagctgtacccttcccagtcatctgctacaaacccagactttgagcacccctcctctctttcccatctctcccactcatttagcccttagcatatgcaacgttttatcatttgtttttgctttagagcacacacagacctaaaaagtcaggtggtagaatgaaaagaagatgagcttaggaaataaacagggcccagtttaaaatggcctttaagtaaatgacatacttaactcatttgagccttggtttgtttgtaaaatgtagataaattaaaacagccagggttcttgtggctgaaagtaataggatgctattatttaatggcttaaagatttaagcagtgtattccctcacacagcaaggcacccaggagcagagtggttgaggattggttaaatcaggaattcattaatatcatggaagacccaggtggtttctgtctttttggtctccttatggtttcaagatgactgtgtaccctaagcattacctccctgtgaaccaagatccacaaaggacatggcgaaagttcttgtgacccttctaagagtgaagaaaatgttcctagaggttccctgacagccccccacctccatcccctcaatctggtaggcattctttatgccatgttatatatagctcagagtcacaccacacatcaatgcccacagtaattgctaacatgggccacagaactaccatgactgactgagaagaatcaagatttaccccaaggctgcagagaagaccctgaagcatatcagaacctagataaaatattttactggcaaggaaaaagagaaagaagagacagaaagggcaaccagaagtgtaagaatgggaagaaatttatgtttgcctccctacctggatggtaagggtaaaggaatatgtctcatatcactttcatatccccagtaaccagtattttgcctcccacagaaaatgttttggggaatatgtacaaacacataatggtgaagctcctataatcagtaaagtatatacttgaagtcattttcttaagagtggaaatgactttaggctcttacatagacactttgtctcctaagccatctcatggcaactgctctgtgttcaagaaagcaccatggtttcactggggcagcaggcagataccatgtaattgagaaatcagatcaaacagatgcatctagagagggtcaagacaaataatacattctctgcattttggacagtttcctcaggtgtagccatgagattatatgccctgaatggctgtcatagcattgaaagcaaggaaatgtagtcctcatctccatctgttgaaggggacaataactattgaagaaggccactgaattaacaaatatatcacattctggaaccttcttaccctggaggttgaagggaagacaataatgataaatatgaaaacaggcaattaatcatcagccactgcaagatgaaaaattcttcagaagtttgtgttaatggaggaattgctatttttgatcttctggttttttctatccctggatgccttgggtaatctgagacaaagctcaagggaatgtaaccagccacccaaaatgaatgcactcaagtgagaagttgcagagctgtgacttggggcagtattatgaattactctgagaaggagcttcagctcccaagttcaatcatggacttggaatgtattccagaggatgttcagagccagggagagatgatgtcaaatactagtttcagaaataccaaaggttgaatgactcatgacctatcactaatctcaaccttcagcgatccgctagccccagaagctatatttattcaatatattcaaatggaaatataatgggtagatgagatgtaataatgagttaagaattttagggaacaaaaataaatcagctttgaggcttaaggcagaaaagagagtaacagagaatatgaatacatgtgtttgaaaaatatttccataaatgaagtaaaacatacagggaacctaatatgcattccaaggaataggataattatggataaatgtgggttttctcaaagtatgctttctttgggagggttccatttctaataaaaagtattcattttaagaatgaacaatgagtttaccttggagggattctgttggtcttaggtggacaataaactctttctcttttttattcttcagtttttttccccacattcctttgcatctcacaaacccaacctcatgccttaccatggttttcaaaacattaactgatcaacattcaaaaaatacatcaaattccttctcattgttctttgattaaaaatattcacaagaaaatctaaggaaatgtttctcaaaactttgaacctcttattacagaatgctctagtgtctgttaggtatttatctactttgatacactgttaaatctgattaaattcttcacactatccttactaaagttagtaacattcaactagtattaatgaaattgattcagaaattgtacaatatgtaattgtgttgatatagtcagtgatgtgcgtaaacaattctctaaacagtacacacaaaaatctgctctattctttaataccggtgcaattttctgcaggagcaagcattttaaattaaataacctgataatatttgaattattcacttcctttagctatagtagctcctctttaagtttagaaataacatataaatgtttgtcttttcccctttactcccactgtccccttgtccctaatgcagaaaagacctttgtaaatctttgccatgacaatgtactttgaaaaggcaattaggaatggcaatttgattatccagcatcaggaagtttctagatcattttgtcagcatttctgcttttccaaatgcatctttgtgttgaaaacatcccatttttccagtagagaaaagttattatgcagacccacttaatcagcctttcagtgcatttaccagggctctatagaactcaaaaatgtcatccttttgttatgctggtggttgagtattatgacatgcatataaaaataaaattaagctagtaggcttaatcccattttctttgtcctgtgtgtctccacggggcacatcttgtccatgtcaaagtcattttaacagtttgcatcaatatgccatcttttaactggctatttaaaaaaatgatggtaggccaaatgtggtggtttatacctgtaatctcagcacttcctgaggcagaggcaggaggatcggttgagcccaggagtttgagaccaacctgggcaacataaggagactctgtctctaaacaaaatacaaaaattagttgagcatgctcgtgcacatctgtggtcccagttacttaggaggcttaggaaggaggatgacttgagcctagggggttgaagcttcagtgagctatgatcacaccactgcactctagcctcggtgacagagtgagatcccatttcaaagaaaaacttttaaaaaaatgattggggcttatagaatataaatcaaagaaaatatttaatagggaaaaccaaagacttcaatttgtgtgttgctaatgggcctgttgcaagagctatttattattactctttcaaaaatagtttatcctgaaattagtgacttccactgacttaagtaaaataggagcttttggcttccatgccctgtgtattataatcaaggccctcagacctttcaggtgccttcattataacaattctcatcactttagtagggtatgttagttctattcacagaagtcccattctggtaaagtttatctttttcttccattgcttgtgtttttggtgttgtatctacaaaaccattgctgaatcaaggtcacaaaaatttactgctgtgttttcttctaaaggttttgtagttttagctcttatatttgtacacttgatccaatttgagtttagttctctatggtatgaggtaaggatccaagttcttctttttttatttttatgtggctatccagttgtcccaacactattgaaaagatggttctttctgcacttaattgtcttggcaattgttgaaagccagttgaccataaattgagggtttattttggaaatctcaattctatttccattaatctatatgtctgtctttatgccagtaccacatggtcttgattactgtagctttgttttaagttttgagaagtgtgattcctccatctttgttcttatttttcaagattgcttttggctgtttcaggttccttaacatttctatatgaactttggatcagtttgccaattttttccaaaaaatcctggtgagattttgataagaattgaatctttaggccaatggtggggagtagtgtcatcttagcaataccaagtcttctgctccatgaacatgagatgtatttccatttatttgggtcttctttagtttctttcaacaacattttgtaattattagagaataagttttgcgatcctttgtttaatttaaatttatttatttatttatttatttttgagacagagtctcactctgttgcccaggctggagtgcaatggcaccatctcggctcactgcaagctccgcctcccgggttcacaccattctcctgcctcagcctcctgagtagctgggactacaggcgcctgccaccacacccggctaattttttgtgtttttagcagagatggggtttcaccatgttagccaggatggtctcgatctcctgacctcgtgatccgctcgcctcagcctcccaaaatgctgggattataggcgtgagccactgtgcctggccttaaatttatttttttttaaagagcacttttaaaaacagaatgtttagcttttctcagcatttgtgcctttggcaaacatgtcagaggcagctgacttatataatagaacagtctcccaacaataaattctcatcaggaggcagtcagaattaaaagagtgagttttgatgctataatcctggatcttctacttcctagcattggaaacttgggcaaccgaactctgtgccattttattatgtgaaatgggtatttttttattaaatagttatgccacagagattttttgtgaagattaaatgtttagtatatatacagtccaaaaacctgtaattggcacatggtaaatagttaataaacatgcatcgttgttattgttacaatgccctatcttttcccaaagcactactacagattctatttgaaattgagccattaccttctggtatgttgaggcagaagaaaggcaaagaataactgctgcagctcttagactctttgttttcctgttattgaggagcctttctaagaaagcaccacggtcatccttgcttcatgggaatctggggtttgttttgttggtgttttatagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggtagagtatatgaatgttactaagagaggcagctggagacacctgattccttttggttaaagcctcctaaggtagaaagtcccagtggtcacaattaagtccaaaggctgttaatcatctttgcaatttcagaggctaaaatttggctgtttattcatgaataattggcatcaggtgaattaattcatgctaaccaaattctaaggaaactgtctcgtgaaaggaaatatcaaggtatttgtcttgtcctctttagcactcttactcctaatttcttgcattttatttttgtgaaatatccataaagaatacagacaacttatttctatgctttaactaatggctataaagtatgcatccatgtaactaccatctaaatcgagaaatagaaacttggggagtacctgaaacacttccatgtatccattcccatcagaatgtcccgtttaccctcagaggtgactaccatcctgactattacagtggtccctactttgcgcttctttagagcacaaagtacaaatttatatgcagccctaaatgatgtagcttcaccaatttttttcacttgtaaattgattcacactatagtatacattattttatgacttgcttttttcactccacattgtttagaaggttcattaatattgtttcagataactctagatttgttggctttctttatcatgatgatagtattaattattactgttaattattatgtaagattccattctgtgatgctatcttttggaatgttgacgtctatcagtcaaagacccctaggaacatacctatggtcaagttgggtttgtttgctcatacaacaaaggagaacacatgttgtagggagctggagtgtctcagtaaaagtttattagagaggacttacaggacttgggcttatagtaggtgatttgggggacggttcaaaggagaagggttttgcagtggattgggtgctgtcaggaggcacaaacaatcctatgagagggtatcttagtaaatcctatctaggaagcaggactaaagctgttactgataaagatgcatcagccattcttgttagtgagaaatgaggtgcatttggtctctctctttttccacccttagctctattttgcaccacaaggggccacacattcatgtgtatggacacccaagcccaaatatctaaagtctgtccacatgtcctgcaaagagccttccccagggggtaggggccattggagtaggggaaatctggggtcctaggtacttggagagtgactggagaaagaagttgtgggcttcagggaacatgttctctccgctgactccggctttctcacccctttaaatgggaatcagaagagaagggccagaggacaacctctcgcactaggtcccaaggcataagccctgttgcctgggatacctgggtctcagggaagtgtcactaactcttatctgaagcaaccaaggaaacagagtccaagtaagtaattaaggtgagtggagacaaggccattgaacatgggagatcagagtactgagaagcaagaatatgggatgaattcaatgttaatatcaccaaggttagtgacgaagctttggatgaagaaactgtgtgccacttgccaactcttttctgaataagggtggctcagtagatggcagaagtgaagaagaggtaaaaactcttttggctgcctcatgggaactaggatttttttttaaagaagattgaaaggtagtgttttagaagtagcattgagagcaaaaagatcccaaaccccagcttcttaatgtgaaacacttgagatgtgagaaaataaacagtgatcactgaagaaagcagctaacaagaagcaagattttcaagggacagccaagtttctgtttagacaaaaggatttttctgattgaagttgctgtattagacaataataaaaatgttttcagcagtaatatcattcacacctaaaaatatgtgtattatgttgtgcctaaggaatacgacttttcatttatgcaacttagcctacaatgcaataattagagaaaatagcacccttcacttaaattttacaacaaagtttaatacagggttgacattaattctgatcaaaatctttaaaagctgtgtctgttcctgaaattgagcatgattatgacccttgcattttcttaagtggaaaatcaatgtttaattcatttccatagtcccacttcttccctctcagaccttgctatggtcctttgtcaactacctaagatgcagtctaacagttgggctctttaagaaaaagtggagacaggttacccccatgtggaaccagtgcagcttgggctcatctgtctgttgatggatgatgatgctcctggaatggcagacagcacgccctgatggagctgagagctggtggcaccgcacactgcccatccgccaggaagacctgccccactccctccccaggccactgccctgtctaccctccagagacattgtgagaagcaattgttattttcttaataatttaaaatcctccaagttctctgagttccttgtgggagaataaacaccaagcacatcctaaggcatatttattttatgtggagcatttgcttcttggcctctgcctgccattgagtcaacttggagtgactctccttgtgcactcgatcatagaagtggttcttcaattacatctgtaatcccagagtcacgggctgattgaacatctctttctgggctctggaagcatggcttctcaaccacgtccatacacttgccagtgggtgagaggcttaaagactaaaatctaacccagaatgctgctttctctctctgcctgctggagttgggagtggggaggtgaccaggatggctaaagacaggagtgaattcatcatcccagttggtttttccagctattcctcctgctaatgcacatagcaggatagacagttctggctgagatgtggggaggtgaccaggttggctaaagacaggagtgaattcatcatcccagttggtttttccagctattcctcctgctaatgcacatagcaggatagacagttctggctgagatgtgggtaggtgacagtgggtgaggatggatgtggggagtggaaatgccaacctattttgcagactgatatgcagtagcaaggatgctttgcatcaggactgagactaggaaagacaagtaagtctcctagcaagtaaaatttaaggacgtctttgctctcagggctgtgtaagcacagagctggcactagagagtgagtgtctctttaaattttgcacatagtcgcctctcttgcctcatcctagtcccaacactgcttgcatgattatcagcatgcagtctgctttccctgaacccagcgtgtaaagtgactttgtaataagaaagagtaagaagagaaacagggcacaaggccctacataatctgcaatcccattaccttgtttcttactgctttccccctcatccactgggctccaacagtactgaccttgctgttcatgggctgtgccaggctggccccgcctcacagcctttgcacaggctcttccctctgcctggaatggtattctcataggtatctgcctggttcttcccttgcctccttgaagccttcctcaaatgtcaccttctcagtgaggcctcctgggacccatctatttaatactgtcaccagccaccactcccaatccccacactactgacgtaacccctgacacccccactttttagtaatgtattttcctaaggcacttatcatatcaccttccaacaatctgcctaatttgcttaattcctatgttccttgtttattgtcccttctactaacgcataagctccacaaagacagggctctttgttctgttccctgatctgtcccaagttctcttctttgagcagaacctgacatatagtagatgctcaataaatgtttttgaatgaattttcccttcccagagcaagtagatcaaatacagcataacctccattttcagtctttcttgcctctgctcatcagataagtgaatttgtctttctccatcctacacataatatgttggtagaggcagggaaaacattcccccaacatttgccagttttagctgccctgaacatttgggccagatattcacagtataattagactatattctatagctacactgcatagtgcagcagcaaaataaactgattgcagagttcatttttatgtcacccagtgtatctgctttcagtatgtgtgacctggaaagcttctgtgtgatagatcccaaaagcaagagatcctattggcatttgctccctgtttactgtatgggtcaaaataaaaagttacgttctgggaaaggagacattcagctcctttatgaagggctttttgttttgtagtctggctttattatttatcccatatatctgtttcaatgcctcatcaccttagccttcctggtggccatgacatagcaattcaccacttagttttttcattctctcttctcccacccaatatcctttctccttacgcttgacaccacctacccacctccttcccagggtggtttttctccctttaggcagcttccttttaaccagcaattatataagatggaaaactggataatgtaataaaatatatgaggaaaacatattaaattagagtaggttaaatccagcatttctgaaaataaagtgtcattcattccctgagaaaaacaataatttaggatgcagtttcactgctacctaaatgcacatataaaatggatatccaaatacaccctactgttgtctgtcgaggataaaggatttcaaggccagtttgtctcactggagtttagtaattgaaccatatggcttatagattattgaatctagtgttacaagtctctgaaaaacaattttggcttgataaagagcaatggagcattaccgtactttcacatccaatgtccaccaattacagcaagtatgaaagaatgtaacttaaaagctataactggttttctcatcctaactgatcacgcacaccatacaaaatatttcaaaggcacaaaagcatgaaagttctccagtggaacttctgaagttttcagttgctcccaactaaaattattagatgaaatttagtaattttttttgctttaataattggaaaattttcctaagctgctagctaaagttatggtagagatggggagaggtggacagagagaggagggagaaggatgggtgagaaagagagaaaggtgaacacagaaggtaaggatgctactctggagatgactgccaggggtccagtacaagctcttccatttagtcactgcaagaccttggagaagcttccttcccagtgcaagtctcctttgttatcagcaaactggagatgataatagtgcttacctcctagggtggttgtaagtaagcattcaataaccctacttaatacacaaatattgcttaaactatgcatggcatgcagtgcctactctataaatgttagctttggatgttatcattgaaattcataaaagccaaatgttagctttctttctgtaaatataatggttgtgtgttacataggcatggacttattaagccagagtgaaggtggggggctaaattaagtcatctgtaaggctaacatggtagaaggtgtgggcatcctctacgctcaacccatggcatccacttcacctccaggaaggtaccagaagcccaaattgtagtaaactaaacacagcccaggccttggttaggggcccagtaggagcagagaagggaacagcagatgagcttggatgctccactgcaaacatgagtcctaagccaagcacacaagatcagaagtacacaatgtcagaggcaggacaaatggaaaagcaggggaaacaacacaggaagatctaggaaccccagtggcccagctgtagttcagaccacactagcatccccactgtgggaagagagaatgaaacccagggagccaggaagatggggggcatggactccctacaagtctaagaggcccagagaaacactcacattttatcaaccaaaggaagatacgagagagatttgacctggagctaaatacccacttcctaaattagaggaggggaggaggggtcttacccaccttcagatttgactctccttggccgaaataccaatgaggtgagcctacaatccactttcattattaaaggcagctggagaagttctcaaacagacaatgaagacagccatcatcagaaaagttagcaaagatggccaggcgcagtggctcatgcctataatcccagcactttgggaggctgaagcaggcagataacttgaggtcagaagttcgaaaccagcctggtcaacatggcaaaaccccatctctactaaaaatacaaaaaattgtctgggtgtggtggtacatgcctgtagtcccagctgcctgggagctgaggcacaagaatcgcccaaaccaaggaggcagaggttacagtgagccaagatcatgctacagcactccagcctgggcaacagagcaagacttcgtttcaaaaaaaaaaaaagaaaagaaaagttagcaaagactaattacacttttatttacatgtgtatttgcaggacttttgtaatgtttattggaaatttcagccatgaagttgttaaaaagttaatctggctattaagtatgaatcaacattcaatcttctgtaatacaaaattacatttatctttggttacaatcaagttttaagctttgcttaagccaatgatcagactagtccaagggtcaacaaactatcttctgcagaccacatttatcctgtcatctgcttttgtgaattaagctttattgggacacagccacatccaattgtttacatattatctgtggctgctttggggctatgcattagtctggactgtctctatctctagagagacagagttattaaaaggaactggcttatgtggttatggaggctgagaaatcccaagatctgcagttggcaagctggagacccagctgacctaatggcacaatatcagtcccaatccaaaggcctaagaataaggagagctaatggtgtaagctgcagtccaagtccaagtctcaaggtaggagaagaccaatgtcccagctcaaaaacagtcaggcagaaacagcaaattctcctttactctttttttttttttcctattcaggcttccagtgcgttgaatgaggcccatccacattagggagggcaggctgcttaactcggtctaccaattcaaatgttaatctcatccagaaacccctcacagagacacccagaagaatgtttaacgaaatatctgggcaccccatgacccagtcaagttgacacataaaattaatcatcacgagctacaaaggcagagttgaacagttgccatagaaatagaaactatatggccagcaaagcctaaaatgctacctggtcctttatgaaaaaatgtatgctgacctctgagctagtcaatagaagaataaatgggaacacaactagataaattctgtttctcttctgtcatatattaggagttcattcattcatttgaaagtatttcctgagcatctagaatgtgccttagcagaacagtgaagaaaacaagttcttacctcaagaagtttacactgtctagtgaggaaagatagatcaaaataaacacaaagatacggtacatagaaacatgccctttaaagcaatctaaatcagtgggcaaggaaaagagagacctgaattatgctgtctggatggtagaggcaggcctttggtaaggtgatgtttaggcacaggtgctgtacttactcccaaatcaatgcagtaaatcatgctttaatgtgagtatttttgactgaaggaacaaagtgcaaagatggtgagatgaaagcatgcttgatgtattcaaggaaaagcaacaagatcaatggactgtatccaggtgacagagagggagaggaaaaagagatgtatttaaagaaatggcaggtgccagatcaagttaggctgtgtagattatgataatgaatttggatttcattccatgtgaaatgggaggtcattggaaagtttatagaaaggagcgaaactgtctactcatgtttaggagcaatgactctggctatggtgtggaatacagcggcaagtactagaagccaggaaagcaataaaaagactgtcagtcagcttctcctaggttttgctgcaataagaagaaaccctaggatcacagtgatttacaaccacaacggtttacttctcacacaggttagatgtcagctgttgctctgattgctattgtttggaattcatgttgaaagaacaacccacatctatgatatcactggactcatgggagaagagaaagagaaatggctggacaacaacatgatgggtctttaagactctactcagcagcagcacatgtcattttcatacacaggcccttggccaaaataaaaccacggccaagcctatggtcaacagggtgtgtagacagaattctcccaaaggaagggggaagcaaatacgtgggaatggtgataaaatctaccacagcagtcactgcagtggtttttgtatcaggatgatagcagtggaggtgctgacacttgactgtactcgggacctattttggacaagattgctgatgaattgaaaggtgtgagagaaggagaggaggcgagaatggctctactgtatttatcctttacctgatacactagtgccaaatttatgaaataaacaaaatccagccctttttttccacacttagcatccacatccttgatgacctctattctcagttcttttgagggctttgctcttagctggctaagattattagctgcatggaagttactgcaatggttgggtattaataagctctagagtcagacaaatcttcctggggtttaatcttggattctcttctctatgacttaaggtaagtcagttaatatctctgcaccttagttgaatcaagaatagataaccatcatgagctgagtcctttgccttctcttgctgcatcttcacaacagatctgtgaagtgaggtttattgcactttatagattagcaaaccaatacacagaggcattaagtgattttcccaaggtcacacagcttgcaaatctcagaggcaaggattcaaaagtcggtttgaatccaaagcctatactcaaataaatcaaatatagcatttaaaatctggatgttgcttgccttttatagtgcttgctttttttgacagactcaactatcgtaaaagttaaactgattatgtatgaaagataatctgtgagttcatttctaagaaacagtaaaagtgattcttctcgctccatgcaggcaaatccttcttagaggatatatgcaaatgtagtacagaattagaaagccttacttatactctggggccagggaaatagctttcaggagtggatataaagaacgctatatattgaatggggaaggtagagacgatagcagaaaaggctcaggcataaagaataggagtggaaatccctatttaaaaggagaatatgaaaaaaataaatgtaactaaaaacaagtgtatgggaatatgcaacctcactactactgaaagtgatataattaaacaataaatgagactgcactttactaccagttaaataagaaaaacatttttaagaataatgcccaaaactggtgaatatgcattgaaatctggtcctgcatgcattactctgggcaatctaaagtgaaaagtaatttgaaatacatgagggactgtaagagtattcatattcttaaatcaagaattccccttctgagaattcattcccagaaaatcaatcaagatattagggaaaaaatgaagctgttctctgtagaattatttgaatgacagctctgaaaatgtagctgtccaacagttggggaatggttaaatcaattttaatacctttactttctagaattttgtacatatattgaaacttgtgacatatacatttttaaaaatgcagattgaaaattgaagtactgatacatgttacaacatggatgaactttgaaaccatgctaagtgaaaggtggtcggcacaaacaaccatatattgtatggttacatttatatgaaataattagaataggcaaatctatgaatacataaagtgatgaatgattgcctgggactaggtgtgtggggtggggtgcaggaatgaggagtgactgctagtgggtacatggtttctttttgaggcgataaaaatgttctaacttatattgggatggtgctcgcatgactctctgaatatactaaaaaccattgaactgtacactttcaatgggcagattatatctcaaaaaagtcacatctcaataacaaagctttttaaaaatacaagttgagtatatactgtaattaaaactaagctacataaatacatgagagacagactagaagtgaatataatgaaatgctaacaatggtttggttcagaaagtggatttgtgggtgaaaatttttgccttctcttactgtcccaaatgtttataatatgattagatttctttgattattaaaaaatagatacaattagcaaacaggagaatcctctcctttgcatttctctctcccctccaccaaaatccaatcttcttataactttccagaatcaagagtcagaattagcaccgtccagcagccctcaaaatcccttctagccatttcaggccattcgatacaattctctgaatggaaaagacaactatattaatagatttaatacctttcaagaatatacagatgaaaaattctggcatactgaatatacatgtgttctcatttttaggaagtgatagaagcaattgcggagtgtgcatttaagacttcaccttttccaattctcctttcgtttgagaaccatgtggattcgtaagtattcaacacattcaggaatgagtctttttcccgaatagggcatactgagtaattgtttatcagatttaagattatttgacatgattaatggtgttcttcaatcatgttgtatattaactggcatgttttcatttgtaggtgatggaattcacttaaaataatcaacattaaaattatccgttggacttgtaggatctattttcataccatagtatggtttttaaattaaaaactcttctttttgcaatgcagtggaacacatttttctacacaatacatgtctctgttatagatttggggtgctgtgggccacttttataacccttcttcattagctccttctattgcacacaatttgagtccacttcatcactttgtggcaggtggggggagagctgtgaattccattttaccaatttgcacttacacagaactcagttcagcaaatctccatattcccccttttcactggctttcccctgtttgttaatatttgtatttgccaatttcaaaatagcctgcatgtattgctgagctacacaaagaaaaggttattttgacttcactgttttatattcattttatcacacattaccaaagagagacacatttatatctaatagatgtatattagtttatcatgtagttactttaaagagcttcagaatgaaagattcttatccatattgaatgaaagcctctctttcatttcaggaacctaagccagatttttcaactaaaagccagcagcacctgtcctaatttggattacgagtttctttttaccctccttcctattgggagtctttcccaggtcactgagcctctttgtccaagtaatttgtaacatgtgcttcaattctctaattcttaaagagttcactagatcttaaagatgcagattggtcatgggcaaatttcaacttgaagaatttctaagtagttaaatgtgacaattttataattatctgtattttttcagtttgcccgccagaaatccatattatatttaccggcttgtggttctgcttcattatgcaacaatcatccaatgaatgatgtaatcctttggcacatagtttctccaacgcttctgagggtcaaaggaagagaaaggaatttattctgttccatgctatttctgttcttactcaaaggggcatctctagaagcagtatttaatacctagtttgctttgcaactaggttctgctttgcaattgactctgttaaacaatttctcatctctgtcaattcatttataattggcctgtaacaatacgtatgagtccattcttgtactgctataaagaaatgcctgggtaagagactgggtaatttatgaagaaaagaggtttaattggctcacagttccacaggctgtacaggaagcatggtggcatctgctcctggggagtcctcagagagctttttactcacgggaagacagagtgggagcaggtgtcttacatggcaggaggagaactaagagagagtggggaggtgtcacacacttttaaacaaccagatctcatgagaactcactatcgcaacaacagtaccaaggggaatggtgttacaccataagaaatctcccccatgatccaatcacctcccaccaggccccacttccaacatcgggggttacaatttgacatgagatttgggcagggatgcagattcaaaccatatcacaatacttgagcacttttctttcaggtattatagtttcgacttgaggatgctttttttttttttttttttttttttttctgaagcggagtttcactcttgttgcccaggctggagtgccatggcacaatcctggttcactgcaacctccatctcccgagttcaagcaattctcctgcctcagccttccgagtagctgggattacaggcatgcaccaccatgctcagctaattttgtatttttagtagacacggggattctccatgttggtcaggctagtctcgaactcccgacctcaggtgatccgcccacctcggcctcccaaagtgctgggattggcatacttatgttcttaaagagaagtttctatttaaattagacaaaatgaaaggctatggttccattctatattgtcacacctgctacactgagcttccccttggcatagccagaaaaatatcaaccgccaccaccaccaccaacataatagctaacctttattaatagcgaacatttattaaacattttttgtgccaagcagtttttgaaatattttacatgcctcagctcatgtaagccttaccacaaacccaggtgcttctaagagtaaatattatgattatcgccattttacagatgatggaactgagtcctaaagaggatgaataacttgctcaaggccatgtaactaaaacatgacagagatgggattccaatccagttagtgtggcttcaaaatgcacacttttaaccaacacatctcctacgcctaaacagaagcatcaggagccttcaaaacatcaaattcagacaacgagagcatccaccaggcaatggccagcaaatgtttgcctctgtggcttgtaacccttaaacacaagatgtgttttgcagttcttcacactagtcatttagagatcaaaaactggacatgaaaactaatttctgcactgtgcctaaaggcaaagagactagtgccattgtactgcccttatgggcttaaaaatgataaatttagctattaaaagttcattaataatttctatgtgacaaaagaaaacaggaaaacagcctttccaggatgccatgattgtgtcccaagccactgagataatgtaatggcagtgaaatactaaaagataaaattctattgtggaggaagtgggtgggagttgcttgcttcatatttcccttgtccttcagatatcaaaattgttcagccaccattctttcctgggaggctagcacacacccaaagaaaaccgataagctttcccttcgctggtaaaaccccgtgcttgacttgtgagccacttcatctagttcctgagcccatggtaggcagtagcagcactctttcccactaaccctagaaataacctcagaatccttctcaacacagtgacctcagactagaccagcaagacatctgacacctatttgccatctctgatgaactattttatttccctgtgtgctgcatgtatggaatttcagattcagaactctggtcccagctcacttgggccacacgtccaaaacaaatttatactagaaaaaaggagaaaaggacagggcacggtggctcacgcctgtaatcccagcactttgggaggccgagactggtggatcatgaggtcaggagatcgagaccatcctggccaacattgtgaaatccagtctctactacaaatacaaaacaggtgttatggcgggtgcctacagtcccagttactcaggaggctgaggcaggagaatcgcttgaacctgggaggcagaggctgcagtgagctgagatcacgccactgcactccagcctgggtgacagagtgagactttgtctcaaaaaaactaaattaattaaaaaagaaagaaaaaatgagaaaagccactgaaacttctggttttctctcccaatatctgaagtcacctatccatagacaataaaagggaatctgctattagctgctttcaatgtatcctgttgctacatcagaatcccatgaagtgtcttcaaaatgcagattcctgagctacacccttaccctgactgagaatttctagaaataagacttgaaaatatatttttaaaagccctacttgactctgacatcctacttgtgaactaacacttttataaaaagaattctacaccaaattcaatggaagtaatctttacccatgttcagccacagaaagctgtgaaattttgaacaaggttcttaatttccatggattgcagattcctcctttatagggaaagaggttggtttagttcaaactggaggatttgctcccaagaaatcaagtgagttcctcggtcagaaaaactgacctctgccccagacgctcacaccttgggagtattttattatgctcagaaatgtctgctatgacctgaagctcaaaatgcatttgtgattttttttccctctcactttgtccccatggtagctgatattgatgctctaaacacttcaggattttgttttttgctaattgcaattttaatgccttttatttctgcagttctgacctgcaattaaagttggtttgttttcctctgactttttcaattcaatttgctctctgctctgatttagttccatcaggtgggtgtgcatgtttattgagaacatgaatagcctgattaccaaatagctcattttactttttgctaggacacctacctcttgttctgtccatctcagttgattctgaggcaggttttgtttttgtttttgtttgtttgtttggtttgagggtctcactctgtcacccaggcaggagtgcagtggtgcaatctcggcttactgcaacctccacctcccagattcaagcgattctcctgcctcctaagtagctggtattacaggcacgcaccaccacaactggcaaacttttgcatttttagtagagacaggatttcaccatgttggccaggccgatctcgaactcctgacctcaggtgatctgcctgcctcggcatcccaaagggctgggattacagacgtgagccaccatacccagccctcaggcaggttctaaacgtctacattagacatagattcttgttcttaaaagtgtggtcctcagaccagcagcatctgcatcactggagagcaagttagagctgcagctgagtcctgtaccccaccctggactctgtgttggactcttcattttaataagaccccaggtaacgtgaatgaaatagaagagctaagctgtaaccaccatggtttattaaccacctgcatcagaattatctgcagtctggcttaaaatgcatgttccggggctttggtcccagctacatgaatcaggggactgtggacttgatcctgtcacctgcagcattaacagctcaggtgattccttagtggaattgagtgataatcatggctccagtaaaatctttatctgggcctgatttggggacttcctgacagaggacacctgtttggggatatttgggacatctcccttaaattcctctaatggaaagaatatggttccctggaaaatcctgagagcagggcattcaggtaaaatgccctgctttcactccaggtgtttgatcaaagataattcggggctcccaatttccaacagtcaggaaaaatgtcatctactttggcacatgctgacttaccttaatcaatcgcagtggttttcaagcttgaacacacaccagaatcaagagggcttgttatgatgcagactcctggactccactgtcccggagtctctgattcagaatctgcatttctaacaagctcctggtgtgattctgctgatggttcaggggccacacttggagaagtaaagctccatgatactgagtagcatctttctgtgaaagggaaatggagggtttggccatttctttagtgcactctggaacatgtcgtcccagcacaactgtacttcttatcagcagcagccacagagcaggctgacctggtagaacccctgtgcaagttatcactggaggaagaagacttgaacccagggatgcccggggctggccctaccaaatcagccacttctctgcctgctcccaaaggtctcatagacacagtttctaatgacttgtccttcagcaacgacctccaatgcttttcaggatcaattctctgattagcagtttttcttctctccctaatactgctgaggaatgtggcagtgtattctgatggccgcataagccatttagtaagctcccatacagaccaagagaggcctggtgagaaggggcacggttgctgtggaggactttgcaaatcctttgaatctctccttagcctctccctgcagttccaagaaagcagtgactttggggtttcatattcaaatgccagagaactcactttccacccaaagcacacacttggttttttaaaaagaaaaaaatgaatacaaaatagtgacttttcctgtggaccatttcaatatgatttgaaccgtcaataccaaccccctaaccccagtaaaaaaaaaaaaagcccatgatccaggcttaaacattcatggaaaagggaatgaaaataagaataagaatcacattttatgatcaatttgaattttcgtcaagaaggattttcatcgctgttacttattcttagtacagtcacagtcctgctaaaatgtattatcattgcagcatgtagagataactattggaaatcaagttcgacagactgtagatcaaattcaaaatccataaaacccaaaggaactggataactttgtaatgatatttaacattccacgaaatgagaaaaaaaattattgctttttgaaaggtcaagggaagcagtagcattgaaacaatatgaatgttcccctatatcagctgtgtttacaagttactgggcgtaggatttgtctagtctagctggcggacgccgccttgtaacagtggaatcatcttacatttgccctgctcttttaatgtttcaaaggcgtttgcatccattacttcatttcatcttctcagcaccctctgtccctttccaagaacggttattattctcctcattttatagacccagagtggttcagaccctgtcgctcagctcagcaaaccctgcagtgccagcctttttccattataccaggtccctactggcaatatattcagaatgataccacctttgctattctgttatgtatatatgagttgcacacacctttccccaaggtgcctgctacttttatctttcctccaggaccccctccccaagtggacacactgtttgcctgtctgcccttttctacattttgagattctctccctctctttttctctctccgttgtctctctttccctattcagctccctccctgccatccttccttatctatcctctttcatctcctcataaacactcctttgcagcagtggtttacaaatttcacttgataatttacatggaaatatgaaagggttctttctccaagtgtcttgcaattgacttggaatcagcgagttaaacaaaagggactgagcctctaactctgggaatttcaaggctccagttacagcaaatgacatgctgtcccctccacctatgtctatgcaggtctgccttgggaaccacctcacacatcagtgccttcgctgtccatctgtgtatgttattcaaattcacataagttaagataaagatccaggatgataaaaaccaatcctgatgggtgggattagagaattacttctttctgtagttaataacacaaagcaatcctgttcaggttctttggataagcctccctactttccttcttctgttcttgttctcccttagcccaaagcagcaagccaagatggcggagtactgccgactgatctttggggatgcccttctcatggagcccctggaaaaatatccagtaagcagttctgatgtttgtccttgaaggaatgtatgcattattgatgaatgaggttgagggaaaacttacttccttttcatatttatgtttcttggtaagattaatgcagttggtgatgaaatctttgacaaggaggataccagcaatgggccccactaagggtagaggaatgcctctgcactcttcctcttcccacactcttctctctcgctggctgcctgatgaaactcaatcaagagtgcagatttcccaacaattacaatcagcccatagagacagtccaagaggacaggcctctgctcactcccagggaacctcgtcacacctctttgagatgaatggattggcaaaacaggacactgcaggtggcacaatgtcttcttggcctgtccctgctggctgttctctatttccttggatgcaccttttggtgtggcacaactcaggtcgcccattgcattgatgatatctctgctttgggaaggaaagcagcagaaatatcctaaagtagcattttccttcccgcacccttttgcccaatctccatgcatttgtaagtgagtttataccagtccctccgctcattgcaagccaagaatagaggactaacttaggcattctatagattttcttaaagtaacctatcttgtggcttgcacacatgctctctgatacaatatctaatgaccccctcatgggaaattgattttcccgttagatgtacaaacttgaaacagtcaaaataaggcttgcaaatgtggtagcttgaatcttagggctgggaggaaatctgaagccacctcatccacttctgttgatgccagggacgtgcagctaaactacctagtaccaggatggggattttgctgattttaaggggcatctgaaaaaatgatttcatgggctcacctggaagcttctgcccgtctttaccaactcctcctggcagatgcctggcttccctccttcaaaaattcaggccagggccttcttatctgtcctaaatcaagatgattgggtttctatgttccattggaaaattcataaatgttcagatttagtacatcaaatctaccagtacatttctatggtcttcttcatgtagaatatgttgaaaaaaaaagtatagtaatgaaaatatatctttgatataaaaaaaaattagctcccatgtaagatacactaagagtttaatgagcagtgttgaaggtagggaagaagtctagacatttggtatccacagctgatctgggggtctggggaggggatctgaaagagggagcagtatttttaaagaatatgcctttcatttctattagctggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggtgaggggctggtgggctctccccgtcatgttttgtgttggtttaagaattgctgctctgggctgtgcgtggtggctcatgcctgtaatactactacttttggaggctgaggcaggtggattatgaggtcaggagttcgagaccatcctggccaacatggtgaaaccccgtgtctttggtggccaacatggtgaaatcctgtctcttgcaaaaatacaaaaattatctgggcatagtggcacgtacctgtagtcccagctactcgggaggctgaggcaggagaatcgcttgaacctaggaggcagatgttgcagtaagacaagatccagccactgcactccagcctggtgacagagtgagactccgtctcaaaaaaaaaagaatttgctgctctgaaattagcttagaaggactttgaacattcctatttctgcacagttttgaactactggttttctcttgctgctacaaacttagcggcttaaaccagcacaaatgtattatcctctagtcctgtaagtcaggaagccccctgggtttcactgggctacactccaggtgtcagccgggctgtgttccttcctggaggcgctaagggagaagctgtttccttgctttttccagcttctagaggccacccacattcgttggcttggggctccttccagcttcaaagccagcaaggctgcatttcactaacctttctcctgtggtcacatctccctctgaccacaggcaggaaatgtcctctgctggcaagaactcaagtcattacattggatccatccagataatccaggataattgctcccatgtcaaggtctttaactccatctcacctgcaatgtcccttttatcatgcaagctaacatattcatggagcagagacatctctgggaggtcattattctggctaccatgtaagccaaatagtcttcagagtgaccatatgactttaagcttcataatgggaaatattaactatagaactgagcactggatgcattgtcattgatgatatgctgaagagttctgggcatttcaattttttcatgttttaaagaactttttaaaatctgtgacatggcaaaattacttaaattatcttttgaagctcctagaggatgcctaatatcatttcttttccttttaaattaagggtgaaatagattgctgtggttgatgagaaaagaattcagtggcactcatttccttgggattatttgtcatttagtctgatttatcttccaagttcagtcagaagcttggcaatctgaaaatcgcattatagacatctcctgattgcagggtgattaagtggaagaaacttttaagcttgactgtaggaagtttttcagttataagttaaacataggaacaatcaattggaaaactacttagcagtgtctacaaaagctgaatatatgcactccctgtacctcgggagttccattcctaggtatatgcttgctaaagatgtgtatttaggtttaccaagagacacgtacaagaattgcttaaagcagaggtattcagaatagccaaatactggacaccaaatactcgtcaacagataaatgaattatggtatattcacacaaagaaagaatatgcagccatgagaataatctataactaaatgaaaactatggatgaatcactataaataaacataatattgagcaaaggaagtcaggtacacaaaaactacatactgtatgatttaacctatataacacacaaaaacaggcaaaactaatttatgctatttattagaagtcaggataatgggttcccttggaagaaaagcaaccagcagggagcccaagagccttctagagattggttatattttgtttcttgatctggatatcatttactcagacacgtttatttggtgaaaattctttgcactgtggacttacgacgtgtacttttctgtacgcctgttatacatcagttataagattttaaaataattaaaatataaactctaggacaatcagggttaaaaaaaagtagcctgagactctgatttatcttttcttctatttttctgtctcaattgcctgtttttttattgtttcgattaaaatctttatcaacagacgttatataattctttgaaagggttttgtcctgtagcttttgaatgtgtactttcatcattattgtgcatgtctttcaacattttttcaaaaataatttctgtactcagtaaaaatgttctctttgaagtttggaagtgagtatcattaacaggcctttcattcacacctatttcctaacacaactctatccgttgaatgatagcaagcaaaccttgtcttcctttgcatgtgggtgcttgtgttttttaccatctgcctttcccactaccagttctctgcctcttattaacaggatgcataacacaaatgacgatttttacaggcagtgaacattattgcttaatatagagaaagggcaacaatctgttagttattcagtagatttcctaagctagccctgttgtctattatgcaatcagtggaaacttttggacattttaatatgtaggtacctgaataaagagcaccgctaatttaccatttggttcgtagatgttcacagtactgggaactcaagtaacttgaaaaacgtgacaggtattgtatttcaaagctagtttacttatcatggcccctgttggccagatgcctcttgcaggattcagccctttgctagtagacttgtcctaaggaactagggtaacctaagatattttttatagttcaacaagattcccccaacatccctccaaagatttacaggagaaaaatcaggtttctgctttttacagtaaagaaagacaaattctttctttcccacagacactaaagaatgacctgattggctatttgaaatgactgcgaattgttgggtcccatgaagtattttatagaaagctctgccaaacaattttttaattatttaattaaaagaatcccctctctgattttttttttttaaaaaaaaaaggtaataagaacttgggacaaaaatttcattataaaaatgcttaagtggcaataccctaaaagaatgtgtctctaatattgtagtaagatacgttttctatccaaaatataatcgattcaccttattaactaacacaatatcagcattataaagtggttgtatgtggctttccttaataaacaatccaatacataaaaacccttgctggtcccagaaatcttttttcccctggagatttttaagcaatacttttttcactactgtcattcagtaattgaactgtgtcagccaaatgaaaacttttataagcttctcagaggacagtgcagtggtactgtctccatttatataaatcgagtagggcagctaactttcagaaggctggcagtgggcaggggtgcaagttacttcattgttgaaccattattgccatctattgggctcatcgtgctattgcattgtgtgagccctgaaagatagtagttaaatcaatttagaactttcgaaccatttagaacaacctcgctgactttttacttgaaaatcttttttatataacggatatttctgggtctgactgaagcccatagctatggaagaatgtaatgcttcatactgatatgaatatttaacctagcagaaatgtccattaattcttcaggggaaaaacaattcatttaaatgagtgtatattggctacatatgaagctgaattatttctgatggagttagatttccaatcatgctgatatttaaggacttacccatgttatcctgccctcttaaaaataatatcagcattttctacgatatgcacttcgttgtgatgacaatacatccatcaaataagcttgcagacaaatcataggataaagttggcccttcacgatttttatgtagtgactttgctgccaaagccccagagttcctgccccagctcctaacttctttgacttctgcaaggtcctctctggccttgggaaaaatgtcaacacaagatcactgagctatgtgctggccacgcattgcatggaagagtcgcggcttgggaaaggagggaaagatgaaggagggatagatagtatatctgttttcggggtcatagagaccctgagagagtgtttgtatatcaaaatagaatacatgtaccatagaaagcaaactgtattaaatgccagcaaactgttttcaatgccacgtgtttaaaaacatatagagaaaaaatattgacacgcattttttaatagaattttgaaattttaagtgctatttattaacaaatccagtttaggaaaaaatctatattcaaaatgtcagtataattttctataacgaataaaatttaaatccttgaaaaaaataattttaaacagcccaacttccaaggaaatctgtaattgattttaggtaaaatatgtgttacaaatgctgtaaagctaaatgttgaaatggtgacatgatgatctgttattaaaatttgacaggagaagctgatacggaaagtgacgacgacgatgatgatgatgactgtaaaaaatcttcaatggatgaggtgggtacttagggcttctggtccctaaggcattccaccaccctgtactctcctgggtctgtctcatggtcactttctgccatctagtggcaaaaagtagatttgtgccttccaattgccagcttcaatttttgaggcaattaaatggcttatgaaatgttccacaatccggagaagatatggcgtttagaaaaatgatcagaactgtgacattcattgcattgttttaattttggaacactagagctacctatttatataaacttaggcatcccgagtaacttgattagctcaaaaatattaattgcacagaacctagaagagaatcagaagcagatcaactggaattttagaattttgtcttaccaaaagtttatactgaaacaatctgggcaacagagagagacctcacgcctttaaaaaaacaagttaaaatgaaagataaaacacatccaggtgcagtggtgtacacctgtagttccagctactagggaggctgaggcaggaggatggcttgagtccaaaaatttgaagctgcagtgagctatgatcacaccactgtgctccagcttagaaaacagagcaagacactgtctctctttaaaaatacgtattttaaagtttatattgaatctgctttcaaatttgttagatatgttctgtctcaacgcttgtagctctacaatttagtaaaaatgaaacaaaaaataagctgctcttacttgatgtccttcctcttagaattattttttaatgtctaaagttttgcttaattatgttccctcactacatttcaatttttgatttccaggaggaaaacagcttaccatgtctggcaaagtatatgttcctgagaatgatttcaattgtgtataatttctgatcagtgattctaaataatttttaaactctcttactaattggatagtccatttgcaaatgaatgtttcccagttaacatttgacccaaatattactaccagaatttttaaaagaaactcatctccatgcattctctcttctaaaaatgtgagacaatattagatcactctacagaggcccattttgtgccaacactgcattattggttttctttttcattaaaaactctatcaaagtaatatgtcatagctaataatagcaaaagcaacatgagattgtagtaccacttgccaggcactgttctaagctccttcacataaattaacttattttttaatcaaaaacccctatatgctgtaggaactgattttatcctaattttacaaatgagtcaagtgaggcacagagcaattaagtaagttgcccaaggttgcccggtttctaactagtggacttgggattcgaaatcaggcaggctggctctagaacgcgagccattaatccctgcactatgctttcctgcttgtctaagacacatcaggagccaagaagggagggagggaagaatgttgatgaaggaaagcagttgtttacccacccctgcccatttccacaaagcaatctttttattattattatcaattttcccttcatttggtggtcacctacctaacaattttcttattgtacagtgaattcttaatttacgaatccgatgagaacacatggacacataaagggacatggggcctacctgcgggtggaggtgggaggagggagaggatcaggaaaaataactaatggatgccaggcttaatacccgggtgacaaaataatctgcacaacaaaccccagtgacataagtttatttatataaaaaaaaaaacctgcacgtgtagccctgaatttaaaataaatgttaaaaaaaattactaaccttagacaacacctatggacaccctgcaatggaagatgagctatagctcagtgcttctcaaactttgatgggcattccaatgaccttagtaaaatgcaggatctgagtctgaggcctgcagaggggctaagatcaggcatttctaaatggaaaggagggggcaggggatagggagtgattatgttggggccatgctgccagccaccattcaacctcccacctcccttcctccctcccttttataaaatgaggtgttgctgttgcctttctcctgtaatgaattttcattttgtaattttcagaaagggagggatgattttctgcatgcttgaatcatgttgtcattttcctgggaaaataactgataatataatgctgactctggaaatgttttcttttttattcctacttccaggggactgctggaagtgaggctatggccacagaagaaatgtctaatctggtgaactatattcagccagtcaagtttgagtcatttgaaatttcaaaaagtaagttttccctggagaaaaacccctcttgcagcatataatgattatattttaaatacggagtaatgggaccaaagaatgttacccttaatagagagatttatgcttttgaagtcttaaatatatgtacattttgactgccttgttactttacacatataataaatatgcatgtattgtaatatataaaaataaccatatgagaaagtattctatggtgttctccaaaaatatttaatagggctacaggccatacatggctatcggaaagacacatgaccagagtacaactaattgggaattgtactttgctttttgttcgcaacacacagtgagatccatctgttacataagtgataatgttgaaataaactatctacctgtttcccagaagggaagcaggcagagacttgatgaaccctgataattagaaatagaaccaatttatctatattccatttgtccatcacatgtatatatttagaagaaaatgcattaacttcacatcactttgtgttttccctttattcaactatacatccatacttgtgcaaagaaaaatatcatctttacccagacaaaagggttcttttatgaaaatgccccttgtatttgcatgaagcgtaagatgctatcagattaagggaatccttgaaacttactagccacttataagggtgtacccttaaaaacagaaatttgcctaaatgtactagcttctaatcaaggatggctttgcagctatatcaaaatccaagcctctaccaaacacgcttgtttatatttgtataatcttacaaaaagtcttcacttagtggtatatgcaacctagatctctacaacaaagaattcaacttccaagagtttatatataatgatttctcaacattgaattcgatgtcctaatttctgatgtttcttacaagttgttttctttgaaacatcctagcgtagttatttttatatcactgtaatttcattggctgcaatgagtttctctaactcattagttaaaagttccaagacaagtagccaagtgtgagaaagagccaatatatttagattcttcagaacctggaaacaacagcaccagctagactcacaaacaagcacttttctccttgtgtttaatatcattttataaccttgaaaaaagaatattcaacatattttaccaagtacctattaatgttgactgaattttaattaatagttatgcttaatttaataagtcatataaaggtagatttatgatggaccaaaataagagaagccaaggtttgccttagagtggattggagaaggtgagaagatggatgacgaagcctggaaatcattaagaagaacgaggttttaatttcgaaagagaggtcaaagagggaaaatatctcaaagataactcagtttaaaaaaattcagagctatataaccaccctgtgctatacttatctaaaatactgctcataattgttggtttttagtggggatgagggtagagaaagtgattctcggtctttctaaactaagataactttgttttctttctctcactctaattggaggcttgaatttcactttcaaaatgtttctcttgtgtttagcacatcctcctctctggcctctattttattttatactttattagtccattctcgtgctgctatgaagaaatatccgagactgggtaatttgtaaagaaaagaggtttagttgactcacagttctgcatggctggggagacctcaggaaacaacaatcatgaggcggaaggcacctcttcacagggcagcaggagagagaatgagtacaggcaagggaaatgccagatgcttataaaaccatcagctctcatgagactaatgcattatcatgagaacaacacaggggaaccacgcccataattcaattacccccacttggtaacccccccttgacactgtgggtattacaattcaaggagattttgtgtggggacacacccaagccatatcatgtatctaatatgaaaatgaagccatgagactggaaaatttccaaggacctttctgttttgaaagaccataattctgtcatattagttatttgaaccaaaaaagtatatacaaactgataaggtggcaatgtgggtatgaaagagatagtcagcacctagcacaaacattcccatggtctcttttgttaaaccccatattggccctaagaaaaaaatctgggtgaatttagaacaaaagattcccacggggtccctgctcttttgacaaatttttttattgccacactatactcatctagaattcattcatgtccctaaattacaaaagcataagtagctctgacccaagtagcaaacgttagaaaagacaactaacaagactcaacttttgttacaggtaaatagtgcactagaaaaaaaaattaaatattgaaattacattgaggattatttgccctcaacttcactgaatatttacccatttcttttataatgttataatttataacaatgaattgtatttctcaccttccccttttttgttttgttgttgcttaactcagaaagaaataaaagttttgaaatgtcttccttcgtggaaaccaaaggacttgaacaactcaccaagtctccagtggaatttgtagagtatccttgatttgacgaatgactgcagaatgaacacagctgaagtcttgtgctatttgttcatttggttttttaataaggagaaagatgcataaaatggcttaagtatatagcctggggcggataaatagtttcaggtatcatatacaatgctgggcggggtagtctggcctatagaacaaaaaactggtcttggaataaaggaagcgtagatttcaaggttgccttcacaccaccaagctctgtgtctttaggcaatttgcttaatcctgactttccttgtctataaagcagaaataattatactagctttatggtttgctctttggattaggtacaacatatgtaacatgagtgtgcatactttacacatatataagatatatgtaaagaaatatatacctgacttggcatctcacatacttatatgtactatatgtccaaatagtagggatgatgatgatgacattgtaaatataaatatacattactaagactggatttattgatattactgacaacaaaaatttttgctactatccatgaactaaaataaagtgaaacaggctattaaatttctttcataaaattaacagtaaatatcacaaagtgctcaatttcatgtaataagtcccagaataaagttaacctttaaaattcatcagtggaagaagaaacaaatgttgactccataaataaagtcctgctagaaaattatcatcgttagtattccttattgactgtgtgatagatcttgtcttatctcatttaatcctcacaatagtcctatgacatagaaattgttaaatctattttatagatgaggagactgagtcacagaaagacaaaataatttgtccaaggttattcagctagcaagtttgagagttgaggttcaatttcattttgcctagctcagaaccctaaccaaccttcacctaacttggtgataggaactagtcagtcatgttttaaagacatagcatggtccaacaactacaagattcttaggatagaaaactgataatgataggaaccaaaatattaagcaagatcagaaacttccatggtacattgaccttgctatcaattataaagagtaccacagtcttggcaaatagcattcccagagaaaattaataaaaattagcagacagcatttcaaaaatagctatacagtgcatattatctacttctgccaaacacaatatcattctttcaaatgatttaacacattccagcctccttgtgtgtccttagtcattaagtctgtccttaatactctccacaaaatcacattgactttggctcagccactttttgctaccccattgacttttacccacggggctctgcaaaggtgatgctatgcctatgtgataagagcatacttattctgtttgtttagaaagctttttgcatatttgatattactgacaacaaaaatttttgctattatgcatgaagtgaaataaaatgaaacagcctatttaatttctttcataaaattaacactaaatatcccaaagtagcccaacgagatcatcaatatttacttcattttccaaatggagaaagatggaaggtagcttcttagttactattattgactaaatatttttataattgtattcactacttaacatgatggtccagatataacaaaatgcagcttagcaggatatatccaaaaggaacacgtgtggattcatccaactatatgcctcagctcttctggaatgcaggttgtcagatggtggcacttaatttccagacaatgggtaagtacatgcttgttcccattctgctatgaactcacattgccaagtgtccaaaaaccattcttacataattgggggagagaaaattgccagacttcactgaaaaaataaataaaagcaaatttcaatgaagggaatatcaatgcataaaaaaagtgaattttgaaaatcgagacatgttcttcaattattctgtaaatggatctttatttctacaggctttgcattatttttcaaacaaaaatttttatgctttttaagataatacatatttattttgaaaataatggaaaattcagtaagtattttaaaaacaaactgccaggaatgctaccaactcagagattccacagtgttgacttttagctttgtaatctatgtcttttttgtctacatataaatgctttttttatgtaactactcatttaaaataaatacatatatattcatatatacatatataaacacacactcacctaagtgccatagagagacatgaatttcaatagctgcatactaagcatatttcacaattcgctaaaaacttatttctattccctaaatttcttttggaaaatattttaaaaacagaattactaacgttaaaagatgtgaacagtttaagtacctttatgaatattgccaaattgtctgtaaaaaatgttgtgctacattactccgctgtcagcaatgtttaatatgacgtggcctctcatttgcgatcttggttaagtattatcgttaaataataataataattaaaccagacaaaaatgtgttatttcactgttattttaaattcatttcttgaatcattattaaggttgaactttttaaaatatgtttcttggtttttgtatttctgcttttatgaattacatattcaggactatcgtcaattttcttgttgatttataacagcactttttatttaaagggtatattgtcttttgtgaaacagagacaattcagtggatcaggtcaggctgattaatgtttaattaaaagttcttggtttacttgtatgattacagcctcctcaccccaggatgaaagccttgtgctcccatttttctcatggtttcttttttatttaaccttttcaaccatcaaaatttaattttggtccatagtctcagtgagatcaatccttttttttcatcctaaacaatcatcccactgaactggaattacacgttaatagatacagcctttttcattgttgttgttaattcagacccattttttcactttgtatcttttccattaataaatttgtctgccttcctggatgcaataactcactgtttttactgtattttataatatggattaatacctggaagtggtgattctcctttactactattaattttcaattccttttttgccattgccagtggaattcttatttcaaataaacttaatttaactgtattatgttttccttgactactaaaaaaaaactatttttaaaatcatattaactttataaatttatctgacaaaaactgacacctttttaatttttagtttttctgtcacaggaaaaatgcttttctctttactttaaaattttttgtattaagtcctcagcaaaatcacttgtcttcattagaggtctagttttcttagactgaatctttctttttatttatattatatttttaacagattgtttctggatatttatatttgtatatttgtttattttataaatgattgtattttacaaatgatcatctttctaaactcttataatagcctattttttgcagtacattccgttggaatttttagacacacaaagacagtaatttaatcatatctcatttctccacctgccttatttattgctttggccttaccgttctcaggtattaaatgagggttccgagtgggcatctttcttttttattcagtaggaagttcaacattatgccttttattaagtatctatcaagctctaagccacgattaagagtaatttgctagatatttatggctttttaaaatcaattaatttatttttattgatacataatagctgtacaaacgtttgcagtacgtatgataatttaatacatttatataatcaaatcagagtaattgggatatccatcacctgaaatatttatctttacattagaaacaatcgaattgctgtcttctagctatttttaaatgtacaaactattaatgttaactatagtcacctccttgtctatcaaacaccaggtcttaacgtcttctatctaagtgaagagtgggcatctttctcttcatcctgatcctaatataagtttcactgttgtgatatcatcaagtcagatattggctgtgactttgagtcagatattctttaacatactaaaggacacgggtcctatttgactaatgttttagaagttggtattgaatgttattaaatgtctcttggacatccattgggatgatcatatgttcatttttcagacataaatgtgataagttatcttaatagatctcatttcctaatatataattatccttttgttcccaaaataggctctacttatttgttgtgtattatttttagaacatatgacttgctaatgtaatttttaggcttttgaagctaattttttcaagtgtcataaattcattattgttttgaaattttgtccaattttgacatcatagttatgtttataaaataatagtttaataagagaaaatttcactgatttttttctgctctaaaaatgatttgttaaatgaaactttagaataattctgccatcacctctttattatgcacatagagatgagtcatgacacagataatctggaactgttgacaacttcccagattctttacaactttaatatgtattctttcactctatcagttgcaatatgtgtgaacgttcatctgatgcactgagtctgaggaaaattttgaccagtaacctttgtccactggaaaagagtctatgtagaattagatgttaattgtaagtaatcacagaagtgcaaattataaaaaagaaattttttgtacaaattaaaaagcaggaaaaggaataatagaatcctcttttaatgaggcatggagaagtccattctcaaaaacatggcttagtagtataagctggtttaagctttctgaagggcattttagcaaggcatcaaagaaaaattttccaatgaggacatcatttgtcccaggaattcctctcataagaaaatcactgatcatggcttcaaagatttcaccacaatgatgtttatcaaaacattataagggtgaaaaattagaaaaaacataaatgtgcccaaaaggggaatggttaaatacattatattctaatatattgtattagatattatattctaatatattgtattagatattatattctaatatattgtattagatagtgtatcatattagaaattagatattagaattagaaattagaaattagatattagatattgtatcataatattctaatatatgctttatatattagaatgatatatttaatatatcattctaatatatctaatatatattagaatgatatatttaatacattagatattagatatattagaataatataaataatatatctaatatatgttagatattagatattttgtatatactatatttatatataattatatattatatattagatatattatattatattaatatttaacatatattatacaaatatattattctaatatatttaatcaaaggaatttgagacagctgttataattaaggcagatacatattaaatgaaatcaatatactgtatgtcaacaatatatttgaagtggaaaagcagactgcacacccaccagttggcagtgattatttctggacttggggattagaggtaatttttttcttatctgtgtttcctgcatttctacaatgactctcttccaagggaatacagtcacaaaagtggactgggatcaactttactttacaatcttactttcttaccccaagtatagataaactcacaataaggcttgtgtttttgatactcagacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaaggtaggtataccccatcacaaaattgttcctaacaatagtgttgaatttatctacattgcataaagaagtggcttagtcattaaaaatttagtaactaggaaagattctactttcttcctacattttttttctctaaagatcaaatacacattaaaagttttcgtaaggggtccgtgtgttctcattgttcaattcccatctatgaatgcacacgggaaggggaacatcacactctggggactgttgtggggtggggggagcggggagggatagcattaggagatacacctaatgctaaatgacgagttaatgggtgcagcacaccagcatggcacatgtatacatatgtaactaacctgcacattgtgcgcatgtaccctaaaacttaaagtataataataataataataataataataataataataataataaaagttttggtagggtcgggcgcagtgactcacgcctgtaatcccagcactttgggaggccgaggcaggtggatcacgaggtcaggagatcgagaccatcctggctaacacggtgaaaccccgtctctactaaaaaatacaaaaaaaaacaattagccgggcgtggtggcgggcgcctgtagtgccagctactcaagaggctgagacaggagaatggcgtgaacctgggaggtggagcttgcagagagcccagatcgcgccactgcactccagcctgggcgacagagcgagagagcgagactctgtctcaaaaaaaaaaaaaaaaaaaaaaaaagttttcataggccacatgaataagataaagcgactgaactttattcttaatgataaaaatctgactctaaatcaataaaatgagttggagagactcatcataagcaaacctcttttttggtgtaactaacctactatgaaatttacatgataattagtggcccatattggagagattttccggtctttttttccccgtttggttcttagaaaattagagacagaacattccctcaataaattatcaaatgttaaacaaaagctttcaaattactttaaatggtttttgaaaatcttccagagtattcagagattttaaaacacatattaatgatcattaaataaaagagttgctttattaaatatatatgtatatatacatgtatgtcataaatatataaaaatcatagatatatacacatacatatgtatatctgaccctaaacaattctaaatttttttagtctttgaaattgattttatatcagatataattttttagctaccagaaaatatttttaatactatgaaaggaaaatcaattttttagaatacattttacatggattcttcatcgttaaagcttttcaaaaatattgtctgttttctgtttaactgaataactatagaactaagaaatttttttactggacataaatgtaattttttgattaaccttaaacaaaggcatttgaaaaactatgtaaaaagctttctataacagcttcactaatttctttctaccctaagcagttgagcacatttttaccttaaaactttcgtcactttatatcaagggtttaaagaataaaatttcagtgaagtgtctcataattatatcttttgaaattacttcaagccacatgtataaagagttcaagttggcagaattagagtttattttaggaaagtattttcagaaaaggctgtttaattcctgtcaggtgtgataaagataaactcataagctccatgtactgatagaatgctacttttagaatccttgtcaattgttgttatagttcggttgaattaataatatttttgctttgcttgcagattcgtcttgttttgaatgtatttgtttgcttatttctttttttgtcttgaaaatcctactgtgacagtaagcaattataaaacaatgacacagaggcaggaaagtacattgagttgtgaaggggaaatagttgatccccagacaagtgtaacctgctgctcctgtccagaatggagacgctgctccagagctgtcagtctcccctgaatggacagttctcactgcagtagagtcctacctttgacattatagctagagccaagatacagatcataactttccaattatgcctttgttttcatcttctggcatagattttataatgccagaatggacttgtgagctcacatgatgttctaccgtcctatgttactgacgagagcattgtggttttggtgtcatgaatttagtttaggactctgctttggtcaaacatcttaaacatacaacatcttctgtgcatctgaattccaagtaggacttgcataacttagaagtttcaaacatgttttgaaatgcttgcttatttcatagacatagttctcacatagaacctcaagttaaacaaagagattgttgctagcaggtcccatgcactcaagccaaatagaacatacaggggaaatgagttgtcccagggcaaattcagagagccttcctgatgactttctctctgaattactcagaatttctgacaacatcagcatatagctgactttgactttactcagcctttgatagctattctcatgccaccattttgtctgatttctggcccagccataattctgtcccctttcacaatcttgagctcagattgtgagcccagccataatgctgtccccttttcacaatctggagctcagaaagttcttgaccagcaggcaattttcttgtaaccacataacccagattcaccaggtttgctctgtcagcacttgcttcctgctttccccttcctggtatacagcagaagcacatcttgtttgcctccgctaacctttatgacagctggtggatagttcagattttgaaaatttgcatagaaacagaggcagacatggaagacatttataaatacgtaatattaaaaatctcttttaagtctataatatccattagttctgtagctagacaaagatggtgacaccttgtgagattaggggtaatgataaacttatcttgatggtttaaagtgaatacttgttcatttattcctcctacaatactgtgtcttattaattgactacttctaacctcaccattttcaatatccttctaccaacctgtgtttgtccattttcacactgctataaagaactacctgaaactgagcaatttataaagaaaagaggtttaattgactcacagttctgcatggctgaggaggcctcatgaaacttacaattatggtggaaagtgaaggggaagcaaagcacacctcacatgaagggagaagagagagagtgaggggggaactgccacacacttattaaaccatcagatcttgtgagaactcactatcatgagaacagcatgagagaaaccactcccataatccaatcaccctccccaaatatgtgaggattacaattcaacatgagatttgggtgaggacatagaaccaaaccatatcataacccattaagtgaaagggaaatcatatttctactcttgcttctattccattttgcttataattcaacatttgctgaagagcatttgtggctctttaaagtattctcttatgtctttgttatttgcatatcaaaattccttatggattgattgatttattgattttctagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggttggtcacatgttcttgatatgagttataactgcatttttcaggtgttttacactgagaaaataatgaaatggtgaattatttgttatttaatttgaaaatttacacacttataaagcaattaccttttgaaagccattctgaaaacccttcaagaattctgttaatcactggtttggattttcagaattgtattgtaaatcaattcattctagtatgcctcaaatggacggccataaaaacatatacatttaactcatatcatctgatagtacaaatgataaatgatacattttaattataactcaaagaagtagagtggaagtagggaataatatagtggctgagataaagaaaattcatatttcctttaaaaggaatattatttaaattccccaaaatctctagcctctgagagctggtcattcaatcttgtctgggttctatctaataaagttgaaacctttcacactcaactgggcccttctctttcttcaccaaaaagcaaatcttcacacatgcttatcatgtaaaggaagaaagtaggttcagtgggaagtagactttttagcctactctttgcttttttctggccaaaatatctacaaatccagtcttctgcaaagagaatagctatgcggaaactctctgtgctctgggatttttccatatgttaactgagtttaataataatgcttactatactgtttacttcttacagttattatgaatattccataagtaaatacattgaccacacttaagaaatatctagcacaatgaaaatattcaataaatgtgagtttgctgtttttgtaaacaatacatttttaaagagatagtcgacttcatgttcttgacataagatataactgcatattttagatgtttcacactgaggaaagaaatgagtagttgctctttgcttactgtgggaatttacaaatttataaagcaattgtattttgaaagctgtcctgaaagttattcttgtttttcagtggtggttgttttcactttttttgctttcactttgaagatgcaaaagtcatttgctttgaaaacataaacgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcttagtgggtgcagcgtaccagcatggcacatgtatgcatatgtaactaacctgcacattgtgcacatgtacccaaaaacttaaaagtataataataataataaaaattaaaacacaaattaaaaaaaaagaaaacataaatgaaatattcacatggtgataaaaccactaaactctttttgttgaaagatagaacttttgtcatttccacattgagaatgttcatgtaaaaataaaacagcctatttttttaacaaatgcctcattaaggcaaggtgataaaacatagatgaagccctatctctggcaacccatgtcttctcctctgaaaatgaaatttatagggcaacatctcaactttttgtctaaagtagctaagtagaaacttctagttggatctgaaaagctggtcctggccaggcgcagtggctcatgcctctaatccgagcactttgggaggccaaggtggtggatcacctgaggtcgggagttcgagaccagcctgaccaatatggtgaaatgctgtctctactaaaaaagtacaaaaattagtcaggtgtgggggcatgcacctgtagtcccagctacttggaaggctgagacaggagaatggcttgaacccagaggcggaggttgcagtgagccaagatcacgccactgcacttcagcctgggtgacacagcaagactctatctcaaaaaaagaaagagaaaagaaaagctagtcctgattgaataatacctttctaattatttcttggaattgttcattcttataaccaggtgtgtccttaatgtcctttgtaggtggttcttcctactctggcctgtttgagaatagcagtttatgaagaaggaggtaaattcattggccaccgtatcttgccagtgcaagccattcggccaggtatgggtagtgtgctgagaaaccttttatcaaagttgcaaagaaaatcattactgcttaaaatattactagaaaatgacttaagaaactattttctgctttgtaattttgttatgtaacaagggcgatgagatttagttacatgtttttgtgacatgttgtagtattaatgttagtcaactctttcaacaataattatgtgtaacaaacaatctgaaaacttatatgcaaatatttatcttcgtgctcataggtctgtgggttggccgggtttggctaatctagcctgggctccgcagcatagctgtgcttcaggttctgggttgggtctatgtctgtcccacatgcgctcactctggggtccaggctgaagtggcagttgcttctacaatatggacttctcttggcagaacactggaatgtctaactctgcatgtgcattttaagcctctacctacaccaaattactaatatactgttgactaaagcagagcttaagcacaagtcaagaaatcacgtcaaggctgggcatggtggctcacgcctataatctcagcactttgggaggctgaggcaggaggatctcttgaggccagaagtttgaaaccagcctgagcaacagaatgagaccctgtctctacaaaaaataataataacaattttttaaaaaaagaagtcatgtcaagtataattctgttatgggggcaagtttggatcaataattcagtctatgacatgtgatttggaattatcttttgtgggaaaaatcatacggttggaaaggaaaaaatcacattgaatgttttcttgtctgatgagaaaaataatgccttatcattcataaatgttattaaaatgaaaaaagtgatttgtttttcatctaaagtaacctgaaatacatgctttcatcacatagatgcgcataattataactaacattggaaaggaaatatgtgctacacagcattattctcaccttccaggctatcactatatctgtctaaggaatgaaaggaaccagcctctgacgctgcctgctgtctttgtctacatagaagtgaaagactatgtgccagacacatatgcaggtaaacaacttaactcaaataccactttactcaaaggggtatttctgtctgagtcaccatatatttttgggttagtgaaaggaaaactgaaccaaacaaagcaggagattctggcttcagaatcacccctactttcgtatgtatgtttagaggtaaattgcttgagccattgtgaatacattttaatttaacgtattttaattaaaatcacaacacctcagttttttgaatatttattcccttttagtcttattctcatgggcccagcacttaccaactcatgttatccattacaacaaatgtctaggtctgtacactgaatttgtcttccaccaattttagaatgctgattcttttcatgggtgacatcctaaatttaaggaattaaccaagaatcataagtgtaaatgcttatagtgccaagtagcttgggtgtaagacactggggagtagtggagaccatggtaagcttggggctgtccatccaaagctggcagccataactcattccagctaggcactgcccttcaaataactatattggcaaatcattgggttatcccaacagtccggaaagcaggctttttatgtaaaatgtctccatttatgaaacgtcatttgggccaaataggacaattgggtgggccattgccggaatggatgggaccttcaaaaagaaactaaggaatcaagaatattcagggatcctgagttgaagcctgtccagtttgactctcagaactaaactcttaatttctctcttcctgaagtttcaacagagtcctaacccttgtccatgttcaaagtgttggatagaggagtagatagttatatgggtagacagaagaatggaagatggataatgactgggtggatggatggatggatggatgggtgggtagatgggtgatgaatgaatgcatggactgatggtcagatagatgagtaagtagatgaatgatggataatcaatacttccaggacctttgatctaaaatatctcttccctatttagatgtcatcgaagctttatcaaacccaatccgatatgtgaacctgatggaacagagagctaagcaattggctgctttgacactggaagatgaagaagaagtaaagaaagaggtgagagggtgttttaattttacatatagcattaagcatgatcaccacacctacttgttggctttgcctaagtaatatcacataccttgggagaaggaatagcacattggaacaacactttcatgcagtttagcatcatgtcacagaacatctagatgattgacttaaatttttcacatttcattttcttttggcattctgtggataccacgagcatcttatcttgtgataaaattaaactgcacacatcttgctatttcagatgaaactttctacatgattccatgctaattaaaggtgatgaacgcatttaaaaaggaagataatcatcaaatcatttagggtttccctttatctttaatgtagcatgcaggattttcaaagtgcttttctgatttttatagtacataaaatatttaacacaatacctggaaaatagtatgagtcataaagagtctactgttattattagatggtatatttatgtattataatgtgtgtcctgcaaataattgatatattattccaaattagatgtcacaatgcaaagcataattaaggaagggtctaaaaatagtagaaatgaagtttaaatttataaagcttctatgtagactggcagtctttttgcttttaaaaaaagtgaattataacttgattattaagggtgacactaatattaaaaatagtgataaaaatttgctattttcatattttattcagaggaaaaactcgagaaaaaagatagaaaatggagaactgtcagtattgggggaaaaaaccttgaaaattgttttaataagtataactaatagttatccattaaatagtccatttaaatagtctattaaagttgacattgttaagtaatgtttttcttatttcgaaagcatcctcgatttattatagaaaatttaaaacgtaaaaatgacaaaagaaaacaacaaagaaatcaactgtaattcaaacatcccatccgctcagagatagccacattaaatgtggggtgtatacatatctagtctttttatgcacaattgttactctttcataaaatgggataatattcacagtctgtgttttaagtgaaaataaaagtattaagtatctcattgcccatgtcattaaatattcttctatgacatgacttttaataactcatagccttctatcatatagctccaccataatttaattactaagtccccaattattggatatttgcaatgctgcactattttattttatttgtgggtacatagtaggtatatatgttacggggtgcatttgatattctgatacagacatactgatttttgtacactgatttttaatcctgcaactttactgaatgttaatcagttctaatagttagttggtggagtcattaggtttttccaaatacaagatcatgttatctgcaaacaggaataatttgactttttccagtttggatgccctttattttattttcttgtccagttgctctagcttggatttccagtagtatgttgaataacagtggtgaaagtgagcatccttgtcttattccagatctcagaggaaaggctttcagtttttcttcattcagtttgatactagctgttgaactgttatatatggctttcattgtgttgatgtatgttacttctatacccaggtggggtttttttgagggtttttatcagaagggatgttgaattttatcaaatgctttttcaacatcaattgaaatgatcatatgggtttttttttccttcattctgttgatatgatgtatcacattgattgatttgcatatgttgaaccatccttgcatctctgggataaatcccacttgggagaatcatagctcagtaccttgtttgtggtgggcaacttctgtgttgcaattcatgctccagagcaccctgtgggatcagtctgagactggagtttgcctgaggccacatttcgacttatcttcttccctgtcttaacctgcttgcctcacctccctgcagttttttcctgagaccattctctcagttactcatgtgctcaacatgtgctcaagaatcctcatgtccacttctgcttctagggaaaccagcaatgctaagtagcttgctgttttataaataaatacaagaatgagttccctatctgaattaattcttaatcaaaattaagaatttaaatatttgaaaatagttacatctctcattctgatatttcttcagttataatagtgctttttctcttttccatggcctttaaaagattaagaaagactgttctatgagtttctcattttactcatatgaacatcagtatgaaattaatttctctttggaaatccaccaaaggttctcaaattcttttctctttttcctgctttacttaatagcatatttaataaactataattaaaggtaaagataatttacatagatacaaataaatcactattaatatcattcttctctaaatagaaaacaggacctattaggtacaatgcatattacctgagtggcaaagttatctgaataccaaacccctatgacacacctatatgacaaaccctcatgtgtacccctgaacctaaaataaaagctaaaaaaaaaagaaaacagaaatgtcctttttcaactggatgaattttattctgtaagaaatagaggttaaacaaaagcattttcaagtgaaattacatgtattttcagtatttagaggaaatactttttagattatcaactttaacccattagttagccattgtctctaaggaataagcacttgcttcaagagaacatttcaacactaccatatttcagcctactttttctattgtctgactcacatgttcttgtgagtgagctgaaatttatctaaaattgtttcaaatagctgggtgtgctgacacatgcctgtaatcccagctactcgggagcctgaggcaggggaattgcttgagtccaggagacagaggctgcaattaactatgaatgcactactataccctagcctgggccacagagaccatgtctcttaaaaataaaataaataaaataaaataaaataaaataaaataaaataaaataaaaaaataaaattgtttgtaaatatttcctgattcagtgtatggccccgattcgatatagcaattgagctaaaggtctcataatggaacattttactaatggtgcttcagagatcatttctgtaatgactaggggaaaatgtcactctaaagaatgagagacataaggcctttgaggttgtagggctcttttcacaaattgatgtcctttggaaaccttatctttgcaccatcaaaaagttattttaggaggataaaatgtacaaaaatacagaagtagagttttaggtcaatcttatttttgtttttcttttcttaaaggtgatcagaaagcatttttagaaatgtataatattgtttaaatttggacagtatttggacatttttcagttttagaaaaaattttagaggcatggaatcacatggagtctatattggtctaatagagaaaatatgattttttttcctttgacatgtctaaactcttaactggcctcatttttacaactcaaggaaaaaaaatcatttgcccttaacatgtaatgctaggaaagaaaagtcatttcacactttgagcatcagtgtgtcttttttcttgtcttggaataatgtaagtttgtttgaatgatgccactgaaaataagtaactgtggttttctctaaagaaaattctatctaggacatggcaggcactgggacactgttttagcagcaaagacttttttagtatcatcattttaatgtgatgcttgtaaaggtcatttctatttgaacattaaaaatgtcattggactgcaaaatattaccagatgtttaatagtcctgtaaattatctttttagagtaatttataaaccaaatagataagaaagtggaatttcccccatgatttgaacaatagatatttatttcagataaggcaaaaatacattattcagattatattatacatatattatgtgtataatatatgtataatatttaggttatgtattatctgaataatggttggaagttaaggaataataaagattcgttattggatttattttgtctttgtaaattcagagtggtagattagtcaagttgtagagtaagtgcctaactgaatcctaacaaagtataacattcacagttaattcctttaaataaaaagtcacgtagaaaaatataaaaacatagtaaactaaagaaataaaattttaaaaccctctaattctgcaaatactggtaacatttttaatgtatatccttctagcatgtttcctatgtacatttttgtttgtttgttttttgagacagagtctcgctctgtcgtccaggctggagtgcagtggcatgatctcggctcactgcagcctcggcctcccgggttcaagcgattctcctgcctcagccacccaagtagccgggactacaggcacccaccaccatacctggctaatttttgtctttttagtagagacggggtttcaccatgttggctaggctcttctcaaactcctgacctcaggtgatccacctgccttggccttccaaagtgctgggattacaggtatgagccactgtgtctggtctctgtgcacattttttaaaataattttttaaatgttttacagaccaaataatgtaattacagagatgcctagtgaaatatcataacactttttttctatttttaaaatacctataaaaggaaaaagtaaatatccaatacatttattaggaaatattatgtgataatgtcataaatgcaatatttgaatatgacttttttaatgttagagaagtaaagaaaaaaataatgagcatttactgagtacttactgtatatctgacactatgttgagccctttattttatttttcttttctcaagacagggtctcaatatgttgcccaagctggtcttcaactcccagctcaagcaatcctcccacttctgcctcccaaagcactgagattacaggggtggttcaccatgcctggccatgaagcttttactgtattcactcacttaagtcttaaaacctccggatgtcctaattaccattatttccatttaacaaatgaagaaactaaggcactgaggagttaaattgcttgccctgtgccacacaattagtaaagaaaggagttaggatgaaaacccaggcaatctggttctgcaactcatgttccacatcagcacttctgcatgttaagtgtgaagaccagggcatcatgataaattgctgatcctggttcactggatctggggtagggcctgggactcagcatctctaataagcccccaagtgatgggatactgctggtccttggagcacagtttaacaagcatctccaccacacacacgcactacctctgtaacaaagctgtaattttctggtaacctttagcaaggatgggcccttcattcatctttctgacctccatagcaggttacctgaatgagtgagcacaggatataagacctttaccttaaacagtaacatcttttgattgaatttttagttgaatgtcaagaacttcccccctttaatcactggatgttgtcagaacttattcttcagaaagttaggtttatctttgtgggttctatttgattgatttgtgcattggctggccaaaatacatatccctcaacttggaagttacgaaagctgtattcatttgccaagcattcatttccatacttgggaaagttgtcctctaagacagagtacctgaaactacaaatcttacccagccctcaaggccaaaattgttcacaagaattcccaacatcgtctgtttcatcctgcaagtggaagtgtgtgagtggtcttcgtgtaatattgatgttgaaaaggaaaagttgtttggtaatactaaaagtttatttattccaaagggcctactttttgtattgtctgactcacatgttcttgtgagtgagctgaaattcatcaaaaattgtttgcaaatattagctgggtgtgctaacacatgcctgtagtcccagcttctcgggagcctgaggcaggagaatcgcctgagtctagaaggcagaggctgcaatgaactgtgaatgcactactgcaccctagcctgggcaacagagaccatgtctcttaaaaataaataaaataaaataaaataattggtaaatatttcctaattcagtgtatggccccaatttgattattttaataatgatatgaattccaccaataaaataatgtgacatcaaaaaaatccaaggtagtgcttttataaggttacaatgttttgcccaaggccttggataccatttaattattcaaaacagaaacttgatatttcattcacaatataagaacttgacactaaaatcaaagatgaggtttacagcttattttggattctctttaaataaaattcttcctccttcaaatcttcctcctcaaataataaatttgcaagatattaatttatagaaacaatagtttatcaaaatccctgaactttaaagcatccaatacagtaaaaagaaaaggttttcctttaaatagtgatgctatctctttcatttctatactgtacagatttggcattcacaatgcactttcattggatgccttggataaaactgggtcctaactaggaaaaccatagtaatccccatttttagagaagggaacaattgctcattatggtagagtgatttggtgcctaatatcaacggccaatgagttgaagaactagggtctttttaaatatgtatcaagaaaagaccattcattcacttgaattgaaactggtcaatgattggttcaattcagctgcttttacgaatatcctccataaaaatttctaaaatttcaatggattctaatgaggggctttgggttcatctgcctaaaatagggatgagtacaataacttcaatatccatgtcatgtccaattataaaatcatggctcccaattaatgatgaagtttttcactttgctttagagcagggcttctcaagttttaatgtgcatacaggtgcaggaaatggggaggtgtgggtcaaatgatacaaagcaggaaatgtgtaggatgaacaagtaaaaaaatctaatgtacagcgtgaggactataattaacaatcatgtatcatagtcagaattttttctaaatgagtagattatagctgttcttgccacagggggacaaagcgggtaactatgtgagatgatggatatgtctatttgttcccttatagtaaccattttactgtacataggtatcttataacatcatgttgtatgccttgaatttacacaataaaatttatttttttcaacgtgcatacagatcacttgagaatcttgttacaatgcagattcagattcagtaggtctggcacagatcacaaaacaccgcatattcaacaagcttccaggtgatgcttatggcccatggaccatatttggattagcagggctctcaaactttagcatgtaccagaatcacccagatggcttcctaaaacacagatcgatgggtgtcgtagccaaagtttctgattcagtaggtctggggcggactcaagaatttgcatctctaacaatctgcagtgaagctgatgctggtctggggaccacacattaaaaaccgctgctttgaagccctgcatctttctttcgcaagagtgtggctctccccagatgaaacccattaattccatccactctaaaatgacagcttaatcacagaaacctgggaagggctccaggagacacttttcctgggaattatccagaatttgtcccgcaagtgattgaccatagtccgtaccaaacgatttgacttaattaatctcaaagatatatttccacaaaattaacattaagagttgttggtctactttcctttaaaaagagaaatccatgatttctacctagcagccaagagttcattccttctgaattctttgtaaactgtatcaaaacacttctaataaattcaagttggtaggaacttttttatatacatatattaaagtttgtatatgtaacacatataaaagggtcagcagagctatgttcttttaccctttgatagcctgctgagtaacctgctgttattatgcattaaatacaaacttgttacagacagcagaaagcagcatcttcactcttttcattcattgatttattcattcattcaaatttgttttattttagcataacatttaggtagttctttactttcaggactttgccattaataatagagctatttattatgtactaacaggaaactaaatatgaattatgcattcattcaatattttttttttaaaaaaacccaactatgtgtcagtcactctgatggccattatatatgtaatgctgaggaaaatcagatgctctcatagcccttacaacttggaggaagagagtgacattataaaatttatacatctatgtgtaaaattgcagctgctactaatgttcaacaaaatgataccatgtgaatgctgttgactcatgtgagtgcttatatgatgacacacagccatgctgtgtcaagattcacttgaacccatgctccagttaccgctggaagaacttgctggacattaactgtgcaaaacaccaaaagtactttacttggtgttaatgaagaagctcaaaaaactgaagtcaacagatgaatttatccagctcattaaagctgtctcttgcttctaactcaccctggtagactcttcaaaattaggagttttgacatatttcattatgaaaaattctaagctaacattgaaagagctgtacaaggaacacctatatatcagccacccggattccataattaaaattttgatgctttcacttgatcacatataaatccctctatccatttatctatccatcttggttcaataggatgcattttaaagtaggttgcaaacatcagtatacttcactcctaaacgtttgggagtgcatacagcaggacaaagtttgttaaagtgattctgaatttcttagaaatatgaggcagatacattatctaatttcattcaactaatagaaatttaaggtacaaattgtgctcatgtttgaagaagctcctccttaagggaaaggctggctctaacaaagctactttctgacaatatttgtcctgagtagggtggatttctgcatgatgaaattatgagactcacccgtaatacgctggaaaaactgatggccttacctcttacccatgtggtgcccatccaaagcaagatgctgtcataaggtaaaaagaactgcactcttttttttttttttttttttgagacggagtcttgctcagttgcccaggctggagtgcagaggcgcgatctcggctcactgcaagctccgcctcccgggttcacgccattctcctgggtcagcctcctgagtagctgggactacaggcgcccaccaccaagcccggctaatttttttttttttttgtagttttagtagagacgggatttcaccatgttagccaggatggtctcgatctcctgacctcgggatccacccgcctcggcctcccaaagtgctgggattacaggcatgagccaccgcgcccggccggaactgcactcttcagatgactcagacaaggaaagcatgatccaacacctctaatagcccagtaatacatatgatatttgaaaggcccttcacttaccatgttaaccattcagttaaatcctccaaatcctaattctctgctgctcaaccatcagatccaaactttcaatgcccaggacggaaatcttttcaaccagcacatcaaatggcttttcctccttctatagaacttataaaaatgatcttttcagttaccattttactggtccatctgtattctattttcagtgcacttctgttcattttggaattaggaagcgtacaaattctttttatatttaattttaacattcaagttaggcatattttgaagaaaaagatattgcaatgattgcatttgtccactagagggcaggaacttacttctgtggttcattctgcactttttttttcactacccacctaagaaaaatctagtcaatgcgactgaagtactaccaccttctgaatcttctttccttgataattgcttaattggaatttaaatctttgaatcaaattaagaaactagacattcctagtttctgtttctatcacaatttccagtaccagatttttattcactcataaaaacaaataatgggggagaaataaaatattgacttctgctgattctcttgagtgggataaggaatttggtttttgcactttggcttacagatccatatagtggaattattcgatctttcaattataatatcagaaagttcaattttagtattgtactcctataggtgctttttttcatttttcagccattgttttgcttaacttatttaactttgtatgtacggatgcctttttagtgcaacagggtagttctttgagaattatgtttacatgtagacatctctatctcagcagcaagttaagttattattacggttccttaagctgctgttatcatagagtggactgctgtaatagaaaaatttagtctttagcatatagtccatattcaaatacttgttcacagtttcctgtgtgacctctggcaagttacatgacttttaataaagtttttagtaaagacttttaataacacctccgattattttgctttattatggtactgtgcgtgttgcctacactgactggctgtgaaaaagctgttgtatataacagtgtctaacccaggatgatctacagccacttctaattgcagtctccattcggtaaatggaatcaattaaaatgtgtacctatgggctgggcagggtggctcatgcctgtaatccagcactttgggagaccgaggcaggtggatcacttgaggtcaggagttcgagaccagcctggctaacatggtgaaaccccgtctctactaaaaatacaaaaattagctgggcatggtggtgcatgcctgtaattccagctactcgggaggctgaggcaggagaatcgcttgaacccaggaggtggaggttgcaatgagccaaaattgcactactgcactccagcctgggtgacagagtgagactccatctcaaaaaaaaaaaaaaaagtgtctacagcccttagcaaaaaagtttaaacattagtcacatgtatatgttatagaatcttacttaactcaggcatcccaaccagtactggtctgtagcttattaggacctggcccgcacagcaggaagtaagcagcaggtgggcaagcaagcaaagcttcatccccatcactcaaattactccctgagctctgcctcctgttagatcagtagtggcattagattcccataggactgtgaaccctattgtgaactgcacatgtgaaaaatctaggttgtgggctccttatgaaaatctaatgcatgatgacctgttactgtttcccatcacccccaaatgggaccatctagttgcaagaaaacaagctcagggctctcactgattctacattatggtgagttgtataattatttcattatatagtacaatgtaacaataataatagaaataaagtgcacaatacatgtaatgcacttgagtcatactgaaaccatcccctcaataacctcctctccccctggtccatgaaaaaattatcttccatgaaactggtccttggtgccagaaaggctggggaccactgacttaacttgtatataacatctgtctccagaaaatcatgaggtccctgacaagagtcagactatgcaaggatctccaaattccttagcccagtgtttaatgtcctcattactgaccctcttctctatgcctttgcttggccactggggcgagaaggtaagaagctcctggcccaccgagttcccagcacagtcctgtcacttcagcattactaaggatgcatagctcactcttgcaccatctcagaattccaggcaaactctgctcctcctggcagagggtacagattggcaacttctgggccaaatgcagtctgaagatgtgctctgtttgtcttttcagtgattggaaactgggagagttcactcaaaactttcatttttccatttttctcaaaacctgggtggaaataggctaaaaatgaacagcagccactgccccatttacaggctgtctctctcctgctctggacatgacctcactttgccctattgcattaaatctacttcactggtttctatcatttccactaactgcctattactctacagtgtgaatagtatccttaggggttgtgtcccaagagtgacacagtccactctacatggagacatcaccaggtgtgacccctggactaagcatttctctaaagcctacttcaaagtccagcaccaacccttggtgcccactttatccccgactgcaaccataaagtatttgcctgaatgtttacttaacatctatctgctttttaaaaatgtctttgattttatatagtacgtccctttttggaaggtggaggctttgtctcacatgcccttgataagcagagatttattttttcctttatttgactcaaattgacaatcgaacttggtttcccaagggcatacagctacatggagtatctgaaaacctaatgcaaatctaaaaataaacttgttggatccagtttgaatgcacctccagtctaacacctcaagacactaattttagttgccaaaaaaaaaaaaaaagccaccattattactttcacagaagctggttttccctaacttccattctttcctccatcaaaattttctttttctctatcctttttcagagggctaattttagtgagctgtcacattgggaagaatctggttcattccccacatggttttagaaaccaacttggatataatggggaaggtcagatccccacggaatagggacatcttcctacctgctttctaaagcagctgagtttggtaaccatgggcaccctcttcagctgggaggccagcaaagcgttacccctgctgtatttaagccaaagaaccacccactgtgggtgtataggtcccatgtagtcaaatctagtttttcaagggaagtaagaaacccattgtttcagtataagatcaccttaattaaaagatttgacaacactggttgagccaaagaaaatgcatccatgtactccattgggaccatgactttccagtttgcaatgtcttgctgaacaacacatacacaatcctttccctttgcatataattctagggagaatttttctgatggatgtaactaaatagtgtgaccatactggcacttacccatcagaagtagtcatttttcaaaagaaagattctgccatagtgagctatacaggctgccccggttacttgtttagtctcctgtctcccctaactgatgtccagccactgctactaagggctcttccagcattgagtagggtgtagtaaacaagcagggatgatttgttgaattaaaataagttctgccatcacttaatgcagttttggaagatggtttaaagatgatttgggaaacagattaaaagccactggtgacaatcagtgtcactattttcactcttatcttactttttataagaaagttattataggtcaatttttcatctgtaatcacatgccaaaatgtcacaatgttaggctccaaaagacttctggaaaaatatatttcctaatgtatttttaaaatgtgctacaaagtagaacattgggatagcctcattgtcagtaaaacctgccagggacttggaaggcaattctgataaagagttacagagaatttagcatattgaaaagcaacattaaaagagtatgtaggcaattattttataaggatcagcatttattcaacaaacatttttaaactgtttactgtgtataaggtatgtggaattagctgctggagggtgtcgaatgaagattttacgtttcaatgcatttattattattattcattggtagtattccacaagcttaaaggttttatttgttttatgtcaacataaataacaaacagatgctctctaaaagaaaatggtattatttaagaatagggcatactaaattatgtgcttagtcagggagggaaggaagacaaaggtttgtaaaggataaatgaggagggttacataattgttttcagatgattagccttggctacaaggatcaataacaagagtgacctcagtctgacgttggacagggagttgctaggcaggtgtcctcacagaagtattttttgtgtaaagttgctatggcctttgtacaaggtgatggcttttgcagagtcttttgtgagagtttttcttatcaggcatttatgagtgagaaccttctctttatgacattccctggctctttttgtcagggttttttgggtttttgtgggtgttgttgttgttttaatataagggactccatttagattctgacaactttcacattatttaacatccacatatttactctgtgccagaaacaattctaagtactttataagtattaacttatttaatcatctaaacaatctaacaagataatattatgatccccagtaaacacctgtcttcatctataaggataaagaaattgaagcacagagagttaagtgaactgcccaaaatcacactgctggtaaattgcagggccagaatctgaacccaggcaagctgtgctccaaaatgtgtgttcttatccatcacatcgattagctcattctgtaaaacaaccccaaacttggcagcttataacatcaactagttattatttttcatgcattatctggtcagctgggcaggtctgcagatccagaccagactcatagactcagctcatctcagccgggttcactcaagtgtatgtgctcagctggggactggctggtccaggacatccttgaccaggatgactcagctctcttccagaagagctggatgacagaccaggatgactcagacctctcatcctccattgctataataggaccctgagaaacagtggaaaaatttgcaagggtcttttgtatcaagtttgctattctctgattaaccaaagcaaatcacatggtctggtccagagtcagtgtggaagggcaccaccaacgggcatagacataggttggtgtaaaaattggagactttaatacaattaacctcccatagtcatggctcaacactatgctgttttaaccctgctttccagggagtatcaaatttgatatttccaactccaaaagaattgtgaagatgctataaaatgtagccttgttggtttaggaaggcaagaaaagaataaaaagaaatgtggaaaatgaaaggatatttataattttaggctgatcctggagaaacaccatcagaggctccaagtgaagcgagaacgactccagcagaaaatggggtgaatcacactacaaccctgacacccaagccaccctcccaggctctccacagccagccagctccaggtaagccatctggaaagagctggacaacatgagcaagatcctccagttcattagtgccactgacggaggcgctgtgatgtgggtagctaaagcatcaagtggggaaagatgtgtggacttaggaggagctccgtcaatgtgcaattaatgaatgaaagccagaagagagtcatatgtgctcatctggctctacagataacttatgaaaccacaacaaaaaaaatcacccagatttccggtgtcctttttcagtgatgagttatgacccatctgctggcacagtttgagaagaattctccaagcagcttataaacaaccatgccttagaagtgcattcttagtcttgcttcattaattctgtgccaagggctcctttccctctttctccaactttcttttcaacatctttgagtgtctgccctgtgctggacacattgctaagcttttcatatggatcatttcaattccccccataccaggcccaagagtagattctattattgtccccattgtgcagatgaataagctgccattttcaggtgataaagtacttattgaaggccacagtgccagggaagagtgaccttaggcctgatgcagttcccaatgatactaacattcttgcttttagctcctatattacagccaaagccacactcttgtctcatttctcaaaatgaataaatgaataaataaataaataaataaataaataaaataaaaatcctttgatttctacgcagctaactttgacatttaatcttatgcagctttgtgtaactattccttgtgtgtatgtcctgtttaccccagtagatgggaggcttcctaggtagacttcaatttgatgcctcctctgtacatcacacagtgctggggaatagcatgtacctgataatttcttgttgaattggttaataaagtaaacaaaagggagcagaatttccttccatgaaggtgtggaaaggagctcctttctttgtcatactagatcagggtgccagtagatccagatcttttaagggtatttctcatgggagagaaagagaattaaaaaaaaaaaaaccaattatatttaatttgtatcagacacgcttgaactgctttttaaaaggttgctggccaggcatggtggctcatgcccgtaatcccagtactttggaaggttgaggcaggtggatcacttgaggtcagcagttcaggaccaacctggccaacatggtgaaacccccatcgctactaaaaatacataagttagcctggcatggtagtgcatgcctgtagttccagcaactcaggaggctgaggcaggagaattgcttgaacccaggaggcggaggtgcagtaagctgagatcgcaccactgcactccagcctgagtgacagagcgaggctccatctcaaaaagaaaaaaaaaaagttgccaaagtcaataatagtaagaagatgacgttataaacaagaagtaaattttcaaataaagagttttatataccaaatacaaacatcttgaatgcttctgaaatataaatccatcatttaaatgtgtgagtaaatagtcatgtgttcctgaaagtaaaagagaatttagcattttcacatttaatttttttaacttgatattttggaataattgaacttacagaaaatattttttaaatggcacagaatacattgcaaaaataacctcttcttcccctaaagttaacatctcacgggatcatggggcaatcatcaaaaccaggaaagtaacattggcatgatactctgacctaaactgcacaatttatttggactaacctgctttctacagtaatgtccttttactgttcaagattccaacgcaggatcccaaattgtattttattgtcatgattctttagtctcctttaatctatggcagtcccacagtctttcctgtctttcataaccttggtactttggaagaactctggtcagttattttgttgaacatccctcagtctgggttggtccgatgtttccccatgattaggttgagggcatgcattttgacaagagcaccatgcaagtgatactcgcctttctcagtgcatcacatcacggatatatgatgttgctgggtctcatcactgatgatatgggatcacttggttaaggtggtttctccactgaaagttattattttcccctcttagatatattgggagagctactttgagactatgcaaatatcctgttcttccttaaacttttgcttactgatttttaacattcaccaatggatctttcctgtaacagttattactgcctagtggtcaacatttgacttttatttttattttactttattttattttgagacagagtttggctcttgttgcccaggctggagtgcaatggtgtgatctcagctcactgcaacctctgcctcctgggttcaagcgattctcctgcctcagcctcccaagtagctgggattacaggcgtgcaccatcacacccggctaattttatatttttagtagagacggggtttcgccatgttggtcaggctggtgtcgagctcctgacctcagctgatccatctaccttggcctcccagcgtttgacttttaaaaggtcacttgtcattcctgatttagccagaagatggcgatagcattgcctaaactgaatttgttccaagtggatgtcttttctcttttctctcgttataaatggggcatataatatcacattttttttttttttttttttttggagacagactttcactcaatctgtcacatagggtggagtgcagtggcatgatctcagtccactgcaaactccacctcctggcttcaagtgattcttctgcttcagccaaccaggtagctgggattacaagtacccgccaccatgctccgctaatttttgtatttttagtagagacagggtttcaccatattgccaggctggtcttgaactcctgacctcaagtgatccgcctgcctcggcctcccaaagtgccgggattacaggaatgagccactgcacctggcctaatgttacatttaattaggtttgtctcaaagctgcaaatgaagactttttaagaataatttttataaagaattttctcacacaatttgtcatttctctgaaaagagatttagattcaaggcccaaatatgtttgtttgtttacaggaagaataaaatttaaaaagttgaagaggctatttattttatcttttatattacaggttctgtaaaggcacctgccaaaacagaagatcttattcagagtgtcttaacaggtaaatgccaccctttccccccatggaattaagcagctcagtgttacacagtggaagtatttagaggagaggaaatttccattcatatctgaaaaacaacatcattaatatttcttcttctaaaaaatctagagacatacacttttagtttagtctacatgatatgatataatcacagagaagtaaccatactttgtagctagaaccctactggcataaaaataatgtagtttcacaagatagctatttcagcatcaaagaatagtttcatgctggaaatgtaacccagtgaacaagaatgcctgtcttcccaaattgccaataataaactatattttagatatgcagaatatgatccatttgtgagcataaaatgcacagtgtttaagaactgtgatacagtttggagttattttatatttggttagtcacataaactagtggaactaaaattggtacaagctttgtgcagtacaattagcagtatgtagtggaatcttaaaaatgtttataatacttggttcaatatacaacagaaatgtacacacacgttcaccaaaagcagcaccactggtaagggccaaatctagaaacaacccaatgtccatcagctgtaaggtaggtaaataaattgtgataaattcctagcatggaacaggaggcaactgcaggaataaataaactcaagtcacacacaacatggataaaactcaagcataatgttgaggaaaaaagtcagacacaaaagaacatattctgtaggattccatatacaccaacttcaaagacaaaactaatctgtgctgtagaaacctggatttggattatacttggtgggagacaggaaccaaaaaggaaggcttctgggatgctggccaaattctaactttgacctaagtgatggatattgaagcacattgactttgggaaaatttacaaggctatacttttatgatttatgcactttgatgcgtatatttgcatttcatcaagaaatgcataaaatatgcgtagaaaaattacttgaggaaagtattaaaagaaaacaaaacatggtttggttttgttttgtttttgagacaaagtctcactctgccacccaggctggaacacagtggtacaatctcggctgaccgcaacctccacctcccgggttcaagcaattctcctgcctcagcctcccaaatagctaggattacaagcacgtgccaccacacccggctaattttgtatttttagtagagacggtgattctccacgttggccaggctggtctcgaactcctgacctcaggtgatccacccgctatttttagtagagacggtgattcgccacgttggccaggctggtctcgaactcctgacctcaggtgatccacccgcctcggcctcccaaagttttgggattacaggcgtgagccactgtgcccctcccaacaaaacatgtttttaaaagatttagttctaggctgggtgtggtggctcacgcctgtaatcccagtacctggggaggccaaggggggggcggatcacctgaggtcgggagttcgagaccagcctgaccaacatggagaaaccccatctctactaaatattacaaaattaaccgctgtggtggcgcgcacctataatcccagctactcaggaagctgaggcaggaaattcgcttgaacccaggaggcggaggttgccgtgagccaaggttgcgccattgcactccagcctgggcaacaagcgcgaaactctgtctcaaaaaaagaaagatttagtttcatgggaaacaacaccatattaatgcatacaacaagagacagcagtgttcctagaatgttgtttaaaataacgtaaatgaatggacaaaaggcaatggtctgtaccaatacattagctgtgattatatcttggtggcttatttataaatgatatttgtgtctttatataagtgagcattacctttatacttaagagcatagtctaaggaacagcctctctcatctacagactttttaaaaataatagtttatgtggatttatttctaatcgtaggttagaacatctagagccttatttccaaactgcctatagctgatatgctgtaaaccacttttaaagaaatagaattgcatctgcctccaagaatgcagcaattccttgggattataaattcttaatgtaataatttattatgcaaccataatgagtcaatttgggcctgaaggaaaccattaaataaatgtacctggttttctccatggcctcattctcaaaagagatcgaatgtcaggagaatagacacagtataagaaaaggaaacatatttctattgcttaaagaccttaacatttaataacataacttattattctagtctcaatgtttattcactagacatcttattttctattcaggtctcttgttattcacagcatatattatttctgaatctcttgatagtttcaaatatttatggtaacattttttgttcccagaagcaggacattcaattcaaaccatggaaacatgtgaactatgacttgatctaggtccatataaatgataattcactggagttaagataccatcagttgtaaagcatcctacgttcatgtattgctaaaaaagaaaagcactgaccaaccatcataccccaccaaccataagatgcatcttgatttcggaaatgttaacatattttttaaatgcacattctagaattgattgaatatatcagtaaaatacagattagttttgttttgttttgagacggagtctcaccctgtcgcccaggctgcagagcaatgatgtgatcgcggctcattgaaacctccgtctcccgggttcaagtgattctcctgcctcagcctcccgagtggctgggattacaggtgcctgccaccacacctggctaatttttgcatttttatttatttatttatttatttagagacaagagtctaactctgccacccaggctggagtgcagtggcacaatcttggctcactgcaacctctgcttcccaggttcaagcaattctcctgcctcagcctctcgagcagctgggattataggcatgtgccaccatgcccagctaatttttgtgtttttagtagagacaggagttttgccatgttggccaggctggtctcgaactcctgacctcagatatccacccaccttggcctcccaaagtgctggacttacaggcatgcgccaccacacctggcctaatttttgtatttttagtagagatggggtttcaccatgttggccaggctagtctcgaattcctgacctcaggtgatcctgcctcggcctcccaaagtgctgggattacaggcatgagccaatgcacttggcccagaatgttttaaggtcagactctatcacattcaaagttttctcagcatgggataaaaaaatcagccaggcatggtgactcatgcctggaaatcccagcactttgggaagccgaggagggcagatcacttgaggctgggagtttgagaccaggctggccaacatggcgaaaccccgtctccataaaaaatagaaaataattatccgggcatgttggtgcatgcttgtaatcccagctacttgggaggctgagacatgagaatcacctgaacccgcgaggtggaggttgcagtgagctgagatcacgccactgcactccagcctgcgcaacagagcaagactctgtctcaaaaaagaaaatagtaatcataatcataataatatagtaaagtgggctgctagtaagcctctggtgactttgtgcaaattatattaaggtatcttccctcaagacactttactgctatatgcttttatgataaatgtaccagcttatgatgtttatactgtaaatgataccttttagaaatgatgttgtagaacctgcacagttattttctaagcctccacaggcacagtgccagaaactgagttaaatactttccatgagttcttttatttcatcatcttaacaaccctataaagttatagaagtattataatccttatagcaatgctgttggtgccctgcccagattccttgtacagctggtgcacccgtctcctggctggtggtgagggttggctgttaacagctcataacttctccttctctgcaaaattgccctcaaccaaaaggaagccccctctccagatggttatgcctccctgcactgaatgttccaaatatgcaagaagcttgccttcttgcctcaagatgagaccagctcagtggtacaactcacactccagcacttccccatgggatcaggcagagaccagactccatccttctgagaccacacccttgctcagctccttccccagccccgtctgctttcctggctcccctactctgagagtccctcagtaaatcacgtgcacctgaatccccatcttgcattctgcttctagggaacccaaactaaaaatatatgtattcgaatgaagcaattgggtctctgagaagtttagtaacatagtctcaaagttagcaagtgatagagccagactggaacccaggtagagctgacatcaagctttgctcttaaactctagctgggcaagatcaaccatttcttcctaagaaggtagccgctcttctttccatctggatgttcagccctcccattcccttagctttcatattcatttgttgcagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaagtaagttcaatgaatatttttagttggtttcatagcatgaagagttgttaacatggatttttaatgttttatatcatatttttggacctgtaccatggcaagaaaaccacctaacctccgttctccatagcttttgtggcaccttagcccagatttgcttgtgaattgaatttttttatttaaccaaattctgagaataaatatgcaggaagtcctcctgtgagtctagcctgcgatcccaattccagttaactaacttcctatattacagctgccaatctcatgggtatgagactttgcctggagtacctagaacctagttggagaggcagctgatttttttttttgagacagagtcttgccctgtcacccagactggagtgcagtgacatcatctcggctcactgcaacttctgtctccagagtttaagtgattcttgtgcctcagcctcccaagaagctgggattacgccactacgcctggcgaatttttgtatttttagtagagatggggtttcaccaggttgcccagctggtcttgaactcctggcctcaagcgatctgcctgcctcggcctcccaaagtgctgggattacaggcatgagccaccatgcctgcccacaactggtcttatagaaaagagaagcttactatcctttgctaccctgtctgaaatccataatgccctacacaggtgactctaatttgggcctgggttcccacagccccatatacccaaaccttgatgatgagaagcatctctcacacattcacttaattaatattttttgagtgcctactgtgccctggggacacagcaataaacatgacctacccaatcatctcaaatagtaacatggtaatgtgggaaacataaataataaacaacaaacacacagcatcatctcaggctgtgatgaggactatcaaggaaagaaagaaacaggaccatggggtagagaatgactggagataggagatcccttctgacatgttgatctgcaataaggtggcacagaaagaataaagcctggtcagctatggaaagaactagggagacttactccaggctgaggaaacagcaagtgcaaaggccctcaggcaggaaaaaaatgtgcttgtgccaggaacagtaaagctggcaaagtgggtgaaacattgtaaaccatgagaggagtgaaacaggatgagatcagagaaacaggagggaatcccactgctaggttctttagagctagagcaagcaacagttcaaaatgtatcgaacgtgcaataagattctactgaagaaagaaattgatatggcgaaatttgagagtctcagagcaatgactctagctgctgtgtggaagagggaccctcaagctgtgcatctcaaatggacatgagtcactggggatcttgttaggtgcaggttctgctccatgtctgaattggggcctgagcagcaccaggtgatgctgattctgcagttccatggacaacactctgagtagtgaagatcaaggactcagagtgaaagcaggagaccagttaggaaactttttcatgagtccagctgagtaatgatggtggtttggtctaggatgacgctggtagacatggagagaaggggatgaattcttgatttgttttaaaaagatcgtaaaatatggggtcagaggcctggaagagagaagcctgcttgtatgtctctgcaattcccaggtgtcctttagagaatgaaactcatgctgttacccacaccaaatgtgttcatgaaactccattatctagcctagatcagtgcatctcaaatttcagtgtgcatgtgaatcacttgcagcatttgctaaacacagaccctcgggacctgaccctagagtttctgcctcaggggcctccttcggtagggactgagcttctgagcttctaacgagctcctaaggtttgctgatgctgctggtccacagactttccactgatgggccctggtctataatcattcaggagcatcctagaaattgaagggtggctgaaaggctttctttggtctaatccctgcctcccttcccagctgccatctcccagcacttcatatgaaaacctgtactttctgccgagttcccaccatgatgagatagggcagttaggattctctgggctcagggcccttcttcaattgcaagactcttgtgtgaacaatgcagacgctgcctctaaactccaacaaagacctgcttccaaatgtgaggttgccgtgtggatttcagagtgtcacccgctctcagaaccccacatgtggactgcgcatcatagcttatcatgggactttgtggacacagggtctggcggaccacagggggcttcctctcttgaaccctgtcgagggctgttcccagttctggaatagcatttcattgagtgtcaacaaagtactgggcatatgtgtcatatcagtttcctaggattgctgtaaaaagtacagcaaactggatggcttaaaacaataaaaatgtattttctcacagttttggaggctaggaattcaaaatcaaggtgttggctgggcgcaatggctcactcctgtaatcccagcactttgggaggctaaggtgggaggatcacttgagaccagcctgggcaacatggtgaaaccccatctctactaaaaatatgaaaattagccaggcatggtggcacacacctgtaatcccagctacttgggaggctgaggtaggaggattgcttgaaccaggagatggaggttgcagtgagccgagatggtgccactgcactccagcctgggcaacagagaaggactctgtctcaagacaaaacaaaacaaaacaaaaaaacaaaatcaaggtgttagtggactatgcgctctctgaaaagtctaggggaagaaacttttttttttgtttcttctaacttctggtggttgctggcaatctttggcattccttggctgacagacatatcactccagtctctacctccattatcacatgaattctccctgcgtaggtgtgtcttggtccaaatttccctcttctaatgacagacaccaggcattagattcaggtccaccctaatccaccatgacctcattctattacatttgcaacaacctctttccaaattagatcacaggctgaggttctgggcagaacctgaagtttaccgggatgttatttaacccagtacatgtgctaatcacttctatgtactattccatatatttctcacagcagcactgtgaagtaagtacaggcatcacccacattggataagagaggacctaaaactcattgaggccaagtaacctggccaggggcacatgcaacacacaaggccatagtgacagtgaggtcatggcgtggtgccccctgagatactacttgtgtcagatgacatagcagatctggaatctgcatctctgtagacctgtgactgcttctggtccgtatacttataatcttctatctctatacaacaaaacaaacagatgcatgaaataaatatgcccaaataaattccctcgttaactatccctaatgttaggagatttctcttctaaatttagattcctgaaatttctttgaatatcttttgcaggtatatagtatgaacttcttgacaataaataatgttttgcaacatgaagttctctaatcaacagcattaatttttacataaaaatcttttcttcaaagttgaataattagggaaatggaaataaatgcagtggatttaaattttgttgctatcttttgaggtcacagacagttcttgtcttcctcagggcttatttagctgtcaagaatatttttaatttcagatatttagtgagcattaacagagcgttgtgtaagacattgctcttaagtatctttaaacatcaactcataacatttttaaaataaaaattaacattttatttttaaaataaaatgttatttgtggttttaaaaaaaagtgtatcgtttagaagacataactttcaaaagcaaaagtatcccttagttctatttctatatatatatatagcattttaatgaattgtagcatcaaaagaagtgaaaaaaagccttttaagtttaaattattgctccacttaattttctatactatagtatataaattactcttatcagatagcctatttttcatatgttggctaaccaatggacaacgtattgccaaagataatccaacgaccttcacagctctaggaaatcttatgtagaattggttgtacatttactgaaaacttttttggaatcattgtcatcagctgtctcagtaaagattatctcaaaagcttgactgataataattgccactgagaaataaaatttcattctttaactgaaaactttattaattaccctgaaactatgtaagtatgtaagtgacctgtcaatgagcaaagtataagacatattacatccttcctttactgaataatcttcttttgatgccaagttatagagataagatgcattttttagatttatattgtgacatatgatttaacacatgcttaaattgaaagcactatcaaaacctaatacttgggctttaaaaagtaataaaatcatctcttttttttttgttttttgtttttgagatggagtctcactctgtcatccaggctggagtgcagtggtgcgatctcggctcactgcaagctccgcctcccgggttcatgccattctcctgcctcagcctcctgagtagctgggactataggcgcccgccaccacgcccagctaattttttgtatttttagtagagacggggtttcactgtgttagccaggatggcctcgatctcctgacctcgtgatccgcccacctcggcctcccaaagtgctgggattacaggcgtgagccaccacgcccagccaaaatcatcatttcttaagcctggaggatccttaaaggccatctaggtgatatttgtcactttttcaaggaggaagctgaaagctaaaggtattaccatttacctgtagttacacagccagttcaagcaaagcttggcctaaaacttctcctgaatttctgctttagtcttatgtactatgaaccccaaaaatctgagacagttaatttagcaagtttatttagtaagttcatttttccaaggttcaggacatgcgcctgtgacagcctcaggaggtccagatgacatgtgcccaaggtgttcagagcagtttgtttttatacattctagggagacatgagacatcactcaacctatgcaagatgaacactggttctatctggaaaggcgggacaactcgaagcaaaggcaggaagatgggaagccgggagggggtttccaggtcataggtagataagagacaaatggttgcattcttctgagtttctgattagcctcttggaaggagacaatcagatatgcatttatctcagtgagcagaggcatgactttgaatagaatgggaggcaggttggccctaaaccattcccatcttgacttttccctttagcttagtgatttggggccccaagatttattttcctttcactgtacatatttgtttattcatttttgtatttacttgtaagtcatatcctgcaaacttccagtagaatattgaaggtaacatcatagaagatttgtatgtaaaaatcccatgaaaatagaaagagaaacaacacacatgcgtagactaagctttggacaaattatctagacctgctgcccaatacaggagccactagctacctaccagtggctcttgagtccttgaaatattgctcgtgagatgtgttataactacaaaatacacaccagatatctaagacttcacttttttaaaaaagaatgtaaaatagctacaacatatctgttgattttaattacatgttgaaatgatattttggatatattaagttaaataaaatatattattaaaattaatttcactcacttatttttactttttaaagtgactactaatagtttgaaattacatatgtgaagggaatcacatatgtggttctcattctgtttctaccagacagcgccagccatttaatgtcatctctgtccttgaacactgaattcagctcttagcttctgagaaaaggagtatgggtttgataattctcctcatctgattaaaggaaacttgctgactcttccaagagagacaagcgttttcctagtattaaattgccagagatttaatttcatggatcttatacaagcagcagaggggataatgccttcaactttgtttttatagaagatgcagagacgttgttcacttgtttttttcttgtgttgtcctttaaaacaaaacaaaaccaaaaaatcccttagtacatagtatctaaagatacgtcatgaggagcttttcttcaagtggcaaagccagtgggtctgattatgtctacctgtcttccatctctcttgatatgcaataaaatcctgaaaacacctcagataaatgaatggatgggcattatgtacattgaatttgtttccttccttccttcgttccttccttccttccttcctttcgacagggtcttgctcttttgctcaggctggagtgcagtggcatgatcacaactcactgcagtctcgacctcctgggctcaatcaatcctcctgccacagactcccgggtagctggaactagtcgcatgccactaggcccggttaattttttttttttttttttttttagaggtggggtctcactacccaggctgactttgaacttctgggttcaagtgatctgcccacctcggcccccaaaagtgctggaattacaggcgtgagccaccagcacaccaggcctgttcctaatactctgtctttccctgtttcctacagatgataatatagagtacaaaattggaatgaatcacaccaatttctttaatattcatcatctcaagtgagctttctacataatgtgaagaacaggttactcaaaaatagttttggtccagacatggcatgcagtcatgctgtgttgctcttaagagcacaggtgttgcccttctgcccctgtaatttttgaccttgggcaagttgcactactgcacctccatgctgtgtccttggccaattatctcacagagccgtggtttcctcaaatgtaagctggtgatgggtataccgacttactcggatacgagtgtgcccggcatatggggggatggttggcaatgagagctacctctgctagagtggttggaactgattgaagaaatgcctttatgccctggttacaatgatttcctgctatataagatcattcaggccgggcgcggtggctcatgcctgtaatcccagcactttgggaggccgaggtgggcggatcacctgaggttgggagtttgagaccagcctgaccaacatggagaaaccctgtctctactaaaaataaaaaaattagccgggcatggtggtgcatgcctgtaatcccagctacggaggctgaggtaggagaatcacttgaacctggaaggcggaagttgtggtgagctaagatcgtgccattgcactctagcctgggctacaagagcaaaactccatctcaaaaaaagaaagaaaagaaaagaaaaaagataattcaatgttaactatgtcatgccaagaggaaagtttccctcaacactgcagtgaggagccttatagaatgtccgtcctcatttggcattgcacataaaaatgcaaaaagaaacttgagaaaattccgcatcccttatttgacaaaatctgattctaacaccagcttcaaccaactcccttccccatgtgatgccactgatgctggcccaattcaaagaaaaagcaaccagaattactgacagctgattctaagaaactttacctggcctatcggaccacaagtgaaaaatatggaggcagagtctgatgtgttgaatgtcttaggtagtctttcgggaagggattccatataaatgaaaagagcatacctactctttgtaccctgttcccaatactctgtctttctttccactgtttcctacaggtgataatacagagtacaaaattggaaggactcacaccataagttaatgataattactttaatttattttgacattcaccctaaccttctaaatatttgtataattctctaagaacaatgcagagaaagtcatactgctaagaggaagcattcgaaatattttagaatgaactaacgcatctctttccccttgtaagctttgtgtggaaagtgccatttgggtaaagatatcagtgaagttggtgaagcctccaaagggccttattttcattgtgtgtctttgctgttaaaaatcttgttaagaggccgggcacggtggctcacgtctgtaatcccagcactctgggaggctgagatgggcagatcacttgaggtcaagagtttgagaccatgctagccaacatggtgaaacctcatctctaataaaaatacaaaaattagccaggtatggtggcacatgcttgtagttccagctactcaggaggctgaggcaggagaatcactcaaacgtgggaggtggaggttgcagtgagctgagatcatgccactgcactccagcttgggcaacagagcaagactctgtctcaacaacaacaataaaattgttaagaaacagaactcagatgtcagccaggagggttatctgcacacggcatctacacgtgctctctgtttataatcatcacccctgatgctaaacaaggcacatctttagcttcctctaacaaagtctgctcaatgcagtgtcctctgaagttttcatacgggaaaggtaactgggaatgccattacacttgtcacattttaaaataacaaaaaagattaaaacctgaaaattttttattagacactgtttttcccaaacggagattattattctcaccactgccatgcctagggcccccagcctctttgcttttctttctgcccctgcctctttctagagcaccatgaattccattcagtctctgggattggagacactctattgctaagcttgtccttggggtctcaccctctaccccaagtggcttatgaaaatatgtatttccaaacagagaactttctctaggaggaattctggtgaataaccttccctccaccttgttatggcctgtctgttttgtgagtcaaactctgtgtctttgcagatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactggtgagcctgagaaacatgatttatgtttgtgcaactggaactcccttataggaaactttggatacttttggataactaaaaggagacaagggtgggtgtgactggcaccaacttgagagattgtttaggtgacacagtgtccatcacactattgtttttataagccccactgtcttaacatctttaccaagcttctctgtcttctgccaataaggctgtattttatcatttttattttcactaacttatgttgagtttataattgcttttgggaatctttgaaatctcataagcaaatagaaaacacttatctttgtttaagaaattaagaacatgttgcaaacaaattttccctttttttttttttttttttttttggtagcactgggctttgtaagaatttttttaaaattatacagtacactgtcctatatttagaaaagtcagtacctaaatggccaacacggaatgttggctacccaattcataaggctccctatgaaaggaaatgccatcctcaccattaataatcagttttattttccaaaatgttttctcacgaattgagacattctctccatttttgttgattccttgatacatagtagggacacaataaatatttgtgacagatagattagataaatttagcaacaaaatatccttgaaaacaagcttatgccaaaaccaaagaaataagtaagcttgatagaaattaaggtagtgtatccagaagaaatgggttttaagagatatttgtataagctgtctatttctttgctgagggtctgtgcatataagagaattctgagcagcttcagcttgtaaggttggaagcctatagatgatttagccatcactgtataataggtgattcagtgtaattctgttgttctaggataacagtccccagtgactgtatgcaatgagtagatcaaaatcacatgaattgcttattgaaaatcaaattctaacgaggcccgttattctcaacttgagcatgaatcagaatcacctggagagcttgttagaagagatttttagggtctaccttaaattttcaacagatctctcgtagggctggtgttttcatatttctgatcccaggaccagacttcaagaactgctgcccaatacctaaatgtgaggctcaggatttactttttaacaagccccacatgatttcgaggggttgcctcatttgtgaactgctgaaataagacgaaagcagtgaaagaatggctgggcaggggttggatcaggcatagggagggattgccttgacagacctgagcaagtcaaagtaaattttaacgggcaataatggctttgagatccggctataaccactgccttctgactttctccagcaactcatccccagtagtccagaacataataaaaattaaaatagtggccgcatattaagcattcaccatggggctatattctgtgctgagtcatttacaggaaacagcctatttaattctcacaataaccattagagtttggtactattgtcagccccattttgcagataaaaaatgtatatagcaaaatttagtgactttcccaaggatccacaactggaaggtggtacatttgggatttgaaccttggtcctcgggttctagagcccctggtttataaccattgtgtagatgcctcggctaattcaggtttcaagccaatgtcatcataatgaagggagttgctctggtgtcctgctcacacagagagcacacagcaaacttcttcattatgatacctggaatgccatgcctgtctctctttaaacagctttatttcccaatcatacaattcactcattttaaagtgtgcagttcaatggtttttgtatattcatagatacgtacaaccaccactagaatcaattttagagcattttcatcgccttaaaaagaaatcctaataaattaggcattcagccattcattcattccttgaaacaaatgcttattagacacctgcttgttaaatatttttaaacagtagtaaataaaaataacaatcctaggctttatggagcttatattgtagaaggatgagtcagaccataaacaaaataagttggtaaaacatgtagtatgttaggtagtaataagggcttaggagaaaaacaataacagaaatgggagaataaggaggggcggtttggggaaggatgatgaggatgcttggcgattttaaatagagtaggcacggaaaggtttacgcagaaggcaacatctgagttaagaggtgaagaactgacaacagccaacacagggaggaggattcctccaggcagaaggattggcatgcaaagactctgggctggaaatgggcctgagtgttgggggaacagcacagtggctctgcctgaagaggattatagggcatcaggtcagagagatgggacttttgaggtgggagacagatcttctggggtctttaggcctctgtgttttcactaggagtgaggtgggaactgttggaagcttttgagcagaggattgatgtgatctgaagaaacttccacagggaccactccggggctgtgcttcccagtacgttacgggaagtggtctcctaggaagaagccgtcccaaagttcaggccaacagcagcccaaggggttaaggaatcctggggtctccagcagatgactcaagtttactaacagggtgaatgttgcttagaagtctggacatcccagctgggtgcggtggctcacacctgtgatcccagtactttgggatgccgaggcaggtggatcacctgagttcaggagttcaagaccagcctgggaaacatagtgaaaccctgtctctactaaaaatacaaaaattagccaggcatggtggtgggtgcctgtaatcccagctactctggaggctgaggtgtgagaatcgcttgaacccaggaggtggaggttgcagtgagccgagatcatgccattacacttcagcctgggtgacagagcaagactccatctcaaaaaaaaaaaaaaagaagtctggacaccccaatattagtccatttccatgcttctaataaagacatacctaagactgggcaatatgaaggaggtttaactggacttaaacttcaccgtgactggggaagcctcacagtcatggcagaagacaagtcatgtcttacatggatggcagcaggcacagaaagagtgcttgtgcagggacatttctctttttaaaactgtcagatctcctgagactcactatcatgagaacagcatgggaaagacttgcccccatgattcattacctcccaccaggtcccgcccacaacatgtgggaattcaagatgagatttgggtggcacacagccaaaccatatcaccgactataatcatctggagtttccccagggccccaacccttgggcaagaccattccccaaggaaagacacatggcaattcagaagagaggtggcagagtgagagggaagcctaatactcacgggagattcctgaaagaggaattcagagtacagatgaaaacagaagccaaaacatcccaagaagacctcttggggagatttgagctgcaggaataggggccgaagtcacaagaaagtcatgcaaaacctaaacatcccaggaacaatgcctcagcatgaggcaccatatggaatcccactgatgagggtgtggaaagcagctcaggagcttttctcctggaggagaaggttggttgggaattggggaaaaccagctgagcttgtaggtgggaaaattgcacttgaggagctagggaggtggtagaaatcctactagaggtggcaactctaccatatgtccttccacttccttctcactaagaaggaatgtgagtacacattgtaaaagttttgaagactgttcagagggacataaatacatgcccaagtcagcctggccctttcaggccaaatgtaagccactcactcaaagtgctcacccctgcaccactgtgattgtggatgtgggtttcagataaagccccagtgcctgttacacacacctatcccagccttgttaggaaggctaaagcctgaatatcttggaattagaaccacacaatgtttattttatggccatttgggagcatttacaatttttactacctgcctttagctgcgacgtgtgtgccaaagcttcctactggctccatttgtaagaatcagagattgttctgtcaggaaatcttttgactgaaaggcacccagaagtgttagttctatctttgctggtggttctaagtaatgaacaggcctcccaggctaaattagacaaaccgaagtgtaattaaaaagtaagccccaggttaaaagaagtatttgggtgatgaggaaaattaagccgacagtatttcatctcccaaaattgctttggggattaaataccaacgtgctttggttaaggattatgcatttcaaatgccacatccacagttcgagagttaagaaagaaagcatggcatccgtaaacttcctgtcagatgtttactgaaaacttagtatttgcacaacattctgatagacactggagacgaaaatgaataaaacacgatcaccacacacactcaggggatgtgtataataaacagtactaagaaatgaaataataaaagcaggaaaaaatggatatgaaagcacagatataactatttgcctaactctatcaatcgataagcacctagaggatatttttgatgtaattgttcatatcatgatacgagatgtaaaatgcacaccaagctctgtagactccacttttgtgcaaaaaaaaaaaaaaaaaaaaaaaaaaaaggatctgtgtccctagagctctacatctaaataactctacagtctggctactcaaagtgtgaagtgtgggccgtgaatcacctaggagtgtgttagacatgcagagtctcaggccccacttcagacctgctaagtcaaaatttgcattttaataggattcccaggtgtcttgtcatatggtcaagttgaagaaacagttttagagtgtgtatcattgccccaaatgcattttagagtaagcctacaatttccgttatttgaaatgggaaatacagtgagctctttacagcttgtcatcaagttgagtgtattatctgttggtgacgaagtcatagttcctgtggaaatcacccctgtggttccctccctacatccacagtagaaggtactggttgctttagtcggaagtgagtgaaaataaagatggaagttcctccaccccattcacgtgcttgtgctccatgatatctctcaatgaacagcttgggggtctgtaaaccccaggtaaggacttttgctccagagaagaactacagggtcagggaatctgttctaattcatttatctgtttttcatcaactgctactggttaaacctgtgtttcgtctataccattagggtgaggttttaattttaaaagtgactttggtgaggcgtggaaattcttagggatttacctgagggtccccaatcactctgggtactcagctctaccatcacattctactaaacacccacagcccagtgagcagggatttcgttgtaatgttaaggagtttttgcttctcagccacagatgtgctcgacccaccattttgtcttctttcttcttcctcctttttagcggctttacaaagagatttcctcatttctttcacagttaccgtatgtgttatcctctgcagagccttgctttgcttcactttgctttgcttcctgtcttttctcccctttcccatatctcccacatgttctaatcacatccattcacctctttctttacatcaaactgaatggctcgcgttcttcttacaatcctcatgtctgtcccaccagcaatcatttcaggaccccaaaccaacgttagtaccatcaaactgagttcagccccagaaagctaaaaagttgtgtttcagaccgcaagctctgggcagatacagatcagctatgaatggacgagcccaccaggacaagcaatcaggtgctgagtggggggtctagggtcatatgtcctcatttcaggccactgctcctccaccaagtcactgcatgaccacctgaatgtcaattttctcacctgttcaatggagataaaaatatctcttacctcatgaaactgtaaggaggaacaacaagataatgcacctaaaatattgtttttaatgaaagcctttttctgtacaatacctgaattgactaggaaatctatatgcacttcaaatataaacaagtattacagttttttatatcttgctacagcttgagggaactcattgtctctccttgaatgatttctaccagcactatgtgctctcccagctatctgggagccacacttgaatgttctcctttctgtggttgcctaggtgatgtatatgtgccaggagtaattgcagtctcaggaagtatccctactgtcagttgtggtagtgccatctgtcttcctccaatatttggactttacatagggtcattttttttttgaaaaataatttagctttcccaaaaaatgttgcatttttctactaaacaagaaatgacaaataagcaaaagatgttagtagtgaaataagaaataaaataattgttgacatttttgtcaattttcctgattattaccccagtgggattcacacacacaaacacacacacacacacacaaacacacacacacacacacacacacacacacaaagatccaaatccatatagttttcaatttgcttcttttacttagcattatgccatggtgatttttcatgtcatgctttttaacgctttttcatggcttcgtattactttattgcatgaatgtagcttaatttatttatctagttccctactcgaggtggtgtattagtccgttttcacatggctgataaagacatagccaagactgggcaatttatacccaaactgtgaggtttaattgaactcatagtttcacatggctggggaggcctcataatcatggcagaaagcaaggaggagcaagtcacgtctgacgtggatggcggcaggcaaagagaacttgtgcagggaaactccccaatataatactattagatcttgtgagacttattcgctatcacaagaacagcacaggaaagacccacccccataattcaatcatctcccaccaggtccctcccacaacacatgggaattatgggagctacacgatgagatttgggtggggacacagagccaaaccatgtcaggtggcaactccacattgaatagaagccttggtcagactttcacattcattttttctttgctcagcaaggaaaaaaaatttcaaagattattataacattgagactcaaataagcagctattttaatataagttctatttagctatggaaattttaaaaataagaattttataggtgtgaaagaatatctcatagaatgatcaagatgcttgacttttttgtccaagactttctccttctgaaaagagaagggagctagtagagattatagctctgggtagacagggccctctctgtctgctcacagaggaaggttggaccatcaatactagcatagtactggcacatagtaggtaaatattctttgaatgaatggtcaggtcacactcccatataaacatcttccttgtttttgcttttgtttttgtttttttagagaccaagtctagctttgttgcccaggctggagggcagtggtacaaacttggtgcactgcagcctccatctcctgggctttagtggtcctcctacctcagcctcccaagtagctgggactacaggcacgcaccaccatgcccagctaattttctctattttttaagagacaggtctcactatgttgcccaggttggtctcaaactcctggctttgagtgatcctcctgcctctaccttgttttcaaattgttggtgatgtgcttgctgtgtagatcattacttagttcagatgttttgtaaattaatttcttgtagaagaaaaacaatgtatagtgaaaatccagagtaaatgctttgactaaaaggaaagaaagaggcatcttctttagacattagtggaagggaaaggaagatgtgttgagcccgaaatatgaatattctagacttggctttttgcctatgttccaagattatccttcttagaagagactccaaacatacaaatttctgtccacatattttttatcccttttgagttagagtcaaggaattattctcctccatggaaaccattttcttgccctcagatgactaaaccaagtgaaatttagcagagttgagaacaagcgtgaagttttattccccagggcctttctgttaactccttaaaaggtttggaacattgagctgggagagttatcatgaatggcaaacaaaccagcaaaaagtaattgagatgtgtctgttcctttgggacagaaaagaaaatcataccaaaagtgaaaattaaatgttgtttactaccattcagtttaccacataccttcttaatttatttcctaggaagtccaagtgaatttttgcttcttctctacctttaatagtcagtttactttcagagttttgtgactaataaatgatcgaatggctctttgaacagagccagcctgctgataaatacaccaaaagttagtataccttgcctttatgttagtcacaaagcacttcaattattatatgaaaaatcactcttctgggtactattttcacatcttatgcagtaagaactttgagcccaaaacacagaagtttatcttgtttagagattaagcagagttgttttatttctgtttttgtttgtttttattttatccttattcttttgattgcaagccacagaattccatgctggactaacttaggccagaagggtatatactagaaaagtacaaagggtatatcacataagaaagggggctgtccaaactctgcccctgcttttctctgcatattagtgttattcttttccaaagtagcaagacaggcttccccttgatagaaaatacaggcactgatcccttctgagttttatttctccattgacatgtaggaaaaatcttggggaaaaccttgtttgggtcccatgatgaccaagtctgcaaccagaagtcagagtatgactgacccaacttggattaatgcctcccctggaccaattatcttggccaagagatggggggtaaaatatacagcagctcccaagggaagcatgtgggtgaggccattctcagaaagcagaggaagttcttcctggagaagtagttagtattgggtagagaaaactacaggtgtacctcacatcctctctttgtagcataaaaaagagataaattattgatgcccatataaaatcccattgccaatttaatgtgagttgggcggtagtggcatactatttaatattaacaaaatcataatattaattattctgtctcctggaggttcagtagacaaaatttaaataaaaatagtaaatgccgtgtgggcagaacttcagtaggagtgagggtcttctgaaaactagctgaggtcgggctcggtggctcacacctgtaatcccagcactttgggagactgagaagggcagatcacgtgaggtcaggagttcaagagcagcctgggcaacatggtgaaaccctgtctctactaaaattacagaaattagctgggtatggtggcacacgcctggaatcccagctattcgggaggctgaggcactacaatcccttgaatccaggaagtggaggttgcagtgagccgagattgcaccactgcactgcagcctgggcaatagagcgacactgtatctcaaaaaaaaaaaaaaggctgagatgagcagaggtggggctgtgtagtaaggcactgtgggggagatgaaggcaaactgagtacagtaggacatttacatattttacatattaaacagatatcctctgaaaacatatactccttgggattctagggaaacaccattttcatttaattgcatgcaaaagcctcagtttaaaaaatacacctggatttcacattaagatgctttttccggaaggaacaaaatttagcttgttaaacaccaaacctatataattttaaaagtatttccaataaggcagcctgtggcttgaatgtgagctttcagagctatcgctgaggtcgggtccagtgtagttttgaaacttaaaagatttcattcacaatcatttttttcagtgcctattttgtctagagcctgggattctaaacatttattaagaatggaaggttgaaatggtgacatccctttgtgggagcaataataagatatttacatacaaaaggtatgtctgtaaatgataccctgtaggaaaaaccaattagggggccaacacccagagttatctgggcagtcaaaggggagaattacctaaggctggcttagaaagggaaggggcagagagaaattgaaatggtttcttccagattgtctccatcttccacaaccaccaagacaatgcttttcaaactctaatgtgcactcaaatctcctgggaattttgttgaacatgtagattctgacttagttgatctggagtagggcccgagaacttacatttctaatgtgctccctggtgatgctcttgccactggtatgtggactacactttgagtagcaagatctagaaagccaggtcatcagctcagagtttctagaacagtgcctgctatttagtaggtgcttaataaatatccattgcatcgtggctgaatcagatagtttagataagtgtgtgttctgggaccacaggaggtggaaacttgttctgcaaggggtaaagggcaaatgcagggggtgtgatgggagccaagagggaggcaaaaggacgtggcagacagggaacttctggggagtctggagggagtgtggcactgacagtggtgtggagcctgacaccaaaccaacataaaagtcagaactgagtgggcagaaggtctgtgagttctccagcttagtctcaatattgactggaggccgatgctgctgaggataaaggcagtaggcggaagggaaacagcacatgtgagcagatgctggcataatcaagaaaatattctgaagtcaggtgaatgatagagatgaggacatggaaacaggaatataattgttactgaattcaaaagagttgctgggagacttagcagtggcttgtagaatgagggagggtccaccaagacaacctcccacttcaagtctggcacaaagcatccaaatcacctcaggagattttgagaatattgattcccaggccctacccctagacatttggagtccataggtcctggaatctgtatttttaagaagttcccccacatgattctgatgttgcagccaaggaaggtgatccctggataactctctgtaactccttcaagtggttggaagaggagaaaagccctctagggaagggaaggtgctagtgagaggacactttcagctaaatagagacgttgcaggagaccccaaggaaatggccagagtctttgcacactggaattttacatctagacagcttgataaatggcatgactacaaagtaatgcctcatgatttctttaattgtgataatcatgattaggcaatcccttttgaatgatcaaataggctttctgctggcccaagtcctagttaatatttgttcagatttaatccacttcacagatgaatgcatcaaatttcatgataattttaaacgaatgtggattccgtatcgtaattctcttgcaagccatggaaccttatttgtctgggtttgtacccatctcagccacttaccagctttggggccctgagcccaggacttgagccagatgtgtcagcgtgttcttatgtaaaacaaaaataataacaccaaccgcatagggcaattctcagaattaaataaatacatgtgaatcttttttgttttttttttttttgagacagagttttgctcttgttgcctagagtgtgcccagagttgctggagtgcagtggtgcaatctcggctcactgcaacctccacctcccggattcaagtgattctcctgcctcagcctcccaagtagctgggattacaggcacccaccaccaggcctggctaactttctgtatttttagtagagacagggttttaccgtgttggccaggctagtctcaaactcctgacctcaagcgatccacctgcctcggcctcccaaagtgctggaattaaagtgtgagccactgtgcccagccacatgtgaatcttttaaaactaggcctgacatatagaaattatcagttaaagtgttgtaggaccctatccttagttcagctaaagacgggttccttgtcacatggccacaaaaagttaggcttgaaggcaatttgaagagtgaggaggacagggttttattgtgttgaaaggaaaagagggaaacaggttatctccacaaggctggagtccctgctagtgtgcttcccaccttgcagattgaattccaagttccacccaggaagaggagtggccaggctcctccctgctgcaaatggggtggatttctgtggctccacctcagtgtgcattcctcccagtgagcaggcccgttgcagtttttccggggactcccttatacttggctgtctcaaaagtttgtggtattatgatttgtcttgtcactattacagctgccacttatagaagactagtcaactcagcttgccttatatgtttttgggaaagagaatctccatctatgggaaaagcagtgggggctttcagaggatgtccacactgtctattgggtgctccagtaagaagggttgagtccagttgctacagccacctgaaaaccttgcagaaggttctccaggttcctcatgaggaaaaaaggaaaagattaccaggcacaattacctttatgtaattggcaaacacttactgggcatcaagtgaatattaggaattgtgcagaataccaaggatacaaaaacacaattgatgcccccttggggcttgatttgataatagatgtatgacaataaatacttgcgttcacagtgatgtagtgacagttcattgaaagcacaaagagaatttctgatgttctttatatctactggaaattacccacgcaagaacataaatgtcaacttctaagatgggaaactcatgttatcctcaaagcaattcaacaatgaatgatagttgtgagccaagaattataacttgctgttgattataacttacatttgtgtcatacttatttttattttgagcttcacagcacctccaaagacataaagacagtgatcaactgagaaaatgtaggttctgaaaatgtagggtcttgccccaaatttcacttttaataagtcttagggtagagattggaaccaggttctacactgtaagttgtctttgcactgagctgggctataataactgccacaacaatctaatgaattctgtttaattaaaaagagataataagaagaatttcatattaaaacccataagcctagataatatgatggttctaaattgtcctcattgccaatgttagatgtctgacaactttaactattgtgaaacatccatcacagatattctaactatagattctgttgtttgagggaggtgggaaggaagctctgtttgcaatcatttgaaatagcaaactgacattttctttttccagcttattcaaaagttgacggatgtcgcagaagagtgtcagaacaatcagttaaagaagctcaaagaaatctgtgagaagtaagccctcattcccattacaattgacatgtgcatctgaatttattcaacacaaattcccatctgatttgcctcttttttctcttttacttccattgtgacttcagagaaaagaaagaattaaagaagaaaatggataaaaagaggcaggagaagataacagaagctaaatccaaagacaaaagtcagatggaagagtaagtcaaaagtgtcccctctcccaaacagttcatctgggaattattttattttgtacgtcagagtcacaggttcataaccagtcaaagactccttcgtgaagtttctcctctagtcagcctttcaaaagattcttttggtaaggtttttaacagggaaggctcaagcaaagactggttcaataaaggagtgaggcacacccagggccttttagataaagagtaagcaaagagcttccctcagggaaaggctaaatcctcacttcctacccataatcttcctggcatttagtgaaaacagagcctgtgccttgggaggaacctgacctttgtccaaaggctggcagattataccttccttgtagcagtaataagaatgttgctatggctcacacttgtaatctcagcactttgaaaggcctaggtgggaggattgcttgaggccaggagttcaataggggcctgggcaacacagggagactctgtctctacaaaaaaattttaagattagctgggtgtggtggtgcacacctatatttccagctactcagaaggctgaggctggaggatggcttcagcatgggaggtcaaggcttcagtgagccatgatggtgccactgcactctaccatgggcaacagagcgaaaccttgtctccaataaataaatagataaaaataaggaaaaaagaaaaagaatgttgagagttctgtaaccttttatctagaagtctgagattaccatttgtcaattctggatgaattggtataatgatgtattcatcatttgcttttagggagaagacagagatgatccggtcatatatccaggaagtggtgcagtatatcaagagggtatgtgggctcatcacgctctctcctttgcaaaacatgtgtgaacatttggtgagctcgctgtgagcttctggaaggaaatgtcatgccttgccataactttttatcactagcacctagcagagctgtttcacagggtgggcactccttaatcaacatttctgcaagttgaattgcaaaccactttgtaaaaggattcatctaaaaatagagtcaagtcatttccaaagtcaagagcccagaaacatattgtaaatgatagtgttcccaaaagaacctttaattgtcatcaatgatagagatgatggcaacctcgaagggctgtcctttttttttccaatttaatgtcatagaaatgtttacatatttataaaaaggtaagaacagtgcagtccattgatcaccacctcccacccttatgtttctgtcacctagcttcaacacttactacagtttcctatacttgtaagtgtagttcttgatcaggagatcaaataatcaaatgtaagccatagatctgaaaagctttcggtattttctgaaaacgtgcacttttaaatgtttagatgaaagtaatgtttcttgtaactttcttatagctagaagaagcgcaaagtaaacggcaagaaaaactcgtagagaaacacaaggaaatacgtcagcagatcctggatgaaaagcccaaggtaaacggaactgaattaaaatgaacaattattttatttgatttccatttagtaagagtaaaaccttcctggtttacataagtaccttgtacacagtctcagatcagttcttgcatatgaaactcatgtatctttctcaatgaaggaaaaaatatagcaatattcagtaagcatttatcatcacctggtgagcttttaaaaactgcaaatatgcagaacccagccccagagatttggctttaactaatctggggtatggctcagacaaaggtatttttatagtccgtttcccctggagaatcagagactaaccaaaccttcagtttgggtactactaagtaaacgtcagttctaaatagctgatgtaatgttgtaatgccaccctctgtccagcagaggatgccctgcaccaaaatcactttggtttttatctagcaaaatagtctcataaatcagagaaaagcaaatcttttgtttcccatagtaacagttgattggggctctgctttaaaattatcttatgttcattgtttggttaaaattaattgtcttatgaatattaactttgaatgaactgagtatctgtagatcaaatactttgaggttaccaaatggcatctcagttttagaacattccttccattttgattcatcactgaatagttttctgtttgtggaaattgtgtttttcaattttcctgcgcttctattttcaatttaaaatatctactctaaaaagtactgccattccacacaagcatttctcgagtcctaaaagttaaaaaacgttagttttatttaattgtatgtttcattcaccagtttacttcttatagatttcttatggataattctaaatatattttcatggttctttgtgctcttatgctttcatatttattatataagacatttatttaatatttttaatttctaagtttttagggttggcaatatagattctcaagcaagaattaataattacttagatatggtgctaattcttacgtttctcctataaacatataatgtagatcttctcagccaccctctcaggttgattatgcactaataaagtggaataaattttaacataatttcagaaattgctatactttccaatcagaattgatctttttaaaatgctcaaattatttagagcaaaagatccagtttgactgaaatttaagaaacactttaataataatcagtctcaggtgatatattcagatacatacatttctaatctatgctgtctggttttaaatttgtcattactttgtacactgacataatagaatttgcttatggttgatggctcagctagtttttgtatttcaaaaaaatttaggtaatatggttcttttcagagtttcattttgcttttttttttcatgcgtgttttggttcaacaatgttaactattttacttacagataaaatgtgaatgtaaaatcattaatgtgtttaaattatataactctcagtatcagtaacccatacaaagattttcttgttactgctctaggtcatcatgattaaaatcaacctcagtaaatgtggaagcacccttaaacttcttccctggatataactggacatgaaaagaactaataacttttggctgatttattaacagtcagggtgcattcagctgcaattttacaataagcccaattaaaactggcttcaacagttatagtatttagtaagccacgttactggaaattcagaggtactacagttgtaacagtgattaatttagtggcttaacaatttcatctccaggtatttttagaatttccactgttgttgccttctagatccagaccgtgaactcagtcatgagatggctgccctagctccacacatcataaccttacatgaaaccactcaaaggacgtgcagcaaatgtcttcattttgtaaccctttctaggattgagaaaaaccttcctacatcccctctagctggtgtttcctcattgggtacaatggcctcatattcccattcttaaaccaatcatgggcagtagggtatcactttcatgattggcttagagtaattaagattcactcacaaggctagagagagttcagttttcctcagttccatggtcatcaggtacctgaacaaaactgatattttatcatcaaagaaatagaggggaaatagcaactgggtagacaggttacatacagtgtacgttacagccatgtttataacaattttttgtttcttcctttctggccccttggaaagagatctgaagtgtttctatgaatttttagtagttctattgtctgcgttttttattgtaaataggtaccatgatgaattcctctgtgcttttcttccatgaggttgctccatgaccatctttttgtgtctggatttgaaggttgcccatgaagattgttggttccatgtcaaactaaagcatttcttgagggtttttcttcatggcttaaaaacgttgtgccttaaagctgtgattttattaataaaataataaatcatgactgttaacattgtaggacatggtggttaataaagggaaatgacaatgacaacaggagcagcaatagacagtagagtaaaagaacaaaatcaagtgtgagacatgtgaagaaagaccaaagcacaggacagcaaagtaggtattaataaatgggtggtgaggagaggccaggccagcatagcagtcgctgatgctcctgtaactgtggggcatggatggaaaatacagtaacactggctttgaaataatccctctccacatctagtactgaaacaggctttgaatcttgacatagacatgagggaaattagcaaaagcagaaacaaaacaaggaacaacccaaggaaatgaaactgatcaatagtatctctaaaacaagtccacggagtcagttccattcagtcagataagaaaacagagtgatttcgtgacatctagaactttatgaatggttccattactgggttttggatgaggaacgtgagctgacattgcagcaggtaatattaaagacaattgtaaccttcttatgaagaagaaaccatgccaaactttgccacaggttactgaggagaatagagttcctccctcaactaatttacagatggtatcggggaatctgccccgatattcacgtaggttcttttctatttttcctaagcatcggctggcttgagaaataaagggacagagtaaaaaagagagaaattttaaggctgggtgtccgggggagacatcacacgttggtaggatccgtgatgcccccacaagccgcaaaaaccagcaagtttttattagagattttcaaaagcggagggagtgtgcaaataggtgtgggtgacagacgagtacttaacagggtaatagaatatcacaaggcaagtggaggcagggcgagatcacaggaccacaggaccacaggaccgaggcaaaattaaaattgctaatgaagttttgggcaccattgtcattgataacatcttatcagtagacagcgttttgagatcaactggtctgaccaaaatttattaggtgggaatttcctcttcctaataagcctgggagcactatgggagactggagtctattgcatctctgcagcctcaacagtaagagacagctatgcccggggggccagtttagagacccacccgcaggcgcacattatctttctcagggatgttccatgctgagaaaaagaattcagcgatatttctcccatttgcttttgaaagaagagaaatatggctctgttctgcccggctcaccagcggtcagagtttaaggttatctctcttgtttcctaaacattgctgttgtcttggtcttttttcaaggtgccccagatttcatattgtttaaacacatgtgctctacaatttgtgcagttaatgcaattatcacatggtcctgaggtgacatacatcctcctcggctgacaggattaagagaataaaataaagacaggcataggaaatcacaagggtattgattggggaagtgataagtgttcatgaaatctttacaatttatgtttagagattgcagtaaagacaggcgtaagaaattataaaagtattaatttggggaactaataaatgtccataaaatcttcacaatccacgttcttctgccatggcttcagccggtccctccatatggggtccctgacttcctgcaacaagatgggatgaagttttttaactagaaagtgatcatagctaagtttttgcagacaccaaaagtatgtataggctacatgacatcatatttcttcctgttcttccatttctttcaccatgttgttgtatataataatttactttctcttcatccacttattctaactaatgtaatagtgtgtttcatgttcctaatcttgtcttaacagggaggaagctctttttttacattactgtttgctctgggatattactattttgagctattctgaaccttgatcaacttagaaaatcatatcaatataattttctaagccattggtaaataaacaactcctttgaaagtaacaaacagatattttgtaaatctttcagcaaaagaaatttgaaaagccaatggctcaaagttaacagtttttcagtggcaaagaagtatttattctggctcaatttagagcaaactacacatgaaacctcattcaaagtgtgactttgctagcagtttactcaacaatgggcatgtcatctagagttcccaacatttttaccatcctgcaatagcagtcataggagaatatgcctcaatcaaaatcaggctaaaaatttgtttcaattctgcatgtgagctgggaccttaagtctttctggtcgctatttggtaggggaccaaatgtggccagtcacactggaaaagtttattttagattgtcccactttgtgacatgcactaggatcttttcatgtggagagttcattttttccctatgaaaaaagagattcaattagtttattcattttgtaggtaattttgagggcattggggaaaacagaagtaggtggtccctcgaagcaacttgtacaataaaatattttggcctcaatttgacacaaaatgatgttgtacattgctgcacataagtcccatggaaacttattatgttataaacaacaagagacactcttagaagggaatacttggctcctttccagtagagttctgaattctggagaaacattcgactgcatgttttctagcaatgagatattcgattcagtccttgagtgtatgtgggtttcagttttgtttgagttgtggctttttatgaaatccatagtggtagaattttcaagatggacgcagtaaacactggccagtcttctgactcagtgaaataattggtttcctggggatttccatacctgggtttgccaaagccagtaggaaacatggggaaaccccatctctaccaaaatacaaaaattagccaggtgtggtggtgggcgctggtagtcccggctacttgggaggctgaggcaggagaatcactggaacccgggaggcggaggttgcagtgagccgagatcgcgccactgcattcaagcctgggcgactgagtgagaccaccctgtctcaaaaaaaaaaaaaaaaagaaaagaaaacacggttagtcacaagttgccttgagtctgttgtgaatatgccaatgtttattgatcactttgctgctcctgactctctttataagaagaatcatcttttgaggggaatatttaatgaactatctccataacctcataaaacagtcaataaatgtgtaatttactttttctctgatgcttaatttgtctttgatgcttcttagaacacaggttttctgcttaatttagctcatcatcaagagagaattccgggaagctttagggcattttaattcattcccaaagaacatttcatcatgtagctactggctcttttttttccctccaccaagggaatatagactgattttccttatttcccctctgacatctttgtaacagggtgattgactcatccctctgcttgaagttagtcttgttagacctaccgctgggctctgagacagaaccttaaatgcggctgatatctcctgtgtttgggagagaaaaggcaaacttcgggatttaaaataaaatattttttaaagtaatgcatttgtgcctcctctaatcttttgcggcttgatggggaaatggattcttccttgccagcacttattggatcttctcccagaagccaaacttgcagagtggaaactggctgcttatagacagtgtttctgctcattgtcaagtctcaattaaccacacagtggtttgtttttgtttgttctgtagaagaaaattctttttcatttttgtcaatataaagaattgcctttttaggaaacaaatatagttatgccttattttcttgagtataaaacttagacatgtttactctccttctgggcaataccagggcattggaacaattttaattccactggtccctcatcagtttatttttgaaatttaatctaatagacttttaaacacataagacattattctatgttttgatcatggttcatttagatatgtctacatattcacatattctttgtgaaacgttttttcttgtatcttctgcccatttgggatcatcatcttgtacttcctctagaagttcctttcatgcggtctactggtgggaaactctttggagtttttatttttgtttttgtgcagaaatgtctttgtttgtttaatgtagtaatagatgagaatctacatttcctccattctggaatgatattttcactggatataaaattttgtgttggtggttattttcctttagcacactgaagataaacttccaccaccctctagcatctattgctgttcttgagaggttaactgttagtcttaatacagttcttttgatgataatttatattccccctccccccaccgacagcatttagtatttttttcttacattttgtgcagtttttctatagtgtgtctaaatatgtgtttgagatggctagatggatcactttcctcagttctgcaaaaactctaaactatcatgaaagcaaatatggcttctgtcattttttttctttccttctaagattccatatatatttgcatataaaataaaatgaacctttttactccatctcctctgtcaatgaattgtttttagtattttccatccttcgtctttctttactgctctgtgggcaattttttttcctacactttttgcaatgcaccaattttttgtttaaacttctattctatgcatccactgagtgtttaatttcaggttttgtattttatttccagatgttctatttggtttattttcaaatatataatctgtatgtcttagcttgttgcagggaagctttcctgtgagatttctcactctgggaaagcctcagctcttgactgtaggctcctcacctttcaaggctatcaaagggtgaacacacaatttccatcatgagcaaaagcctatcagggcaaaagcagcttccttgcttattacctttctaggttcaatgtccccttcagtttgaccctgatcattaagttgttgtagttctctgggtctttaaagatagttttaatggccaggcatggtggcttatgtctgtaatcccaacactttgggaggccaagacagcaggatcacttgaggtcaggagtttgagaccagcctcgccaacatggtgaaacactgactctattaaaaacaatacaaacattagtcaggcatgctggtgtgcacctgtaatcccagctaccctggaggctaaggtgggagaattgcttggacctgggaggtggaggctgcagtgagccgagatcatgccactgcactccagactgtgtgacagcgcaagactctatatcgaaaaaaaaaaaaagctttagtatcaaacccagcttcttaatttttttcagtggaaaggatggtccaaataacctaatcagccattaccagaaatagaaagtccccacattgcatttctgaaatatttgaattagttaacatctgtatcagtcagggttcaactagaaaaacagagccagtaaaagattgtgtgtgtgtgtgacagtaattggcttatgcaattttggtggatggctatctgccccgttctcaatgctgtctctctaatgatggaccctagcaggcaggcaggaaaggaaaattacaagtaggcttggtgactagagtaaccagcagaagctgagcctctttgtcacagagttgaacatacacacatacacacacacacacacacacacccctggcccaggagtcagacaattaaaggaagacccaatgggcaggggaagtgattgcaggctcagctgctgcttcccatcaaccagacacataaatcaacagatcagcaacaatgcctgagtattacacaatgactgctgactcccccatcagccctccaattctcagaagaatctccatggaacccacaatagctggaaacatacagaaagggaactctgggaaatatagtttggctgagacagttggcacaataagaagcatcacactgttaagtaaaaatcagaaaatgttttatttcaaaaatactctgtgtctcttgaaaaattagattctaagattataatagaaacatgcaaagaatttctaaagctaagaagaagctgtcccttagggctgcatggtactccctaggctgtttcaaagattgctattgtctattggccccataaggtaactgagtttgagatttaaacaaaaattaaaacttagattcgcatggatgccgttgattcctcccccttttctttaccatatcaactttctttccccctcctttgtccatatttttctttcttgaggatgagaaaatgtggacatatggtgataaatgtactggatagagggcagaggctcagaagagaatcttccccacctgctagagtagggggctacatgttggtggggttcagcgtcttcccagcaaacaatgattttaacaccgggaataggatgaggtggacttttatcatattggctttcatctgcccacctgccatacatgaaaagtccacacaaccacggatggaaaaccttttgggtttatttccacttctacttctgtgtgcctgtcattgggcatgatttctgtgaattttgctaatactcattagatttttttaatcctcaatgtatctctgttttttttaaagccctattttgatataaccaggatagtgaaaattatcaaacacacacatccaaaccactttaaagcaactaatgtaaaattttaattgttttctagaaaccaatagctgatttaactatgaccttcaatattttaaagggaaaagatggccaacctcaaaccaagagaaatactctcatcccttggtatctatggatggttggttccaggactcccctcagatacccaaatccacagatgctcaggtcctttatataacattgtatagtatttgcatataatctatgcatattctcccatgtactttgtcatttctaggttatttataatacctactacaatgtaagttctacgtaaatagtgttatactgtattgtttagggaatcatgtcaagaaaaaatgtctatacatgttcagtacagacacaaccatccacttatggttcttctgaatagttttgatccaaaagtggttgaatccacagatgtggaacccatggatatgaaggggatgactgtatttacctacagaaaatccaaagaggaaatctactagatgctttgagatatttgatgaagaagtacttggagatgagagaaaaggctattgcatgagggcaaatgcaggcatactgggctgaagaaaacactgaagaaatttttccttccaaataggaaagcagttgccaagaacagcattacagtctctgttttccatgtattatattatatctaaggccatattcatgcagcaaattcaccacttggagtgctgtttatacattttctgtcaacagaaatcaacagacacaagtgttctgtgtttattataatcattagttgaggttaatctttgatttgtcaaggaggtgtttgaatttcctcaaataatattttcagattttaaagagtcacacacacacacacatatacacaataacacatttatacagacacacgaacaactttatacaattggagagaagcttagcagattaaccattttggcatcaaaatggatttcgccctatctaattatgctagtatataaaaatttgtgtcaaagagagtagccagcagcatgtgcctgtgtttggtacataagagagaatagaaaatacattgttttctatctttggctgagaaagatttgtttcctttttctttgcacctttcgtattatccaaaaaagaaaaaagcttactcttaggttttgcaaaatacacagtgagctgttacaattcttaagtttcttattgggtctgtgttttaggtggaaccaaaaaaccctaggacttgaaaaaaatattgtaaagcagtcaagacatctttataattgttgagtaccaactgcagtgcaatcactttagtcaaagcctccatcatctctcccctggatttctaagtagcctccaaactggtcttcctgctgccacatgtacacactcaaaatctattctcaacatgtcacccagaggcatccttttagaacacaagttaaatcaggtcactcctctgttgaagacccttcaatggctcccataatcctctaaaagtccaatacagtctaactccacttttgctgcattttttcttcccttcctccttgatatactctctgctcaggccacactgggctcattgctaggccccaacaagacaggcgaatcccaccttgagccattgtttcctcatctcccaagtgtctgtttgggcaactctctcctgtctttcaaatgtttgctcaaatctgtcagaggctttccatgaccactttattaaaatttacaacccccctccaccactctcccatccctgccatcctctctcctgtttattctgctgtgctttctgtttttcatagcatttgtcaccttctctcattcagtcatacccttctttcctaagtgtgtccttgagtactgccccacccatcagaatataagctccacaacgggaagaggctttgtctgtttcgttccctgacgctcttgagttccagacatccaagaacatcgcctgccatatagctggtgtccaataaatattttttgaatgcatgatgtatgtagagggctaacaacattaactttgtatgttaaaaaatagttctggctctttgcggggagaaaagtagtgcccttaagcccagactccttggactgtgttgttcactgaacaaacagctgtcaatcattcatcactatcttttctcaagtttcttgatggtagtgggattttgtggagaatatctcaaaagtaacagctgtgatcatttttaacaactaatttttacagagagtggggaggccgaggagaactcaatgccaattccattgcatgtgtgggaggccaggtgccttgtcacactgggggtgttggagcagataaaggcaaacagaggagttaaaactgtactctagaaggcactccaagagacgtcccagacaaataattggaaacaccagatgacttagaaatcaatttcattgccacaaaaatgacagcctccctttttttccacacagggggaaggttcctcctcattcttgtcggaaacttgccatgaggatccctctgtttcccccaactttactccccccaaccctcaagctctcaagtggtgaccaccgtccttccggccaggtaggactggatgggaggggtcgcttttgagagaagggtggtgtgtagccatccagttttcaggcatcacggacttgctcgtttgtccttcatcctccctttctctacattcccatcttttttttctgctaaagttcccagccacacccatgatcatttcctcatcctttctgccttcctctggtattaatttctccatcattgtgctctctcttcctgacataaatctcattcttccatattgtcttcttcctctttctccattttgtttctctattggcaaatttggcttcctttttaatctggattttctctcttgcactcagactattattcccactttggaaacatttttttttccatttctgcttctcactacactgttttcccgtggtcctattatcttacaatccagtgggatcaagttaactctcaaggagtctgtttcaatccactcccctcaacttaccacagccctccttttggaagtccagcaaaatttactttattcccacatggtatttagagtgaatggggacagcttgtgatttcctgattctctagaagcaagagctcttggaaatatctcactaatagggatgcttgggccaggagctctttgtcagagcaaacttcagcttgaaaatcagagcagactttaacttacccaaggagatgcatcacgaaaactattatattcccttcactaataagaaaactagcataagccattccaaagagtgtgcaattcttagaaaaaagaagcattcttgtgattataaataaagcaaactttattctaatgtaatgaaaataaaattctacagtgagacttgtactgtttttgtcttcaagtatttgttcatctgtgaaataatgcagtttaaaaacatgtcaaagaattactgaaaataactctttactgagaaagaggtatgagttattcctcttcctcgacatcagttgttgctctggctcagagcttttcagacctttgtgggtatctgaattacttggacatcctgttaaactgcagacacttatctaggatgtctgagtggggccggaaagtctgcctttctaagtagctcccaggggatgttgatgctgccacagttccagggagcacattttaactggccaggatgtagtacattcctacctccaggcttaagcacctggaagaagcttgaagcaactgtcatggcattttaatgtattttaactttttgacccaatcacaagcctgggcctttgatttttttttttttttttctactgcctgtaacactagaaagagggacacagggaatgccatgtcagaacaaagtcacaacatggctatgaattctgttcatgtcctctcaacagtgatcattttgtttctgtattaccttgtaatgaaggccatattggaaggtgagtagaggaccgacatataatatcaatttctggcttctacaagaaggcatcagggagaccttgacaatttcttcttcgtttggatataaatgttaagactatcttttaaatcatcagtgatgagcaccattcgatttttttgttgttgttactcttgttactgccctggtagttttgtgttttttgtttgtttgtttgtttgtttgtttgtttttgagacattgtttcgctcttgttgcccaggctggagtggaatggcgcaatctcagctcaccacaacctccacctcccgggttcaagtgattctcctgcctcagcctcccgagtagctgggattacaggctccctccactacgcccagctaattttgtatttttagtagaaatgggatttctccatattggtcaggctggcctctaactcccgacctcaggtgatccgcctgcctcaggctcccaaagtgctgggattacacgtgtgagccacggtgcctggcctgccctggtagtttttaaagctattgtgaaacatctaataccacaagtagaatatcttattttctcaggggatgcaaatgacagtgggtggaggagctaagaacacatgacttaggttttatttttcaaaacaaatgcaatagagacaaaaatgctgcatttttgttgctgtgctctttcaggcttgtaatagcgtgttcacaacttgtattccctttagaatgtcaactgagatacccactggggaaaaatatttattttaagaaagagacaaatatccccacaatacctagacttcaaacatttaatcatattgttagtttgtttggtccctttagctttccactataaaagatgacataaaaataaatatttcacacttttcatgtcaaaataggtctcgtggctaaagcagaaaaagaaaatcccattatagcattttatatttgaaaaaagaacaaaacgttcttttataatagtgtatggaaaaaagatttttgtactaattttaatatttccccaaatgttttttgcattcttgttctttccttaaacatcttcattcatacactacagctgaaaacaaaatgatgaataaaaagtaatagtacataaggccgggcatggtggctcatgcctgtaatctcagcactttgggaggccgaggtggatggatcacctgaggtcagaagttcgagaccagcctgaccaaaatggtgaaaccccatctctactaaaaatacaaaaaattagccgggcgtggtggcaggtgtctgtaatcccagctactcaggaggctgaggctgagatgagataggagaatcccttgaacccggaaggtgatgttgcagtgagccaaggttgcaccattgcactccagcctgggcaacaagagcaaaactccatctcaaaaaaaaaaaaaaaaaaaaaaaggaatagcacataaaggtataaagctgtcatgtgtttgccaaaggataatgttttctattatgatagaagattggccccaagagtagtcatcacataaatagttggaattttacattttttaatttgtgagtgcaaatcttcattggtgaaaaaatatattccttgttatcagctagaccttaataggtgaagctaagtaggtgagttatacttttaactgtggtaacccattttttaaatagctacaaatcactgtagagcgagatataaaataaacaaaaaagatgtttgctcattttatgtatacataagtctttagataaagagctgtagaatgaccaatttctaaaaacaccaatgaaacattagaaaattataaatatatgccaagtaattattaatgcctgctttattctaggatatgccaatttcaatagaaaacacaaaagaacagaaaacatagttcctacatgctttgaaataataaaggtcagtttaaggccgtagaaaggcatcaaaatatttttctgacacataatactaaaaacaaaaattagcatttatggagcacttactgcatcatcaaacacctttaaagcacataacatgtgttatcttcttattcttaccactgtacatttggagaaactaaggttcaaaaaggttaatgaactttactaaggtcagacaagaagtaccagaccttggacacaccatgtgtccttcagctttctaagtatatgtctgaagctaagattttatgatctagatgtcaaagtaggtgacttctctttcttatgttgacatggataaacaagcaataagggtacaacacctgtgcctcaatatacttatctgtaaaatggaaagacgacgagcctctttgttaaagaagcatatctctttgagtggctagaagggatacacaccacacatgtataccaaacactgtttcatttgctggtggcatagcccagcctccacaagatcgtggctaaattgtgccagagatttcacccccaaactgatcacaacagcacaaggcattaaacatcacaggcagcacgttcacattgctcaaagtcacttgtttttagcaaacttctgggagaagaacatctctgaggactagattttagaaaacctccagctctgtgaaaacaggactcacctctaggaaaccacaattagtcacagtttctgtcactgagaggtgggcagctgttttccgtgttcatcgcatctgctggggaagcaatgccaagcagaaggaaagggagacacctgaggcacagtgtggcctgcacagttgggttaagataattttgagtcaaccttccctgtctatggctgctgaaaactcatagttcccctctctaaagcagcaggattgaggaagggctcacccactctcacctccttccaactttggctttcctccttcctctcatctcctctacttgcaagccattcggcttatacatgtcaatgctgtttcaacaacagactcagtgggtttgcttcccctgaggtcttctttctctctctcctcttcccattcctcctcttaagtctgtctcttgccccagccttagaacagaatccttgttaactaacccttcttctgtactatacaagagaggagttagagtacacgttgggctttgcaacgggtctgctttcatttgttaagcaattgttttttatttggatttcatttattcatttaaatatttatgaagccctactacttaccctcaggatgctaggcattctaaaggaatatcttgctagagaaacgtctccgtttagattgtaccttaagtttcagtcacagcacagaaaagggcttctttggaacctgtgacaggtgaccgtcttctccttttcctctgcagttagattcagggcgactgctttgggctaaattatgaaagacttaagcaggagtaaagagatttttctgaaagtaaaaatatctaaatacctaaatagattcccgagggctgttgtgtgtctctttgaagatctttaaatgcggagacaaagaaggcgtctaccagcagagggttgcgtatgtctgagtgacctttttatgatctcttttgagtccgtgaaggatgcgattaattaaagtcggaagtttgtcactgaaataatagttatgagatccagagaattcaaggtgttggaggactcattaagtagttgcataaatatcatgctgaaagatttaatgagaccacagggtcacttatagaacgatggtgcagagatgacctagaaaaaaataaattagaatcgatattgtgcttctgaattaacagctatagattgctatattaacacctgagacataaattctataattatatcttaatgatgaatattgatgttcttgtcacggaaaaaatgaaaattgctcacatttagtattttacttatcaatagtaaaataaatgtatatatgcgtgcttatttctgtgacatctgggaaccgtgaatgctttaagtagctacaattaaatgaatagtgttttttttttttccttttaattcaaccaatagttattaaatgcctactacacagcaggcactgggctaggtgctgggaaaaaacacagatgcacccttttccccccttcaagttgattatagtatagtgctatccaatagaattttctgcagtgatggaaattttccatgtctcagtgtccagggcagtagcaactagccacaagtagttattaaccatttgaaatgtggctgatgcaactaaggagttgaattttttattttattttaactgtttatatttaaatataaatataaacagccacatgcttaatcttagtttctaatgtgtaatccaccgttgtgtcaaaaaggattgcactgggacaaaagactatgttcatcattataaaagagctgtttacatgggaggaaaggctgacacataattgaggaaaccaaggaaggcttcacagaggtggcagtcactgagctgagacctagaggagcagataagaaggacttcctcatgacaatatgaaaaagcctgagatgcgagtatcatgttacttgcatcttgtggaactgtatgtaatttcatcatttgcatgttgtgttactctgctcagcttccacagcaaaatgtcacagactgggtggcttcagcaacagaaatttattttttcacaattctggagtctggaagtctaagatcaaggtgcccgcgagattcgtttctggggaggcttctcctctgggtttgcagacagtggctttttgccatgtcctcagatggcctttctatgcacatgcacagagagagagagagcgcatgcacacgctggcacttcttccttttcttataaggacaccagccccatcagatcagggacctactcataggagctcatttaaccttaattacttcattaaagatcctgtctccaaatataatcacattgagggttagggctttgatatatgaatttggggtagacacaattcagtccataaaggaagtatatctctcacacatagctcacacaaattctgtagaaaactatcatctatttacctagcatctggtgattttaatcactgcttttgacttgcatagtgatagataacatagggttctagaatagtaacaggtataaaaaatacctaaaccaaagtatccacctcacagaactcgaatgtaattaaatattgcttaagcaaatattaattttcctttattctttgaagacaaaccagtggtgagctggagcttactatctaagctcataagagtccattttaaaatttttcagggattttgtgacctggttattcaacacaaccattactacaaattaaattatataaactttcaatgaaataaatttattcaaaacaaatgtaacaaatactcataactcatcatttaccaattttttcctagagctttgttgaagcactttttaaattttttttaagacagggtctcactgtgtttcctggctggaatgcagtgaagcgatcatggctcactgcagcctcaatttcccgaggtcagttcaatggatcctcccacatcagcttcccacgtagctgagaatacaggcttaccaccacacttggctgatttttttttatttttagttttgtagaggtggagttttgccatgttgcccaggctgatcttaaactcctgagctcaaagcgatcgtcccgcctcagcctcccaaagtgctcggattacaggcatgagccaccatgcccggctcacttacaaataatttaatacctctcactattgccggtgctctcactattgctggtgctctctaggtactttgcatctttacatctactacgcaccatcggtagtggtggctctgacagtctgctactgtacacctcctcccaacgccttattcaaggtcacgactttgttactttgagactggctctgggcaagtatttacaccattgaaaatcaacaatctctaaaactgggccctttcattttccaggagagccgtatattaatcatttaccggcataccactggcacaaaccttaccctctttcatggtacagggttttcccagtatttatctggagttcctgttgcagctttccatggttgaaacattattacccatcctttaaaaacaaaatgaaactttttactgaaataaattaccttctttaaagcttttttttctgtttcctccattagacagagcctgtactgctctgttgatctatgaactttcaggccctcagtataaaatgttttaaggacaacagaaaagtcccctaaaacttacacctagcattgacaacatttttctagccccctcagcaatgtcttctacctaaaattgcctcagctgtaacgtaacatacctcctgctgctagtactagctcacagctaatactaagcgtaacacctgactccattttacaggggccactttttttcctctaaaagttttatgtagcagtaagtgaaatagaatagatgctggggtaaacagcagtttccagattaaatgttattttctgtaggaaacatttctctccaatgttgccccttcacaccatccccaaacaagtaaaaagttgctcagactttgaaaatgtaataccatctggcagaactcacattcgaccttttattaaaactacaattatgtcacacctgtgaggtttaaaattcaaggctccggaagttaaagcgacgtgtccaaggttacatggaaaattcttgagagctcacagtttcctgccctggcctttcacttcggatgtacaccatagtacgtgtgttttctgattagagctctcttcagttatgatttattttaccatcataacattttgggaggctggtatgagggagagtatagaagaaggaattcaagcagaaaaggttaaatgatttacagttttcgccctttctccaagggaaatttatgtgcccccaaattttagaatcatgaatttagattgaatgagaatggataaaatccatttacagtcaatttagattgcataagaatggatgaaatccttggcatatctaaagaatggaaaagggatcccaggaggtagttctggataacttttaacttgaaaacgtctggtagaggccgggcatggtggctcatgcttataatcccagcactttgggagggcgagtcaggcagatgacttgagcccaagagtttgagaccagcctgggcaacatggcaaaaccctatctctacaaaaaatacaaaaattagctagctgtggtggtgcatgcttgtagtcccagctacttggggggctgagagatgggaggattgcttgaacctgcgaggtcaaggccgcagtgagccaagatcgcactactgcactctggcctctggcctggacaacagattgagaccctgtctcaaaaataaataaataaatagtctggaaggatagaaaaagcaagtgagaaacaaaaaagggaccacctatgaggtaggaggaaaaccaagagtgtcaaacaaacccagaggaaaagcagtgcatgagtatgaagggcatgatccccagtgtctaaagttggtgaatgctacaggagagtcttctttggttttagtatccaggaggtcattattggccttgatcttaatgaggaatcagccaaaaggtggggaagggaaccaggtaagagtggattaaacaggagaccaggaacaggagacagcttatctaacactcatttggaggtttagactcgaagggaagcagggatctggtctagtaatggaggaaataggagggaaaatccatttgagaagagattaatgaatccttctaattcatggttcggtctagtttatcatgaaacactaaatcaaatgaaagagttgcttctatagccctgtgcacttccatcagcagattttatattgagttgtgcagatcaaccccattgccaaggaagaacaagaaaaagatatttcacctacattaatggttggcagagtggtttttccctctgataaattaatattcaatggaggaacaatatgttaatgagtatacagcatatattattcagaacaataacaataaaggatttctgtagaccttgtttaaatgttaggttttcttttgctgttgagtacatgaacagcaatacttacacaacttacatcatgatcgtcagagccgatacagaaagccacaggcctgcctggctgctacactgaggtgtctacagaccaagaggcttcacatgtgcctttctgtaattagtatttactcagcctcctatagcagggaaaatattttgcacataataaactcatatatttccttacccattaaggggtaatgtacttaagcacattttcctgtaggatttttaccagcaaggtcgagtcatagctccaggagaggaaagaatgggactcactagaagagaagatcctcattagcaagtgaaaaattttgtaaaacagggattacaagagaggaaggtatttttttttcaaatttttcaaattcctttaacttcttctaacatggaagtcagatctggggggctagagccttgcttgctatatacccaaagatgacagaactcaggataagacatagaaaaagagaaaagcctgcccccttcttcctcaggccttggaatcgttggaagaagaaggggagagagagaatagagcaggaaatgagactttgtatgtacctctctgacttctaccctccaggcgaaaatccggaagattctggagcaggctcatgacacctcatatcttgtgtgtcttagaagggacacgaaagctcttgcatgtcctggtgatgggaaatggtggtgtgagcgggggctggtgtgagcgggggctggtgtgagcgggggctggtgaaagctgggacaagacaaagaggctccctctggtgttgacttcataactgaagtccgctggactcaagtaatgagtggacttggccagactctaccggggcatctcgccccaaatggccagcagtcttgtgtccatggagaaatctagaccaaccatttcacagcacagacctatgaggatgcagagagcagcctggcaggtctaagtctgtgcctttctcccccttggaagacacactgatttcctgaatagatttacccaccatttgggagagctgaaaatgggaaggacaactttacaagcttcaactttacccaaagagactgactcatgcaaaaaaacgtgtaaaaccaatcctatggggagtgaaatgttgaagaaaccataaggaaattgtctatttcctttaacagttagaaggactagggcagcttcccttcctgtcatgggaagtgtggctcctacgccctctgggagagtggtttgagaagtgtttccgctgtgacttaaattatagccatttcccgagcaggcagcccagggactgtggtaggcagtgccagctactcggagtcaattgaaagggaattggtcgcctgggaggtttctaacctgatttcaggtttcctggacaccgcgtcctctcctgacccaacacctgctgtgacagatagatgtttgtaatgaggtgaataacaaacagtctcatgaacattaggtcacatggaacaaaaggcacactggcttaggtggagcctgcattttcctgtttttctaatacatttctctaccaagtctactcactcgcggaaagctttggcaagatttttaggcaaagcctttaaactcacatttttttgaagaaaaaaatgtttgctatttcatggctgaaagagagactcaattctgctgttacattcagaaatctgtttttttgtttttaaatgtctgtttcatacttaaaatctcagaatatcttactgagaccagctctaaagtaaactatttcaccacactcaaagaagacccaaccatcataataaaaggggcagaaagaaacattgggaggtgatggatttgttgtaaaaatgaatgagggccaggcacggtggctcacacctataatcccagcactttgggagcctgaagtgggaggatcacttgagccaaggaaatcgaaatcagcctgggcaagatagtgagaccctatctctaaaaaaattttaaaaaattagctgggcatggtaacacatgcctgtagtcccagctactgaggaggctgaggcgggaggatcacttgagcccaggaattgcaggctgcagtgaattatgatcacaccactgcacagccagggcaacagagcaagattctgttttaaataaataaataaatattaatgaataaaatcaaatattcctaatagacaaactggcttttgacttttctggtggtatttcaattgatttttcctgtagcggaattcataggtgaatgcctgccacagcaagggtccagtgtgaatgaagctttctatgtgatttgtaggtttttcctctgccctgatgtgactaccagaagtggggttcagctgggagttttagaaatgactttttctttttatttaaattttgtgcctaattatattcttagatgtattggtcagagctttatcatgatcattcgtatatctacagtccctcagtatttaagtcttattagcaaaagtaaatgtgaaaaaggtattgtgtgagattttacaacagcccaagatgaagagtatagatgtgtgtggtgtttgtcgatggcattatgcttctatccttgttctgacaggattctggccttttggaacattctgtctaaggattgaagctaatttagttgagaaacctaaatattacatttcgagaatgaatttaacacctagatttccaatcttgaaattacaatagtcactcacttatcaaagagtagagtagaaaatagttctttccttttaacatcttttctctcttaaaattggaggacagggatttataagtagtgttccatctatccatccatccatttatccatccatccatccattctttcatccacctatccacctatggtatgtacttgcatgtgtgtgtgtgtgtgtgtgtgtgtgtgtgtgtaaacatatttaaaaggcaggtttactcattgcttttggtacagttctctaaactaaagaagcttatgttggtacttttattgtccatgaaattatattatgaaacaataacaggtaggaaggatgggttcccataaatatcctcttactctctttgcattttgtatcatgtgcactactaatctcttacatttgttaatccattgctatggttttgacataagttggactgacaccttcatttagcagatgtagaaagaggcccagagaggtccacttacaggcaggagtagggccaggccagaaatctagtctcccgtctttttgcttttcttagcaaacagattccccaatgagcagacttgattgtgtcttgctgcacagcaatccacactaaccatacaggtgtaatgtccattatctaaaaaccccagtccgctttgatttcggatcatgtgcttcccttctctactgtgcagatgtcaggtaaacaggtcatcgctgcactgcttcattgtttgttccagtcttcttttctctgggttccttcctttattcattttcagctgttatgaatttatacacaattaaagggggagggaggcatattaattgaaaaattgatgacataaccttgagggctttgctttaattacctccagtgtccaggaatgacagttcttcagatttatcttctcttccttaatagaggattttcccactggacagacttctggcaatatctggtgttcagactgtagtgccatgctctgctatttttattactcacacaaaagtgcgttgatgggccatgggcaagttaaatttatcatcttgcaacggtgggatgaaagagccattgctaaccctggcaaacctaaggtgtacaatttcacaaaattacatagatggtaagaggtggtgttgacacaattggagctgacactttcatttagccgacgtggaaagaggcccaagaggtccacttacaggcagtggtagggccaggtcagaagtctaatcttcagcctccttgctttgtactcccgacctcaaacccgaccactctcttctcccaaccataatgcatcttagtgagttacagtacaacaaaagatctagaaatatctgactattaaaaaattatctgctgatcataaaacaattgaaaacatagagaagaatttagttaggggctagatgtagtgtttaaaatttgaaaatcaatagttttcctctatagcatcaataatatctatctgtctatctaattatgtataatatgaaacaaaacaacagaaaccataagatatattaatagaacacatataacctgtttatagatattcctaaggaggattgtggcaaagattcctggaagtgatatttaatggtatcttataaaatggtagtgaagagaaaagtaaaacagtggcaaagaatatgaaagatgagataccagtgtataagagagcaataaataattaaaagcaaacaaatgggaaggaactgatctttcagaaaaaaccaggagatacagctaagtgcccagagcacaggatcccatctgagagggacactggaaagagaaaaccaagggaggtaaattatcaaagaaatattataagaaacattttcacaactgaagaatattaattaccagactgaagggccaaactgagtgcccagccacaagaaagaaatgacccacacttaggctccaaactggaaaattttggaataccaaaaacaaaaagaatttttttcaacatttccagaacaaaaactaccactcacaaattgaaagtcagaatgagatcaggcatctctacagaaaatgaaagtttgaagagtaaagcaaagcattcaaagtcctaaaataatttaatggggaattctgaagccatactatcaagccagagaatagaacaaaaacatgttcagacatacaaaatactgtaccatctatatatttttctaaaaggcaaaacaaattctgttctttctataagcatatatatgaatatgaatgaacagagaatttctggacatctacataccaaacttaaaccatggtttacctgggggaggggactgggattagggaggtggccaaagggtgctttgcagctatccatattgtttgtttgcatgtgtttactgaaataatgtaattatgtattatctgggtgattaaaagtattcttcatgttaatgcaagataatccattagtgataaaagttagttttaaatgagagcttgtttgaaattctaagctttcctctaactgttcatctggaaccacttctttcaagtgccctttctatttctagctttaaaaagaaatccaattcaggctaaaaggagccattatagtttcttgatatcatcacatttctgttaatgagcccttcaaacttgattggttcttagtagaattacagtgattctgaagcaatcctgaagtcacctgtttccctctgccatagaaaatgccgcatctgttgctgatataatctaagataacaaaatatcaagaaaacaaaacagagagacctgagcttccaatgaaaactctgtataactttttaaaatatgtttaaatgcatcaatgaatgggaaaaaagtagagaacgctcagaggacaaggtccaagtgaaagcaggtaccagagaggtgagcagagcatgcaagctgtcctttatcttgaaggtgtctatcagtgtcagcttggtagaacttggtattgaaacttggtgtagaatagaggaggaaaaaattctccctgagaattcatgattgcaagctggtcctcactggggggtttgaagcctgaattcaccccacctgacaaactcagggccagactgaagggccaaactgagtgctcagcaacaagaaagaaatgacccacgcttaggctccaaactggaaaatttcagaataccaaaaaacaaagagatttaatttaaatctgtctcatcctggaaatcctctgggctcctgacataattaatcagtttgtttaaaaaggaacccatctttaaaccagaccttaaactattactacagataaagttccaggaaattcaccacatgaaagcaatcacaatgaatacgaagaaagtccatgagtgagaaagagcaaaaataacagacagcagaatgacccctacaaaaacttgagattttggaattatgagaaacagaatattaagcaagtacttttaaggttgacaatatgagtaaaaagcaactgactaaaaaaagcgatgaagcacatttgcaaacaaacaaattgattctctataagtgaaaaatatatttaaaatgcaatgcatagttatagcaacagaaagagaattagtaaatttttagtgatctatataattagcaagaatacagcaaagtatcaaagacatggaaaatatggtagagagatcaagaggcacgaaggatagaatgagaagaggtgagagcaaataggtacaggagattatctgaagaggttatgtttcagaattaataaaattaattctggattaattcatagattcacaaattcatagattaagaaatctcaagcatagtgtattttaaacaatgccacatctaaatataagtatcatatttaagttccagaaacacaagtatcatttaacaatgaaagtaataaagagatttttagcacagcccaggaagacaaaagatggggagcaaggatacagtgaggactgagggtttcccaccagcaaatcttcactaaaggaaatcatatctccatatgctagtcagacaaaaagatgcccactattatccctttctgttcaatgcagtaagacaagaagaataaataaaagatacaatgttcagatattaaatgaaaaaatatttgcaaatgatgtgaataactattcagaataatctacagataagttaatgagttagcaaatatgctgaatataaaattaatttataaaaatccatttcatttccatatataagcaacaggcagctagaataacttaaaaaatatataacatcataacaagtaaagttattattgggtataacatcaaacaaggtctattataacatgcttatgaattggaagagccaatagcataaaaataagttctggccaacatggtgaaaccccgtctctactaaaaatacaaaaattagctgggtgtggtggcatgtgcttgtaatcccagctacttgggaggctgaggcagtagaatcgcttgaacccaggaggcggaggctgcagtgagccaagattgtgccactgcactctccagcctgggtgacagagggagactcagtctcaaaaaaaaaaaaaaaaaagttctcccaaattgatctatagattaaatgcagtaccaaaaaaagtcaacatttgtagaatttgacaagctgattccaaaatttttatggtaaagcaatggcccaggaattaccaagatgtttctgaagtgggacagaacataaagattcatcacatatcaaaaatcattctgaatatgtagtaattaagatattagtgggatactggcagctttaacattggcacaaatatgtgatctatgaataagcgcacactgatgtgagaacttgatttatgagagagatggcactggagacatgtggagaaactcaggcttttcaataaacattgaaagaactattattattgatatggaaaaaaactaaattggattcctacctcacctcacacacaaaaatcctatctatgtggtttcaagaattaaatatgaaatataaaactataaatctttagaatattatgtagaatacctttgtgcatttgggaaaaggaaggtttttctttaccaatatagaaaaagaacaaaatttaacagaaagattgataatttgggctaaattgaaggtaagatattctgttcatcaaaagacactttgaagagagtaaaaagacagataactcctacacttaaaacttaatcaaaaattagtgttatacatcatcctttgctaaccatgagggatttgttctaggacccaccccgcccagataccaaaacctgcagatgctgagcacctgacacaaaatggtgtagatagtctcaaattgatttccagagggtttgcaccaatttttacttccaccaacagtttacagttgtcccagatgcaccatatccttgaaaattacttaatatcattagacttaaaaataaaaagtagcaaaacatgaatccctggtttagttggttaaataatggtccctcatattcctaaacacttcctcagatatgccagtgtagaggtataaaatagtgtaacactgtggtttatttatatgtattataaatatatattatatatagtaaaacctattcatcctcctatatatattaaatcctctccagattacttatactacctaaaatgccatataaatacttgttacactgtattggttataatttgtattatgttttatttatgtttttttttttcaaaattttttgagttacaattgggtgaataggtggatacgaattcaaccagcagatacagagaacccatggatacagagtcaactgtattatatagtattatatatactctatattatagtaatatattataacatagtattatattattatatatgaaattcctacagattaagtgaaagacaaacagtagaaaaatgtggaaaaactcaaacaggtgcttctaatatggaaaaacacaaacgattggcaacatataaataggctcaagctcattagtaatcaaagaaatgcacattgaaaccacagtgttatattattttatgccttcagacaggcaaattttttaagtctaacaatatcaagtgatttgcaaggatatggtgcatctgggacaactgtaaactgcaggtgggagtaaaaactggtgcaaacactctgaaaaacaatttgagattatctagttaagttgaaggtgtacagtcctataaccagaaattcctcatcaaggtagaaactccctagagaaattgtagcatatgtgtatcaggagcgttgtgccagagtgttcatagcaacactctctgtactagaaaaagaaatgaaaaataacccacctataatagtagaataaagcaatgttaatatattcctacaaaagaatattacacaacaactaaataaatatgacttgtagctacacataacaacttggataaatttcatcatcaaaatatttagttaaaaaaacaagtgggaggaaaatatatacagtatgattcaatccaataagtttaaaagcatgcaaaatgaatcaatattttagtatacaaatatgataccaatcaattttttaaagtatgagaacaataaaaccaaaaaattcaagactctcattacctctgaggagtcagggaaggagagaggattttataaactagtcagtaggtgtttatgcttcaatgttctttatatcttatgactattttaccctcttttatatgtactcaatattgaagagatcaaagctatcttgagtagaggtaaaagaaaaatttttttagttaaaaaatatatttaaggccgggtgcggtggctcatgcctgtaaacccagcactttgggaggctgaggtgggtggatcacgaggtcaggagttcgagaccagcctggccaaaatggtgaaaccacatctctactaaaaatataaaaattagccagacatggtggcctgcgtctgtatcccagctactcaggaggctgaggcaggagaattgcttgaacctgggaggcggaggttgtggcaagctgagatcacgcctctgcactccagcctgggcaacagagcaagattccgtctcaaaaaaaaaaaaaaaaaaaatatgtatatatatatatatatatatatatatatatatatatatatatatatatatatatatttaaatgacacttttaaaaatggagggaggagagtagttatgatatatcagtttactgtaagaataattttgacagatgggatattttcgcatgtcagcatcattcaaattttttattatgttaaactgattaacagtaattacatataaaaagtggacattcaagtcattcagataaagccactaccccgctctgtgggtttgtcagaaggtgtcaagtcctaccttctcagtaggcgtctacacagcctggcgctgtatccctctccacccgccccctcgcagtgtgcactatacttccactgttccagctctttgtctgtccccagatggaaccatgcttctcctgtttctgctgctaggccacaattcctccagatatctccacactggtacctttttctgcagttcttggttcaaatgtttctttgcagagagactttctcaaatggcagagtagtttctatcttttttccttttttttttcttttaatgtgtggcaccatcattctgaaaatatcttattcttgtgattacttgtttataacttgtttcgtccccacacaggggccgcgtctctgttatttctccaagcacctggcatagaggagatattcaacaactttatagaatgagttaatattttgcagactaaatagttgggcaatagaaggttgcatatatattcttattttttaaattggggaaacagtaaagttcagacccattcactttaaatattcatccaaaagatatttattaagcatttagtatgtgtcaggcactgcgctgcatactaagaatacagagtgaacaggaaggtagccaggaaccctgtgctgggaatggacaggcctccaggtgcctaagaagatcagagtaaaatcaggaaccaaatgatctggaagctaagttgccaaaatactgtgggtaggattctgggcatttttcttcaataattctatagtgatacctaaagccagtgtggagattaaaggatgagactatcagaggtaaggggagctttaggacacaaagctagtcattgcaccaatgccagagtttccacgagaaagaaaaactaaaaagcagcaaaacacaagtccctggattagttggttaaacaatagtccctcatcttcctaaacgcttcctcagatatgtcattgaaaaccccagctgggaagacccctctgagttccaagactgactaatgaaatgatatttctacctttgatctgttgcaataaaattaagatgtgagtagaagagaacagagatatctctataaagttccctgttacagctcagtcagccctttgtatccatgggttccacatccatggactcaaccaactgcagatcagaaatatttgggggaaaaaacggtgtctgtactgaacgtgtatagatttttgtccttgtcgttattccctaaatcattgagttaggtattatcattattccctaaatttacattgagttaggtattataactagcctagagatgattcacagtgtataagtggatgtgcaacgggcatatgcaaatactacaccccttttttgttttttgttttttgagacagagtcttgctctgtcacccgggctggagtacagtgacgcaatctaggctcactgcagtcttcgcctcctgtgttccagtgattctcctgcctcagcctccctggtagctgagattacaggcatgcgccactgcgcccagctaattttcgtgtttttagtacagatggggtttcaccatgttggccaggctagtctgaaactcctgacctcaggtgatctgcctgcctcagcctcccaaagtgctaggattacaggcctgagccatcatgccccgccagagccaccacccctgcctgcaccactttaaataaggaacttgtgcatccgtggattttggcatccaaagagggtcctggaaccaatcccccatggatgcctagggacaactgtattatattaggttgctaatcaattcgtgtacactttacccagttttataccatattcaactattgatatttgatttgacatacctgtggccatttttgaacaaggccattctgaactaatatgtcttgatgtgagagcatattccctagtggcatctttgtttctatggaatgctctgattcaatttatatccctttgatttatatcctgtttccatcagggaacaagctctcagcactaacgccttctacacaggaatgcctctaccatctctttcagatagttcagaaggcccttgaagatcttacacattctaaataccctgggacactttccaccatatcacaaggtcattacaattgtctgccagtgataattttgttccttaggttccttaacatttactcctggttctcggtgggtttgtcagcatctcacagggttggcaatgacacccactatacttctctctatcccgccttggggaatcagtttaacatcttatctccttgcttgttggaattgacacatccagcattcagactgtccatgctacatgtaggataaccaacaaacaaaattgcgttttttgaaacttaaaagctcaatacctttatttactattagactgcagattgttgggcctgtaagtaggacacacattgcctagagtggtccggctctgtcctttgccatctggctgcatgaatcaatgtcagctggatacaaatatatctctggaaaggggacattgggaaaaagggtggatacactaagcatagaccccagaacctgttctcagaaaaatattttcatggtaaatcctgagatattaaaggacaggtttaaaatgctggctgcatgctttctctgtcttttattttcattggatgctagaatttgaatgggccctgtttctgctttattaatccatattttgtggcaggagaaattcaggagaactcaggaatggcaggaagtggatgagaaagagtgtgtgatagaaactgcaagtagccttaagggcaaaacaagaataatgctactgagatgatgaggcttgcatatccagctggctactgtattctggccaccagaattggatttcagcttggattttcgaggcttagcagtacaatgaggactgggattcataaattataattataagtgttatttattaaaaggtagttttggtctcagaaggaaccaaataataataatgcatgcatcactgaaagataaaaatccataaaaaataattggggaatatgagataaggggaaaattgagaataagaataaaaaggtaacttggagtaagggaggaaaaattagtaagccaatcataacacacaccccataacatcctggatattggttgatgtctggatattgagttcatgggtcaacactggccacagaggtgaagcatcattggagtagcttgggcttgcaaggaaggttggcattatatctcttcccatccccagatgccaccatagactcacctacactatccccaggtcctcattgtactcattttattcattcacacgttttttgaatgtattcaatatgccagtgaccaagttctggagaaaccatactttgtaaaaagtagacattgtccctgctccagtgaaatttacccccccaaaaaaggagagaaggaaccaataaacaaatgatctcctgaactaattgtctagctacaaacccagacaagttatctgaaagaaaggagcatggtgccaggaaaacccagactggtctgagcaaggtaggtataggggatcgaagatcaggcagaacatcttggagcaagtgatatttgaactaagagccaaaggctgagtaggaattaactaggtaaatggtataaggtctggtagagtgagaaagagtgtgtggatgaagagaaaccctttcagatacggagaataatacacgcaaagtccctgtgataggagggaccatggtgtgtgcaaggaactgaagagtcatggtagatagaccacagagcatcaggaaaagaatatacaatggagccagaaaggtagacagaaatgaaacccataaagccttggctgctgcattaacaattttggcttttatcctaataagacttaaggctggctgaaggtagtgatatgatcagatttagactttgaaaatatttttattgattaatgtggggagcaaattaaagggtagaaggggcaagcgggttgcaaaagattagctagggatattatgttagtgcaggcaagagactctggcagtgtggagtcggtttatgacagtggtgatggacagaggtagaaggatgtgagaaacagggcctggagccggattggctgtaggatacagggaaagggaggagtcaaggaattgcctagacatgtggtttgtgcaactgagtggattttgactcccattcctgggctaggtgtcaaactgccaaactgggaatgagggggagggagccatgacagcaacgttggacatagtatgactgagatgttttcaggcatctagagaagtcatgtggatggtgaaatgtaccactttggaattgagaagagaagtcttagctggagataaaagatttgtgagtcatacataaaatggaaggaaagtggagagaatatagcatgacaaagaaaagaaggcctcaccaggcgcagcagctcacatctgtaatcccagcactttgggaggccgaggcgggtggatcacgaggtcaggagatcgagaccatcctggctaacatggtgaaaccccgtctctactaaaaatataaaaaattaggtgggcgtggtggcaggcgcctgtagtcccagctactcgagaggctgaggcaggagaatggcatgaacccgggaggcagagcttgcagtgagcaggagatcgcgccactgcactccagcctgggcaacagagcgagactccgtctcaaaaaaaaaaaaaaagaaaagaaaagaaggcctcagatggagccatggagagttttcaaggagcaactaggcctaggattattctaaactcagcactaggattgtaagggcaagtgtttattttctcaccattaacttaaacttcttctctattgttttgtgttacccatgacagaaaactctcactcatctctcactctagaatttcctcagttaaccctaaatcatctttgccaatgatgatagaagtttcactctaaatgggtttaatcaagatgaaaaatataatcgcatcattttataatgaataagacttcacaggtatgctaaatggttgttaccaaagtcatttaaataatagtgattttatgcgtctgtgtttcagtggttggcttctctggccttgacctgtgagctcagcatgaagtgctgagatttgatttaagatgacctagagtttatgtactgtcatttacttggaaattatcactttgcgtatttcagatgacatctcttaggtcagttttgcaagttcattatttcaagctgtctaaaggaggtataggattttgtaacaagtaattaaggaaaccaccataaaagtttaagtttatactatatgatagttttcattatccaatgctgcattttttgtaatagacattgaataggagggaactatccttactaagtggtaggcatttttccccatgattatttgttcactgaatttggaagtgatggaattccaatgaagagctatatcaggatcatatgcacatgtgcagtataggtatttgcatttgctatgtgtgtttccctgtgttcgcgatgtaatatataaaatcaagacatcaactgttgtctccccagagttatggctatataacttaagcagcaaaggaaaggatttaggggtccattttaatgtaggcaagagataagaccattttttcaagttaataggaaagaaaattatggagctgtactgtccaaggtggtaaacactagccatacagggctatttaaatataaattattgaaaaattgaataaaatttaaaattcagtttctcagtcacactagcacatttcatgtgctcagtgttcccatgtagctagtggctgtggtattggacagtgccaatatgcaacttttccacaattacggacagttctattgaatagtgccaaacaagaacagggttcaaatccaggccagtgcctctgtttgcacagccagtgcactaagaatgattttgacattttgaacggattgaaaaataatcaaacgaagaagaatattttagagcacatgaaaatcatttgagattcaaattctaatgtcctcaaaatttctattgagcacagccatgtgcattctgttatgcattgtctatgtgttcacactacaacagctgcattgagtagttgtgacagagactttatagtctgcaaagtctaaaatatgtactccctggctctttaagaaaagtttgttaactcttgagctaaagggaggaaaggagtagtatcacacattaccgtcataaaaaatattctgtatagatttggaaaatgaagtcaataaggagaagggaaagtgtatctagaattcatgcccagatttgatggctgtgggatatcctgcattggggggtgtgatggtggatgggttgaaagctctggaaacgttggcaatagcctttaacatgtatccaaaggctccatcaaaccctcagctttctcagtgtctttgcaggttttttaggatactctcaaaagctcacttctctctgtaattcaccatcttccccattgtaaaaggcaaattaagtcctctcaaaagtttgacaatatgaaacaaggaaattcagttagtctcttgacagcaatgccaattatcttccttttttttaaacattctcttaggcgaatgcctaagacaatggaaaattattttgcagtgagacccaagccaatccagacacaagctgctctcattacaaccatctcttctcatctcttgaggatgagctcactaataagagtacattatctcttattgggacaggcttaaatacatgcaagaacttcattaagtcattctctatcagaataggagctattgagaatttctgcagaactaggattgtgtcttctctacctatgaaatgagtggtgtcatgacaaagcactctagggagccctgccaacctatttgataatgttgatggacaagattgtatggggagtggggagaaaaaacaccttttatattcttccctgatgtatgtataagtagttctttaggaagagatgaaatgcgtggctttgtcctgaatagattcccttaggggacacccagggaattcctaggcccagtggaattaatgttctagaaagagaatcatgcttctgttgcagagcccccttcttaatcctcatgaatcctagttaataacacatataataaagtattcttattgatgcctgtaacttcctttgaaatgcacccaaaaggataaatgatatagacatatgctaaagcaagtatggtgaaatgctacgggtggaatctatgtggtaggtatatgggtgtccactgtaaaatgatttcaactcttctatatgtgaaaagattttcataacaaaatgttagggaaaaaatcctcctggaatacatttcatgtaagcctctaattcctcagcattagccacaagcagaactgtcttcaaaggagtaaatcatcaggaaaagtccgtgaccccaaaagagtgctgtccaggttttctcaggcatggctcaggttcaggcacaaatgcaagttcccagttcccatctcctcagtgtgtgcccgctgacctccctgcaacagttctgcccattgaccagtaggggataattcagatgaacaccttcgtgcttggaatatgagcacttagacttctagattttaaaaggatttctgagcccgatctttacacacatgctttagtttgtactgtctttctgtacatcctcagttaagagatgctttctggagtgttttgtagatggatttgaagacttctcactgcttcagtacagaatgccctggcaatgcacgcctggaaggagtccatggactgatattttctagccaaagggagctaaaaatcagccattttgacatttggatttttcattgatgtgtcttgtttatttaattcaatttaatatgaaagagtagagagggtagaacaaactgttcagcaacgtatagatcattaggttttaaaaccaaataaaaagtactcagtgtaaaaatttgcctgactgaaaggattttgaaattattcttgaaagctctgaagcacgcagaggcagctttggatgtgatggatatttttgctgcatagagtatccagtgccaaagagatgattctgtcagaaaatattacgaagccaacctagctttgataattgcttcagattgtctacatatataatcctaaatctcttttcaaagtacttacactaccagtggtctttgatttataactgctggtccaagagatggcctactaataatataaaacagggtcttagcttcactgcgtatcgtttccagaggatgtgaatcttaagtcaatataagagatgtgtgagtaggaatgagaactcttagaaatcataggaaggggttcaagtcacagggaacagcagatgtagctggcctaaggcaaagggaacagtgcaggatcagaaagaagtccattccaatgaaaagagctgagaccaagggaaaccataatggggccagagcatgcaagaccattgcaagaagcatcaagggcttggagctttatccagaagacaggagcagccattgagagggcatgctccagcttttgttttagcagaatctctttgcatgtgatgtggaaaatgaattggagaggggaaccaggaaacctgttaggaggctacttctgtaatccatgaaatggcaatattctgcttttatgtccctgagaagaaagcataggtaaggaccactgaatacacatttggtagaaaaagaatattccccggctaaggattgggaagataaaacaatcaggaccacccacccattacttcattttcctttatgtatccgatcaagtaccctttctaaaagaaggtaaactttacagttttttttttaatttaagcatctcattagaacctactgaatatgagtctccatgtactaattgtagtaaaatctctctgaaggctggcatcagtatgtctgggcaggatgtatattctagcccagattttgcatagatgtcacaaggagtccagaatcccttgattttcagacatagccattagaagcacactgatcttcacaggtggaggcctccactgccatcagtctattactgctgcttaaattcacagcaccgtggacaagaggagaaggtagcctagctgtttcattggcccccgcatctctctgccacatgatggacagccatatcagattgcattagaatgttgactgcatgttaactggtgatccttcttcctctcaatacttattttaaaatcactctaaacgccctgctcttattactaattagattatttggccttggtgtatagtgtcttggggtcatcagtatgaaggtcaagtcacgcaaaaagagtggagtctccaatgtggatacacccaggaggtcactctctccccaggctgtgtccaagtagcataggggagcacagggctctgtccccatgatgtactgtccttttccatgacattggagatgaagctggacctcaactctgcacatgcatattcctacaacttctcagagtcctgtggataatgacggaggagagaaaccatgcaggaaacagccccctagagcacccaatctggatctaagtttgtcttacatgtttaagaaaaatttgctttaatttattttactgtattaattgattaatttttaaagaaatagtggagtccatcactaagacctcaggccataccttagatattgagatgttgaataaatcccaccagtttattttattgtaatgtgcctcatttttcctaaaaactaaaccccaaaatataaaagttttcgttgttacttatttatttattttagagacaaactctcactctgtcacccagcctggagtgcagtagtacagttgtagctcaccatagcctgaaactcctgggctcaagcgatcctcccacctcagcctcccaagtagctgggactacaggcacataccaccatgcccagctagttatttatattttgctaaatgaatttttgaaataaatttcacagatatttccccattttcagttgaaatttaattttctttctttctttctctttctttctccctctctttctttctctttctttctttctttctttctttctttctttctttctttctttctttctttctttctttctttctttccttctttctttctgtgcttctttctttctttcgtattgctccttgtgtagcagggctatcccataggcagggtgcccagggtagtgaaagtttaattttcagagtttttaatgccagaatccgacttatgaattcactcagtagatattacatgtcactggcatatgaccttttaatagatattttattggcctaggaatggtaaggtcagagacttgagtggttccacttctaacagcaaaaagaaactatttctggctataataaaatttagcatcttaaaatttaaatagaatagttgtttatacttactcagggaactggagggttatatgggatatttaaataaattgtggaacacttggtcctgaaaactgcccattataatactttaaactaattaaatttcatttaaaagtttcaagcttcctgaacatcagggaaacgtgaaaatacagtcatgggttatagagactagcatcaggaaaaacagccagaaattctgaacttggatctcttcgcatgtccttgttctgcttaagaaattgcttaagagatgaccttgataacattttaaaaatttgagtgcgaagtgcaatgtattgcctttccatggattagagcacatgataactcttgagccagattataggaatccctatcataagattaggagaagtgagagaaaagaatcagaatcgaaagcctggcccacaggtgactcccttgtctaaagaaaacgcttggtcttgctttcagcacatggcttcctgaaaacgaactttaccttaataagtaactgtttaaaactttacttattaatttgaattagtttgagtccttagggaaccctgcgagggtttagttgtcttgattacaaaggcccacatccctcagaaagtaccctcatgtcggcagctggacaaccttaaggattgtcattgtggaatcacggcacaatccaatttcttatctcactgttatgagttgagtggtggtcaccaaaaagacatgtccttatcctgtttcctggaacctgtgaatgttcccttgtttggaaaagagatatttaaagatgttataaaggtaaggattttgcaatgaggagattatcttgggtcttccatgtgggccctaaatccaatgatgtgtgtattagtctgttctcatgctgccaataaagacatcccagagactgggtaatttataaagaaaaagaggtttaatggactcatagttccacatggctggggaggtctcacaatcatggcggaaggcaaaggaagagcaaaggcatgtcttacatgacgacaggcaaaagagcatgtgcaggggaactgtcctttataaaaccatcagatctcatgagacttattcactatcatgagaacagcacaggaaaaacccacctccatgattcagttacctcccactgggtccctcccattactcatggggattatgggatctacaattcaaaatgagatttgggtagagacacagccaaaccatatcgatgtatgtccttaaaagagtgaggcagggagagatttcacacagaaagaagaggaggaggaggcaatgtgtccacagaggcagagattggagtggtgcaggctcaggtcaaggaatggtgacagctactaggaagtgaatgaagcaaggaactgattcccccaaaggagtgtggccctgctgacatgttgatttcagatttctggcctccagaactgtgaaagaatacatttctattgttttaagccactcaatttttggtaagtcaatatagccgctgtaaaaaactaatacgctaacaacgaattctgtttcctccatttattcataccttccctaatgtctgcttttccaggtgaagtatctgaaaggtctttttcccttccatgctcttgcccatccttctggaatattctctgtggcagttatgcagacctttacaaccacatttcttgtgggttgtatgtgtgaaatcttcagagctcagaaaaaaaaaatctgatcaaaagcaacatttgaactactgaatttctttcttttcaagttcattcattcaatattatttgttgaataaatattcagcaaatatttattgagcatgtactatgtgccaggcattgttctgcatgctggagaagcctggggaagtgaggggaaagatgaacaaaaatccctgctcccattaagttttcataggcaagcaatacataaaataaagaggtaaagttatagcatgttggatgtagtaaaaagaaactacagagaattaagaaagaaagagggatagggaatagttttctggtttaataggatgattatggaagacttcaccgagaaggtgacctccagaaaggagatatatcagtcagagttcccccgagaaattgaaccaataggagatattcacccttacatatgtatgtgtatgtgtatgagatttattgcaagggaattggttcatgtgattatggaggctggcaagtccaaaatctgcagagcagatgtcccagtttgagttcaaaagccacaggctgctggtcagcacagtggctcacacctgtaatcccagcacttcaggaagccaaggcggccagatcacttgaagtcaggagttcaagactagcctggccaacatggtgaaaccccatctctattaaaaatacaaaaattagctgggtgtggtggtgcatgcctgtcatcccagctactcgggaggctgagacaggagaattgcttgaacctgggaggcagaggttgcagtgagccaagtccgcgccactgcactccagcctgggcgatagactctgcctcagaaaaaaaaaaaaaaaaaaaaaaaaaaaccacaggctgctgtagaataaaaaagaaccaatgtcttagttcagaggccatcaggcaggagaattctttcttactcaggggaatgttaacctttgttctattcagaccttcaactggttggatgaggccctcccacattagggagggtaatctgctttgctcaggctactgatttaaatgctaatctcatccaaaaacaccctcacagaaacattcagaataatgattgaccaaatatctgcgcactctgtgtcccagcaaattgacacataaaattaaccataacaggagaggagttgagtgagccataagggatctgtgggaagagtaaaatttctaggaagagtaaatttcaaaagctaagggcctggcttgttgaacaatgaggcagcaagtgcaagagggactgagagccacaggagatgagtagcagatgaattcggagtgcccttgaggtgaggctggtagcaggcttgatagaccatggacatggctttttgtctgcttttggttattttgttagacctatttcagggtctccaccgttgtcacattctttcctttttaagagtattttttttttctggttatacccatgaaaccttattttaagtccctaaccacaggctttagagatctatgctgtataaaaagtaattcatccaattctattatgacttatatatagcaatctactcatttatgaaacaaagaattccaggcatatcttgttttactagcctgtcctgagtattgtggttcgaattcatttgtggactcttgagtagggctgtctgtctataatgacaatgcatatacatgtagaaccagcttatgagagtttatgttttataaactgcataatagatttaaaagtttctccatacatatttcatgattcccacctcagagggcacaggaaatggtccaaagcagacgactctaacttaaaatgactgacaaggcatctgggtcagtgagctttggctgcataacaaaccacttcaaaacttagtgacttgaaaacaaatcactgttgagacaataaccatgttactgctcacaagtctatgggtcagctgaacctttctgctgctttgccttgggcttcattgatcccagctggtcttaggcaggtatctgtgttcagctagcagatcaactgaagtctggctagttgaggatggtcttacctacctggctggcagctgactggctggcagttgggacagcaggagtgacggggccctgtgtctctcttcttctagcaggctaatcaaagcttgctcaaaagcaggagcatagacttcttaaggcctaggcccaaaactggcatattgtcactttgaccacattttactgtccaaagcaaaccccaataactgcccagattcaagtgggaaagaagtagactttaagtgttaataggaggagctgaaaaataactgtggccattttttcaatctatacataatatgctaattaattgtatgtgttaacttgactggtccacagggtgcccattcacttggtctgagtctgatggcctgagaatgaggagagctgatggggtattacacacacacacatacactattgattctgtctctctggagaaccaagactgatacagatttttgtcccaagagtggttctagaggaagagaatttttaggatgagtttcctgaattggttctgaggtttctggcattggttctctcatctgattaggtttaacgatgctaataactctgtttccattaataaagagggcactgatagatagtccgtggtgtactctgtcaatagagatatataaatattaccattggatactcctaatcaaccacttataagaagcaaagattttggtgactgtgtatatgatgcttttgaacatgattggcaaagtaacaaatgtaaagagattggcttctattgtcatcgaacaaagaatgagctcagggtttgaattcccaggtcaaatgctgcatacatgatctcaaagctgctatgtctgccctcgaggagacctttatctcctatagccttaggactaagatcactgaaaatcaaatgcaggatctcatcctgtgactggctgaaccaacacaatttgaaccctcagcctcacaaggtgtctactgttaaagtcagtgtattaactaggaaggaatgcgttgctcaaagttggaatggagatcagcttcagccccgatgaagctgaggacattgagcccctaaattatgatgagggttctttgccagcagaagagccctctccagcctcttctaaggggattaatcctgcatcaccagaggaaactctaagggcctccctcaaggcagttgccatgcaagatgatgctgattctattcaggacccctctttgtttctagacctgtaactacattcaagtccaaagaggcccctaaaggtgacgtacaaagtgcaactcatgaggatttatgctatactccaaataagtattaagtatttaaattttctaatttataatagaaaagtttggaaaactgtgagggaatgcatattaagaacataggataatggtaggagaaacacaaattagatcaaaatgaatttattgatatggataaaggaagcagacagcatgcatttaattttgcagctcaggcatttggaaagtgctgtaatagtttgtttagtcagttggctgaaacatgggccagaaggtcacccacagtgagcaagttggaaatgctgaacttcccttggtttaatgtagagggagggattaaatgacttagagacattgggatgttagagtgggtttgtcattcaagaatgactcactcacattgggagagtcctggagacatacctttcaccataactgtgggaagtaagtttgtgagggagtcccagcatccttgaagagctctgtgacactctactctgtaggccagaacttacaatggaaactgcagtcactgaattgagaaatctaaatgtaatgggaataattggatcccagggtggcaggggccaagtggcagcactcgaccgtcaaaggcaatgtggccgtgattaccatgatgaacagtggagtcaggcagcaaccaaaattctctaactcacagagaaccatggcactggccagttgatcatggtgttcctggaaagtaaaagagataggctggtgactaaattcttttttgctctctgtaagctgaaaatttctatgtcaaataaaaaaaaaaaaaaaagtattacctgaatcatgaaagcatagagtcactatccttcaaggaattcccatacttgagccagtttatagacccaaaaccctttcaatgaaggggaggctgagtctctttgaggaaagactcctgtatattactgaaaatttatactgttcatctttctcccatccttctccaaatggacctatggtgttttaccaggtgactatgcattggagaaaaggaaataatcagacctgttggagactactgaccactggctctgaactgacacttattccagaaggcccagtatttcactgtggtccaccaggcagagtagggctaatggaggtcaggtgatcaacagagttttaattcaggtccatctcacagtgaagttcatgagtctctaaacttatcccgtggttattttcctagtctgaaatgtatacttggaatagataaattccctgacagaactgctatattggttcttgtgacctgtggagtgagggctattacagagggaaaggccaagtgggagccactagaactgtttcaacctaggaaattcgtaaacgaaaagcagtaccacattcctgaaggatggcagagattagtgctaccatcaagaatttcaaagtcgcagggctggtgagtctcactatactcccattcaacttacttgacgtgcagaaaactggatgatggagagtaacatggaaagtttaaccaggtggtgactccaattgcagctgttgtaccagatgtggtttcattacttgagctattccctggtacttggtatgcagttattgatctggcaaatgcctttatttccatccttgtcaataaggctcgtgagaagcagtttgctttcagctgtcaaggccagcaatacacctacaccgtcctacataaggggcatatcaactctccagccctatgttataatttagttcacagggatcttaattggctttcatcactagtccattacatagatgacattatgctgattggacctagtgagcaagaagtagcaactactctagttttattggcaagacatttgcatgtcagagggtaggagatatatctgacaaagtttagggaccttctacctcagtgaaattcctaggagtccagtggcgtgggacatgttgagatattcttctgaagtgaaggataagatattgcatcttgcccctcctaaatcaaaaaagacggacaatgcctagtgagcttctttcaatttttggaggcaatatattgctcatttgggtgtgttactcccactcatttatttagtgacccaagaagctgctagttttgagtggatcccagaacaagagaaggttttataacaggtccaggctgctatgcaagcagctctgtcacttgggccatatgattcagcagatccagtggtgtctagatttaatattatgtgtcatgtcccaataaagcttggaagtagatcttaacaccattgccatcacccacccacacacatccctacaagtgaagaaacggaaacctcaaagcaggtaagtgactggtcacaaaaatcacaggtaataaagccaggaatcaaacattatcgcagcatgctagaaagcctatctgcttttgatttctcagtcacattattttttagtaattcttaaaaaaaaaaaaaaaaagccttggccaggtgcggtggctcacgccagcactttgggaggccgaggcaggtggatcacctcaggtcaggagtttgagaccaggctggccaacatggcaaagcccggtctctactaaaaatacaaaaattatctgggcgtggtggcacatgcctgtagtcctagctatttgggaggctgaggcaggagaatcgcttgaacccaagagatggaggttgcagtgagccaagatcgcgccactgcactccaacctgggtgacagagagaaactctgtctcagaaaaaaaaaaaaaagcttgtgtggtggactctaacctaatcagggctgatttatatgttgtttttttctcacatattttcctcaatgttctgttcatatcacatagaatcactgagaattcttctctgacattcacagggcccctaagtactgcttcacagactgaactgaagcaatattaatgggtctcttcctagataagcccaagcctcaagcatagccctgcgcctcagtcagccaatctagaaatagggcaagcttctaaagatgaaagggcacagtctctgcttttagtaatctcactagggcaatatagccaagtggaatgaagagatgagacaagggctagactgtgtgacatgggccataggttgacagaagctccaaaaatagagtgagtgctctgaggaagctacacagtagcaagaacatggtgagctgggtggaaaacaatgagttaggtcttgcaggatgcctggcaaaggtgggacgtctgtagagggactggcttgagcaaatggtctcagaacaagctgtggattccctcttttaaagttccagactttcataacttcactttggcctgcatgctttccttttggaggcaatatcttcataaatgccataagaggaaattcaacacagaaccctccactgatttcattttctatttgaatttggcagagacccctttaagaccgaatctcatcaagaaaaatataatctgagctacatattgtactaaatcacttcccccctttttaaatttgaaatcagcttttcttttatatatatttattttgagatggagttttgctcttgtcacccagctggagtgcagtggtgcgatctcagcacactgcaacctctgcctcctgggttcaagtgattctcctgcctcagcctccggagtagctgggattacaggtgcctgccaccacacccaaccaaaatacaaaaatacaaaaaaaatttttgtatttttagtagagatggtgttttaccatgttggccaagctggtctcgaactcctgacctcaggtgatctgcccatcttggcctcccaaagtgctgggattatagctgtgagccactgcacccagccatcagcttttatttcatatgcatgcatagcatcctacaacaataactttaaaaaaaataagtcatcaccattttctatgattgcaacctatatagagaaatagcctggtgttatcctacaagacaatttccttaaaatgtgtgagtaatggctattaaatcattttatggagccatttctaaaataatactctttgtcactgttaccataattacttttagttgtggccatattttaaagaacagaatgctttatcgtgactgttataaatacaaattatttttccccttgtgggaatcatcaggctaatttgtttaccattttccttctaaaacagatcattattaaaaggaaatcagtacaatgattgtgattaagatcaacagctctcttaattctttgttctgttgaatatcaagttttttctgccttcctacctctgtctttccgtaagacaaatccttttgctggcaaggggtatatgtgtgcatgcaactcctgacttatatctccactcttacacgtgtgctaattgatcttaaaattaaagtccaggatgccaatgaaggaaataagctctgaaccacgcaggtcacagtttctgttggttgtatttgtgtcagggagctgtcagactctgcagtttgaaatttaagttctcaatggactctgagcgcatatccttgatgtgtgattcacacctgtggtatcatcatggggtcattttattgaaatgttgaacttgtttgcaggggccttaattctttagctttctgcaaaacctagttatgtgatgtgttctctgtttggggataatagagagtaaatggaaataagacattaacattgcccaacccctattatagttggtgttaataatctttgcctataggtttggaagtaccttggcttatataaccactattcagataaaacaaggaaatgatgacatcagtgtaagattgaatgagatttgaccactgcacatgccatgctttgcaatagtctaaaaacctggacagaatgatcagaaccatctaactcaagcccagggataagcaaacaatcagtaaaaaatgcttacatagaaagcgcatgatattttaatatgaatttttaatatttaattaattttagtggctattgtctaccttttatcaaataaacagctatttattattagaacttcttgctaatgattactgattttgactgtttgtaagtctagccttacaatttattcagaagtgtggttttaaacacataaagtgcttcatggcaatgcaaaatcttctactgaagtgttttgtattatttcgatttgaacttaagagattatgtggattctgtacgtaataggttttattcatagacttgatagtgtagcaggacgagccgcagacaagaacccctcagacaccgagttgtagaaggaaagggctttattcagctgggagcatcggcagacttatgtctccaaaaactgagctcccggagtgagcaattcctgtcccttttaagggcctacagctctaagggggtatgagtgaaagggtcatgattgattgagcaagcaggcggtgcgtgactgggggctgcatgcaccggtaatcagaacagaacaggacgggattttcacgatacttttccatacaatgtctgaaatctatagataacacaagcagttagctcaggggttgatttttaactaccaggcccagggcgcggtgctgggctatctgcctgtggattccgtttctgccttttagtttttacttcttctttctttggaggcagaaattgggtataagacaatatgatgggtggttgcctcccttaatagttaaatgatttggcaataacaacaggccgaaatataaaagagaaaaatttaggttggtgcaaaagtaattgcagtctttgcaattgagagtaatggctaaaaccacaattagttttgtaccaaaatatgtatttggatatatattctttaattgatgttaacttacacattaagtttttaaaatattagaaaacctacaaaatctgggttgaaaatgagtatttgaacttgaagcatggcaacctttcacccattttgttttaccaaattgtaaataaatcataacctggtaccatcacctagacagaaattttgtggaatatctacactataaataatggaacccctgtaaagtagtaactatttcaaagttaggatctcctggctttggcaaattttatttttgtgaaaattaaagttgggcattggcaacccaataccttttagtgttccactagaacaaaattaaatattaggccagtaatttgatgcagtggtatccaaacttttccatttcatgccctaaaaattagacactcacaacccccatcataggcatattcacttatttgtgtgttcatttttacgttgtaggtattactagactaacacatgtgttcatcataaatgaatgtataatatatatattttaaatgataaaatataaataatgagaaagaataaagatgaaaataatgttttattttgtttgttaatgattcaaaacaaatctttgccctccatatagagagtccatgtgtttgaatagactttattattttcaaaactcctcacttaacactttgatacaggaatccaaaactctgatcttaagtttggattttcttttccatatttggttttaatggctgtcactgctggggaaaaaaaagattcctcacacagatttgaagattaaaatggaaggtgtgcatcctttgccgaggctactgcttcattacactccttttattcattcccatctaccagttgtaaaggtttgactttctgatggatgcttaatttttaagtgcctgctaattacaatggcttgccactttcattaacatgccatacacttaaggcaaaactcactgttagctgtgagaaagtaaatacatatttcaaacagtcttcttcataaaattactttttaaatggattctcctgcaatatctgattgttttcacctcagaatgtaggaaaggagaaaacgtcagctctcaactctgccgttgtccttttgtttgccgttggcacaattgctaatgtggttcatctcaatgtctttgcagggtttagtccatttggtgagggtttgtttggttaaaatagataaggtagcctgtaaatccattgaatctgagcatgtgtacactgaatgtgttgaaacaagctgaaaagtcatcgtataagcaagggcaccactgtccaagcccttgaacgtgtgggacaggccaggttccatggctaatgcctgtaatcctaatgctttgggaggctgagccaggaggatcactttagtccaggagttcaaggcattgagctatgattaggccactgcactcctgcctgggtaacaaagtgagacctggtatcaaaaaaaaggacgggggaggggaaaggtgtggtgccctcttctttcctcaggtctcaagccctgtaagtcactaacaaccttttaacaaactaatgtggtgccagtgtcaataggtatgagtaaagctaatttcccttacaagtgaaattctagtacacttttcccataatccaatagatcatctttccttttatcctctgaacatatgcatgcatcttaaaagactacggatttaaagtactagattaggccaggcacggtggcacacacctgtaatcccaacactttgggaggccgaggcgggcggatcacgagatcaggagattgagaccatcctggctaacatggtgaaaccccatctctactgaaaaaaaatacaaaaaattagccgggtgaggtggtgggcgcctgtagtcccagctactcgggaggctgaggcaggagaatggtgtgaacccgggatggggagcttgcagtgagccgagatcacgccactgcactccaacctgggcaatagagcaagactctgtctcaaaaaaataaataaataaaataaaataaagtactagattatgtttttcttcccaattaaacagatcatgagttcttttggtgactagggtgttgtggcattttggaggcaggaaagatacaggaagttcccatgctataagccttgtctctttgaacatatctaagcatattagatctgttaatttttgcttcatatagtttgaaggtataattattgggtgtatacatttttagtattgtttctcaaatacattgatctctttattatgaaatgttctttctgtattttcttgccttaaagtaatgctgttcgatacagtagccattagccatgtgcttatttaaatttaaattaattaaagaaaaatataaaaattcagccccgcctttgtgctagtcacatttcagatgctcaatagggctattggttaccctatgggatagcacagagaacatttccatcattacagaaagttctattgggtcgggctgccttaaggctacttcatctaatattaaaacaactatatcaagggtttttttggttgacaattatatggagaattaaataaatcctgaatcacagatgaagattttagcatatccctctctgttactaacaaaataagcaggaaggaaaaaaaaagaaaatcactaagcacacagaggatttgtttaacacaattaaccaacataatataattcacatatttaatgcattacattcaacagttatataatacaatacgcattaagtacgcaatgcggacacattggaagatacacctggctgccaagtgtcctgtagggaggtgttgattgtagagacacacagcaggggctatataattccataatcaggaaacccagcaaaactggtatcacacgaaggaattgcaactattgtattagtccattctcacacatctataaagaactacctgagagtgcgtaattaataaagaaaagaggtttaattggctctgcagcctgtacaagtagcatggctggggaagcctacaatcatggcagaaggtgaaggggaagcaggcacttcttacatggctggagcaggaagaagagaataaagggggaggtgccacatacttttaaacaaccagatctcatgagaagtcactcactattatgagaacagcaagggagaaatctgcccgcatgataaaatcacctcccagcaggcccctcctccaacactggggattacaattcaacatgagatttgagggaggacacaaatccaaaccatatcacctatggtttgggttttggtagcacaacactggtacaacctactactcagggatcctcaaactttaatatgcatgctaatcaacttgaggttctattaaaatgcagattttaatagagtaggtctaggtgcactttgtaacaagtacactttgttactgactttaaaacgagctcccaggtcatgctaatgttactggtccgtggaccacactttgagtaggaagattctaactcaaaagcccaaactagtagcttaaacaccaaatcatgacagaagctgtttcccctggcttgtatcatattgattaacacagtaaagaattagctgctgacatgtacaaagtgtgaagtttcacataagcataagcacctgaagcgtctcttgaagtctgggaagatccggccagggcaagtctgcttccatacatggtccatacaaaagtccactggagcagagtagaggccactagctttcgagagcccatgatttatccttcaccataagtcccacctccactacactgacaccttgccaaccatccatctcacttctttatttgcctttctaaccttctgagacaaggactctcaacctaagctaaatattggaatcagaggagctttgagaaatactgatgttttggtctcagccccaaagatcttgatatggtcatttcaaggggtgggaaaagcctgggcattttaaaagctacccaagtgattctaatatgaagccaaggttgaagacttctgtttaaatcaatttagtgacactagcaagattctcacacaccatcctcagacattctgattctgaagctcaggatcaccacttcctaatatttgcaggatctgagacaaaagaaagctctcaatctatagcctttcaccttgtctttctacttcccacccactcctatactttcttgcaccatgaagaatcttctgtatatagaattagacacacatccaagatctgtccttactccctttcaaacacccagcccttggtcactcttgaacttagacctttgcaaaatgactgcaaggtctgccattagaggaagaggaagagggcctaaaaaggggtcttggggccagttgggaagggaattttggtatcttgttgaagtgttttctgacaccaatctcttctccaacatcggctgaatgtcgaaccattcaattcaattttgatgcacctggatttagggcagaccccacagcttaagtcccacaagactgcccccacttcaggtgccagttgcaagacttggaccacccatacttctgaccaaccagctgtaagtcagaggttcccacaacactgtcctcagcttcaataatttactagaacagctcacagaactcagaaaatccactttacttacatttagatttacagtttatcaagaaggatacagatcaacagccagatgaagaggtatatagggtatcgtagtctgctttgtgctgctataacaaaatgcctgagactggcaatttatacgaacagaaatctattttctcacagttctggaggtttgaaagtccaaaatcaaggcgccagcaggttcggttgtctggtaagggctgcatcttccagaggggaggaacgccatgtcctcacatgatggaagacagaagagcaagagagaccaatgctatcaaaagcctttctaaggaccttaatcacactcatgaaaaagggccctcttgacttaatcacctcttgtttgccccacctgttaataccatcacattggccattaagtttcaacactttaactctagagggaacacattcaaatcatagcacaggacaaggtctggaagagtcccaagaacatgagcttatgatcctacggagttagggtgtgctgccctcctagttcatggatgtattcaccaacctggaagctttacatcattatttaagagtttttataactcaatctttagctctcccaccaggttagtgagggaggctgaaagttccaaccctccagtcagttgatctgtctggtgatcacccctatcctgaggctctccaggggccctattctaaatctacttattaacataaattcagatatgattgaaaggggtttacacaaggcctccttatcactgtgaaaaacccaagcgtcttaggaggtctatgccagaaacctgggacaaagactaaatatatttcttatatcacatctgggtaccccagcattagggaggccatgtctccatgtgcaggagtcatagtcttgtgtactaagctactcacctcatgaggagtgtgtggatgaaggagggctggggggccatgagggcccaagggatgggcctgtcttgcccacatctggaagtccgggatgaggactgagactctctttgtagcaggttccccccagtgattctgatgtcagttgtccacagggtgcacttagaaagacaaactctgcagaaggatcagagctaaagaagaatagcttcccctcttttctctctgctgcctaacatttcttagtactagtcagagcttgggagccacacttggaatttcaaaagaggaatttttcatgcttttctaaatggattgcattttgggggcttggaagccaaacacttagaatctgtaaacagtttgtcctgggagagaatggctgcaggctttcagaacaagagagggaaatttaggctgactgcaccctctgcttctcaaagctctttctgctaaaatgctatagttatatgtggtcgtagaaataaaagagaagccaaacactcaagtgggcactgcttcccattttttgactaatgagagattattcaaaatcttgatattgagttcttactacctacccaagcactgagctgtcttctgtaatcatccacaatatctatgatgtcagctccatcattatcattttatgtaaggaaactgagatgcagactggccactggctcaagctcatacaactattcactgacagagttaagaaccaagcagggccgggtgcggtggctcacacctgtaatcccagcactttgggaggccgaggcaggcagatcacctgaggtcaggagttcgagactagcctggccaacatggcaaaaccccatctctactaaaaacacaaaaattagtagggcatgatggtgtgcgcctgtagtcccagctatgtgggaggctgaggctggagaatcgcttgaatctaggaggtggaggttgcgttgagccgagatcatgccactgcactccagcctgggtgacagaacaagactccatctcaataaaataaaattaaattaaaaattaaaagaaaatataaaaaaaagaaccaagcagggctgagcgcgatggctcatgcctgtaatcccagcactttgggaggccaaggtgggcggatcacgaggtcaagagatcgagaccatcctggccaacatggtgaaacctcatatctactaaaaatacaaaaattagctgggcatgctggtgcaggcctgtagtcccagctacttgggaggctgaggcaggagaattgcttgaacccaggaggcggaggttgcagtgagccgagatcacgccactgcactccagcctggcgacagagcaagactccgtctaaaaataaaaaaaagaacgaagcagcccggccctagaactcatgtgctctaaaccactactctaaaccagctctttaaaacacgtaagtgtaaatgtgcacagatttcaatttagagctgtgtgactcccagcagatttcttttttcttgagcaaaggagatgccactgtgaatattaatgtctgtcatagccagagcagacactcttcagcttttgggcaaactaaaatgctcaaaaatacccacaggcacaacattttctaatcgtgcttccagagccaggcagtgtgttcatgcatgtaagacgctgtataaatgtaggtagtagcaccaatagtgctcatgaattatggatgaagaggaacatccagagtcaaacattcctgagaaagcagaccaggctccctttactgggttaggaaaagataaaaggctaaacttcccaaggcagttgactggtgatttttcattctaacatccgaaaaaataggaataaagttgctatggtttgaatatatgtgtcccttcaaaattcatgctgaaatttaatccctagtaaaacagtattaagtgaggactttacgaggtttaggtcatgagggccttacctccatgaatggggatagtgcccttataaaagggcttgagggagcctgctttgctctttttgcccttctgccatgtgaggacacagcaaaaaggtatcatcttggatgcaggagatgagccctcaccagacgccaaatcttctggtgccatggtcttggaattcccagcctccagaactgtgagaaataaatttctattaattataaattacctggtctaagatattatgttatagcagcaggaatgaaccgagacagcagcctatttcagaagcctgtctctgatgctcctattccaaccaaaatctttaagccagagatcgcaaccagtaacctggctgaataatccacaaacatggtttattgtactcacacattgttataatgtttttttcttagtgttctttcatcttcttgttgaacaggatgccaactttaaaaataaggagatatcctttaaaaatgtttccttgctttaattgaaatattcaaagacctggctcactggggccatgttccaatggacttggcagcaattagctggatctgaggagtggaatccccgattagatgaccttgtgtgctccctttagccacagtcaccatcactgtttgttaccttatactcacataccaccactgactaccaccagtgcttttcactctttttctttacctctcttcctcctaaagtcatttgcatttaataactgctaatttcctgttattcaaggtccctagcaatttatgatatatgtgtttgcttatataaacttgcttcaacaggccacagtagcctaggaggtagtcattgcttgaagatttatactgggctgcaaaataaccctgagtgtctactcaactttcagttcgaagtgccttatcctgtatggtagtgggttactttttgcatgccaactccatcatatggtagcagatgcctgggactttttgttgataaggattccaaggctatctagatggcctggaagtaccactaagattgattagtgatgtctgccatagtcaccccagctgctgctatccatcagaagtcatcagccctgtgcttccatctccatttctttttttggtttttttttttttcatttttttcattttttttcattctgagtgtcatcatttaggagactcacacaaaagtaagagaatctttctagggaaatgttctcttttctttgcttgaactgaagttgcaatttagaggcagttacccttaaccctggcatctttttcccccagtacaagtgttcatagaagcaccacatgtaacaggcaaaaactggaaacaacctaaatgtccatcaacagtggcatgggtaaatgaagtgtggtgtattcacatactttatagcaatttttaaaaacccgactacagctatctacaacaacaaaaaaagaagccagatgcaaagaactatagactgtatgactgtttatataaagttgcaaaataggctgctgtctcagttcattcctgctgccaggttttatctctgcctcctaattattctgtcatttcagccacatctggggttactaagtgtcatttctaaattgtacctactgacattagcgaatatctttttgctggtctcccaaaagaaagatccatcatttttctaactcctaattgaagaacctaagaaaattgctgtgttacaaagtgttccttttcatcaaccacaaaacaatcctccaggacagagttgagcaaaaccaattctgtccaatccagtctgagtctaatgacagaaactactctgagttaccttattcctgatattccaggactgacatcagggcctctgtcccaagaagtggaggaaggcagaactcccactagccatatcccagcctccttaagatgggcctgtggtcctgggaaatctgctcttctaacctttcctttgtccacagaagccacatcagtagagggtcagttacagacaaggggcacacagtgaataaggaggcactcacttcttggattaattggcttagtgtgagaaggctcacttttacatcctaagattggaaagtgccagaggcccccacaaatctccaaaagcatagtttgctctccaattttctcaactctttcccggtttgtaatgtttattgttttcttataatatttaccaaccatcttacctcaccaatgctagatcctacaggtaacagaagcacagtataccagaatgatcacatccaatagcccctggctggctccaggtgtcatgaagtgacctctgattttgttactgcccctgagtggtggccagaagttacattatgtcagtttacagtgtggcagcccccatatccattggggacatgagtgtcaggcaggtcaggtgagtgtcaccacctggaaagtggaagcatctctaaaaacaacttccacagaatgcatgaatttacagatgatatgaaaacatgtgcatattgaattttctgaaaaatggcttatcacaaaatttaaaaaaagtatttatcaaaggaactttgggcacataaggaaataaatccaatagtatgctcatgacaattagttatataaataaaataaagtaggttattagtccatataagatagcctcaggaaaaaattaaatgcccagataaaaagtatgcagcttgacaaatttttacagaatttatgaaattaccacttgtgtcaagatacagaacattatcaacaccccagaaacttccctcgtgctccaacccagtcagtactacctccatccggaagtaacagctattctgatgtcagtcaacacagagattagtttttctgttttgcaactttatataaacagtcatacagtctatagttctttgcatctggcttctttttttgttgttgtagatagctgtagtcgggtttttaaaaattgctataaagtatgtgaatacaccacacttcatttacccattccactgttgatggacatttaggttgtttccagcttttgcctattacatgtggtgcttctatgaacacttgtactgggggaaaaaaaatgccagggttaagggtaactgcctctaaattgcaacttcagttcaagcaaagaaaagagaacatttccctagaaagattctcttacttttgtgtgagtctcctaaatgatgacactcagaataagacgctttcttctccttccacagtcccctgtgctgaggcattttatgtgattgtgtgtgtaagcttcaaagcgttattcaacaaagaagcgctgttctcccaagctctaaccatttactcgtaatgggcatatggtatttcgagtgctgtactttactatttcaccactagagggcaagaggagccccacaatgcttgacattgccagatctgcagtcaaaatgattaatcatgaggcaaaaacaagaagccagagggaaaaaaggaagagctcacaaaggcaaaataaacatccataaacttaaactttcctgggtagggaagatctgaaaaatgtcacccatgagccactttctaacactcgttccatctttctttttccagtgtgcaaaactcaattgcacagtcctcagttgctgaaactaccacccaacagggtgggactagatcaggcagacagatctcagagggcatttttttttagcactgcctagagccttggttattaggaagccgagaatcttgcagaggtcccaggcctcaggggctctgaacaagcaacagagagttctgtgatttcttcttcattctaagtaatatttcttccaataacaccatggtgtttactaaaatcaaggcactaatgagtaaggctaccagccccaacacctctcctttttctcctcttctcccgggtccaggcccttctacctgccacaaacttaatcaagattacagaatggagatgtgttgttttttgcaaggggaggggagtagggaaattaattacgaagccaagttgctgttaaactatttataataaatttctactggaaaaggacctttggctgacaatcgttttcttctgcctcggcatgaccaaatacagtaagaattcaaaaggaaaactgaaaagcgaggaagagcccacagctggagcagtctgttttcacgtctccacgctggcgaacgacaaactcggcaaggagcctcctgtgtatttcctgtcctcgttatctcagttcttgctctgaagggctaagaagccttcaccgttagccaagactccttcgtgcttcagcttaattttccttgcataattttaaatacagatcatgtctacagtacagcaattaatggatagcctaaagacttattatttcaaactaattgatatgtaggaaaagtttaaataacataacggagaggggaaattttaaacgatgtatgcacaatgaatttaaaatttctctctgttgcagatggtagcaaaaacatatgattaatagggggatgtgatcaaaatgtagaactgacttggaaatctttctctttttgatattcttgagcatatgattggaaggaagaaagattcagacatttcagaaatggggtaaggggtgcaggggagagcagattcttccccccccactcactcccaccaattctagggagttatctcacaagataaaagaacacctgagtatattttgagttgtgctgttaggtcagaaataagaaatgggagaagaatgccattatttccattctaactctttggtcaaatccccctcttgagataaacttgagagagaagtctacaaagaccaagttcacccagctgcagcagaacctgttccaagtcaccagcactcccagacccaggattccctccaaattctaagaaatgtgctgtgatgaatcacctcactgacacacaaaaaaacaaaaatctttctaatttccccattcacattccagcaagtttaataggaaagtttagaaaactcatctgaagaaagaatactcttcaaatgggagagagcaggaacattttgttctaagaagggattgagacctaatgatgccagacaacattttaaatatcagaacacagcatttgtaagaaaatagaatctgcttcaaccataaaccataaggggggaaaactacctttaaaatgtattttcttcatatcaaattcatgtcataagaatatctgaatgacttctggccaagtcacttaaattttgtggtcttcagtctttttggtcttctcagatgtaaaatttgccacagactggttattttttagaaccctttcttcccttctgttctcctactttatttaggtagctctacacacacattttgaaaattggatgaacaacctccttctcattggtccatgcaagaccatattactgtatttataatataatacacacccatatacaccacaaaaactacaatactggtttctccccctctggtaccctggcctttcattctccaccctctgcccttcaaggtaacaatgaatctgaaacgtgtgcatgtatatattcctgttttttatatttacatggttatagatatacatgtgcatatatatcatgcatatgtattcctataacactttatttttttatcttagttgttttaacttcataaaaatggtatcatatggagtatcatattgaaatatgataatgtaagttaaaggaccatactgaacctatactgtataaaatttgggggagcctacaatttttcacttaaaaatatgttgcttactttgggaggctgaggctggtgaatcacttgaggccaggagttcgagaccagcctggccaacatgataaaaccctgtctatactaaaaatacaaaaattagctgggcgtgggggcacacgcctgtagttcccagctactggggaggctgaggcatgagaattgcttcagccagggaggtggagtttacagtgagccgagatcacaccactgcactccagcctgggcaacagagcaagactgtgtctcaaaaaaataaataaataaaaagagccagacacaaaaaagtatatacattattattcagtgtatatgaagagttagaaaatatgctatcttgggtaggggacaggatggctagtgattggaaggtggcaggtagaggtcttatggagtgctggtattgatctgagtgctggttaaatgggtgtgttcactttgtggaagaaaatcctaagtccatgaatttgttgtatcagttagctattgctgtataacaaattccaccacaaaactcaggggcctaaaacaataagcatttattattatccacaagctggtgagctgggaagttctcctggtcttagttgttctcacttatgtgtctggagtcaactgagcatgaggtggacagctctgctggtgatactggttggacccgctttcatgtttgagggtcacttggatgtaggttggtctaatatggcctctgctagaacgaccggatctctccacttagtctctaatctgtgaacagacacgcccaggcttgttcacttgctggtggcagggtttcaatagcaagagtagaggcacatgtggccctttgagaacaactcagcactgcaacagtatcacttttgtcatatcctattgacaaaacaagtcacaaaagaggagtgaagaatggtgggtttttgaaaactcaatctaccacacttctcttatgtgaacttctctctgtgtactaatgaaaaaaatttaaataaagtatatctaagtataaggtatctatattgttaaatgttgctatagtttattttgacttattctattccatgaatgtatcgcacttatccattctactgtcagtttgcatttagtgatgtccagttgattgctgttttaagcagatctgctgtgaacatgccatctcatatctcctagtatgcaaactctgtaccagaagttttcttggttgtataccaaactgtggaattactgggccatagggaatatgaatcttccattttacatgatgatgctaaattgtcttctgaagtaactataccactttacactttcttcagcaatatatgaaagactgtattaccctgacacttgccaatagttgatattaacgtcagacttcctaatatttcctactaagatgagtatgaaatgatatctcaatgtggtctagatctgcctttttctgatcagtgaagaaactgaccatcccttctatttagtttgtttttgttttgcctttagccacatgttccttcttaagcaaaatgcctctttgtatcttttggtaatttttttcaattgagtgattggtcttctcattacttcataacaattctttatatattctcaatactattcttttgtcagatgtgtttgttgtgaaaatatttgcccagtttatcacttgcttctcaccttattgagggtgtcatttgaataagtttcataattttaagtatttgaattaaatttttatttaatttttattgttagctttacttgaggcctatttagccaatccttaactaccccaggatctgaaatagattaaaggtttagcagtcaaaacataaactaaatactgtttcatttgcactcacacacacacaccacggcctgctcttgttacaagcagttttggtaatgcggctcctgtgttcattatgaaatatttaggtatggacttgtcctcagtaatagcatctaaatatcacaaactcaggaaatctaaattgttctgacaagttacaagaataatttcaaagaacattttcttttggcagtagaccctgatgttgtgtagtaatggaaatgtttaaattccaatgataggacagggatggccctggctagaataacacaaaaatcattcaaatctaaatggcataaggctgcagcagtccaagtgagatccctcggggagtcttggaccttttccaagatgtaggctctctacagtgtgagtgtgcagagattgtatgattccactggggtcacttccactgatgggttcaatggactacagcactgaccttcacatggcttgttttcatagcttcgagtcctaaagggagatagggtcataggaatatttcaacagtgtaaacagctcacaagtcttccttgctcacttacttagaggtgaccagatgaactgaacataccctaatgctaggctcttaaaataggatcttgttttaaaaaggggttcagtagacaaagaaggccattccctttttcccaactcttgttcttagggtagtgttctcaaactctggcaatttgagtgtgcaaaaaaaaaaaaaaaaaaaattagagtagtggaagtgggacagatagttcctctttagcctcctgacatacctcttgtttggagggataagataatctctcagattgccacctgggcaaggaaactgggcaacacacttccaactcagaagccctgaggttggtggcctgctacctctttgctggtccctcttcctcaaggtttccgctttggaagtagggactgattcttaattggttcatctacttctaaggccagcacttaggaagagttagcttgttcttgattggctcaagaactttaattaataaagaagcaccgaatccagaatatttataaataacatctgctcacaaatagaacattgttccaaatagttcagtctaaacactttcagcttcaaatccacattaagaaaatcataacaattacctttaaactcatgtttccaaaaatgtgatgtgtatgtggattacctgtggatcttgttaatatgcaaattctcattcagtagatctggagtgggcctgaagtgatactactggtcctaggaccacactttgagtagcaaggctttctaaagttctgctctcccgcacagctgaattgaataacttttccttctagagatggcatcatggttagcttttgaaaaccttttggttttttttttaacttcagtcttctagtaattcaagaaagctggctattttttcaatctttctggatgttttaaggatctccttctaattctgaaatgttgctcaggtatttcttgttgaagtcttttccacagggtagactctagcttggggtctattggagcaagttaaatgtcttcaaaggtgatgggttattcaactgaataaatgttttctagaatgtggtgaaacctggaaaatacagtgggagtaggagagggaagaaaaaaaaaagacataatatacttttctccactctacctaccatgataatacatattaatcttgcctttattctttctttattgtatataaaagcttccactaactttccattctagggagtcattgagagaatataaatatgtgggctttttgttaaagcctgataggagaagagattattataagtaattggagactgtggagtcagaataactgagtttgaattctgacttcatcatttaccagctgtgttgcttaaccataaaatgctcataatatttactccagcgaataatgggagaattcacagaggtaatccttgcagataatccctgctaatcatttaacctagtgccaggatatagtaaatgctcaataaatatttatagtagtagtcattgttatttgataactattacagaatagctcccaagggcctactgaagaaaagctttgtgcttaagacactggcaataagttcatttccatatggtgtaacttgaagctttggttttatagattaactcagagacaagtcctaccacagtgattcacagttcctgaattcaaaacactgtgcatatcactgatttggcatttcaccttatatgactagctcgtgttattatttaactttgccttggctcactaattttattttcagtttctaacctttaagaggtaacagttttatactgttcaagactccccaaaccaaataccacagagccatttgtttacattagtaggtccccaataaatattcattagttatttcactgattaattaaagtaatccattcatctccacagggactcaggctggctgaatcaggagagacatcttcagatctattcctctttgagaaattagtataatgtcagtgcattctcatgtgtttcttgaattatgagctccctgatgtctaaagaagactcacagggaagagttcatatactgacagaacaatcattaattagttttcaaactagttttgatttgaaactaagtaatttcaatcagttttttgactttcaactcagtgttgtgacatcatggtggacacaactttcttagaggtatcaataccatcatcatgtccatgtttgatttgacagacaaatattgcaattttattctgttggacattttccaaagaagttggttactgatttattaaataaatatacatattttagggtagtggaagaagaaggtgaatagaaattaatgggtgagcaaaggtgagggaaaaccaaatcaccagttttctttctgattatattttaatctaaaaggctatgtttttaatcaggttatatgtcttgataagtggcgtttctacttaaaaaatgttggttgtatttgtatcccaagtaggaaatgcaaacatacttgtataaagcaaacaagtttaacttgtgtgtttgtattaatgatatgtgatcaaggcacaggaaatgttagtaaagaatcatacacttattatgtttgtttgggacagaacaaaggataagtcattagttggtgagttcagtcattttctttgagataaaacatttggttaaaaggcaggctagcccaggcatcatggctcatgcctgtaatcccagcactttgagaggctcacgcctgtaatcccagcactttggaaggccaaggcaggtggatcacgaggtcaagagattgagaccatcttggccaacatggtgaaaccccgtctctactaaaaatacaaaaattagctgggcatggtggcgcgcgcctgtagtcccagctactcgggcggctgaggcaggagaatcgcttgaacccgggaggcggagcttgcagtgaggtgagatcgtgccactgcactccagcctggtgacagagtgagactctacctcaaaaaaaaaaaaaaaaaaaagagatcaacttgggcaatgtagcaaaaccccatctttataaaaatctagaacttaaataaaattaaaaaggcaggctgatggaaacaatttaattaacttgatttactgggaaacattgatttattggaaaaacaatgaaaatgtacattgatttattggaacttgattaacttgacttattggaaaacattgaaaacatacattgggacaactggatattagatatttattttaatgcagaagacttttctttaaaattgtatttcctttaaaaatagactggcattatgttattatttaattattattttaatgcaaaagctattttcttaaggatactatttatatttctgctactgaatacagcacagtaatatatttcctcttgtagaatacatttagtcttgttttgatgggataaactgcttttgaatatactcactatgtcatgcatgatttatttatttaaatttcagcataatttttcttgacaacctgttctttcacttgaaatgttatgtaacaaaaacaccaggaccaactggcattttagtttatccgtctattccatatgctgctggatgaagcggaaaatgaatgtgtatcatcactatgctgggcacattttattcgcagcctgtcttttctcctgtacatcaatttctcttctccgtttggaaatagcttcatagcaggttaggtctatagaccttaacctgagtgatcacatataatgtaacaggaatctaattggctatggttagagtcagggaccaaaatatattcaaacttacttggattgctgcttgaatataatcacttcaagtccaggtagaactatttagactcagaaagaaattgatttttttaaatctaaacatagttactgggtaatttatgatagatctccagcccaaacatttcataaacaagtcaaataaggtcagcatgcatcaaggactagggcacattaatccaaaactacaagaaaaccctgcaatgtgtccactcaatatatgccagccaataaattcaaactaaggactaagctaaggtcttcatttgggttcccccagaaacaaatcctgagatgaggatttgagtataatagtgtttctgagcagtggtcccaggaaaccagcagggaagtagagaagtgaagcaggaaagggagggtagcaattaaaagtgtggcttttctcagacaagttacaaatgtgggcaactggtgatcaagcccagcatggaattctgggaaaccatgtagactatgcaccttagagttatttcttgcaaagggtgagggagctggagtctatatacaccaactgagcaggcagtttcagccgtttttgcaccctgcaagagaaagcaagctgttggaattaggacagtctgcatgacaatggttaggccaaagagctataaactgggcactaacaatcattagcttcaaattggatgagaagttcgccaagattataatgctagagtctccataattcaaatttcagtggcattaaacccacacctgcatctgacaataatcaagtatgtttgggtttagaaaatattttccaaactgacactacttttttggcaagacttagccattaaatacatgaatgatcctcaacaattcatgtaaatgagaatcacctgcaagccttcttcaagctctaaatcaatagttctcacactttgggattcatcagaatcaggtaggagacaataaaacacagatgactgggctcccacccccaaagcttccgacttagtaagtttagggtgagcctgagaacatgtgtttctaacaagatcccagatgaagctgatgctgctgttcgggagacctcaatttgggagcttctgctctgtataacctcacacaccgtacttgctcctgccctaatcagttttgtattttaccattataaccaaaagaagtacattatattcttcagataaagaaaatgttaagaggccttgattttcaatctacttctaactggaagagttaagcaaaggaagttttttctacctctgaagaaggcaaaccacacaaagttggaatcttctatccagagttgaaaaccctattatacttataatcatttttttattaacatatactgaaagatggtcattcatagcaagaactcataggtaaagattaagttggtagggtttctgagtggcattttacatagcactatgaaaaattatgcacatgattatcttttcttattcatcactgatgtatcaagagatatcttcaattttcagaatgttttatttttcttggcatacaattagacaaaatatttcagttttcaaaaaacaattcagagttcttattatttttcctcttttagttattttaaaatttgatttgaagtgctgcaaagagaaagggggaaatgatgtggtaggcctttgatgaagttaagtggcagtcgcctggacaaatgtgcaaaaagactggcattcagtaatatccagctcttctggtcttagatgatttctattctgtgatgccaaggagaggtagtcactccctcctttgtgttacatttgtatgttgcatataattttcccatgtatattgcagtataccatgtatgttgcatataattttacatatctcagcataacaccttattattttatgtttcacattctcctactagtcttgggacttcctgaagccagggctgtgtctcactcatgtctctgcctagcacctgtcacagtgctaggtttgcagaagtacacttgataaatttttggacacatgaatgaataaatcaatgaatgtgtgagggagaggaggccacaaaaagcgagtagatgtaaatagagaatgagccatgaatcagtggtattggccattcaattcagtattccaagtattgcagtatgttcccatgatttggaattaggatggctctctggctgacatgtcaaccaagaactagaacaggcttgttagaactagaacctagaagatttttcctgtcactggtaagattagctgtagttttctctaaagccatttacccttgtgtaagtaaggatgcctatgatgcatcagaatggcttttaatctcctaggttgagtgttctgaagaaacccccaagttttgggaagcagcgccagaattatatatgtcaggatatggttatctgatgggaagatggaaggagaaagtaagatttagcagaccagctctgccttgtgaatctaagcagaagaaaaacgaatagtgttttaaaactaatttgcaattgtactgaattgaagtcaccggttcctgtccttataagagtaacttcactgcggccatagattctgtatataccttaatccagtgataacaatggaagaaaagggagttttttttcatccttgcactttccttgtagaggagaaagagataaacattgatggaaagtaaaagttcccctgggctttataacactagctctttctttctcatagttataaggtagttataaagtactcaagatttatagttaggattattctctaattctactttaacttcagaataaccaaaaaggcccccagaaatttaagaggccatccttatggcataaacattggctaataaagattaatcataaataagagaaacactcatatctgcatgtatattcatcattcccctgacctcaaaataaatcatgcaacacaaaatatgtatgtgagaatgtattggttagcataatactggctgctgtgacaaacagtaccaaaatatcaatggcttcatacaatagaattttatttcttttttgtacaatagtccaacataagagtttccagttgatgaacagtttatctcatcatggcaattcagagaaccaggttcctttcataatgtggctccatcatcccctaggatcttgctggaaaggggaaagaaatagtagagattccccatatgtccccaaaaagccctgccctaacttttcattggcaagaatttttcaaatggctatgcctggattaaaaagtggtagggaggacttgtaaacattgtccttggatttggcagctgcacccaggcacagcagacaccgtggacaggtgcctgcaaattttgaggataccgacttattttctgcaatgtagaccaaaatactggaatccaaacctgctaaatgtagaattattctaaattgactgctactcacaaagaccctaaagataaaatcagtaaagtgacgactttgtattccaagtcatctctgtagacctcttcgagaaatggatctattaacaaaaggatctgggctagaagacttacaaaagaggatttctataaaaacaacttgctattcaatttatctgacttttcattccaaacccgatgtgtttagcacagttacatcaccacacttacgtgacgaagaaggaaatgggaaaagagggagatgtccaatattctctagcagatgccttttattcaagaataggatcaaaaatttacctgggggtaaggaaagtgtcttcctcttcccagtgatagttgccttgttaaagactttagacaccagcgcaatgtggttaagtctccactagtgcaacaaagaaaaggatagaggccagtccctgaatagggaggccccagcagactttcagatggttaactatcaagtccaaagacagacagatggaatacattacccaaatactccggaagttgcaaatcgacctgcatggtgttttgtaaatttctaatttaaggcaacactgacaaattagaaggtttaacacaaaatccagatttctggattcttttgaaaaatcaaaagaataatctagttagtagaactagttagtagaactagttagtagtaatctagttagaagaacgggtgtctgctgtctgtaaccacccagctcctgtcactcgtttgccttttgatctggccctgcctcagtttgctctccctgagaaatcccatcattgttttcagcttcaccttggggggagaattcaagcacaacaagcaggcttctcaaaatgcctgtgaggccaagaaacaaatgtctagtttcctttcagataaaattgtaaatactcacccaaaaaccacagcaatttaagcaggagacataaacatcatatttagaaggagggactatgtaattaggacatactcccttaagcatcaaaatcaattatcctgataaaaccctaggacggctaaccactcttgaaatatacatttataaaaagaaaaagaaaaaccaaaactaattttaggtgatcgggagaaggatgttctccagggacataactgagttcattctaggacatttgattcagcctgtcccttgttttgtaaatgccatgcacaggctttgagtcgagaaagtggttgtagctagggctcaagttcagtaattactaatccttggttaatcttaaaaggagttatcataaaggcatgcaccaatgaggagactctgatccaagctgaggccaacacaagggcaggacccccacaggaaaaagcctttggagacccaagacttcctgaagaggctgcttcatgggactccaggttctctgagatggttgcttgcaccgtctgcactattgaccttgcttctaatgtgactcggtgtaagaactgaattcataatgtatgttcagttctttctggttggtggcattccacctgattgaaaagaaatacatccttcatctaaaaataattagcctctgaatggccttttatttcaattgcccggagggcttttattgattttttttcagggtttgtgtggttaagagaatgggattcttctggtggtgtctttcttagcctctctcgaataggctgtcatgcccttgctcctcatgtgcggctaaatcagaagctacaaagtagtgacttgcagactcagttgggccttttattggactcttggtatatgttaaaattgctgaatttgagtgttttacacaagaaatacaattccacttggctacagattccactacttctcaattgccttataccagatctcattcacagatttgtgttgcttcttgagccccatagatatttgagttcagagattctgaaattaatatacatgtattaagttaatacatgtaaggtcctaggaacagtgcctgccacacaataagcacttaattaattttaatgttactattattatagtaaataattattttatggttctatatttccttgtttattagcaatttactaggttggttataacccaagagatttttttctttttcttttaagctatgatttttccttattccagttttccatttgcttgttcttttttatggtatccgattctttacagaagtattctgattaaattagactgtacttaatggaaaacagaaaaacaactagctgatcaaataaacatttcctaaactgaagaatgacacagagggagtgaaaaaccaggatcttccaagtatgacagacacaaagaaaagcctgtgatgatttagaaatgtgctgggctaattgcagctggttgagggtcctcgttgttttccataaaaccgtattgtattatgaagaggacagcaggtcaataagaccctgggccatgggacccctcttcagcatcacttttcagtaaaagacaattcccgattattttgtgaaagcaactttgaaatcctaaacatgaaaggaaaacacattggaatgttttgttatattcccctcaacacacaagaatatcaggttcctgagaccttcacacatcctgtttttacatagtgaacagttggcctggaatggtggggatggagccctggataggaggcaagaatttatttattttacttatgtattcattttgagacagcatctcactctgtcacccaggctggagtgcagtggcaccatcttggctcacttcaacctccgcctcccaggttcaagtgattcttgcgcctcagcctcccaggcagctggggctacaggcaccagccaccacacgcagccagtttttttttatttttagtagagatgggatttcaccatgttggccaggatgatctcaaactcctggcctcaagtgatccacccacctcggcctcccaaagtgctgggattacagacgtgagccactgcacctggccaggaggcaagaatttagtattcagatcttgattctgcgctgaaccacttggatggtaggctttagtctcctcacttcatgattgatgggatttgatgaacaatgtgctgaatgtttattctctcaagattataaaacaagtatcttaagcttccttaccccagagcacaggatcttcaaagacttagaacatcttttggtatttcaaatacaatagtaactttctgtttgacaaacgtctttgggttattatcttgattatttttttttattatactttaagttttagggtacatgtgcacaacatgcaggttatttatcatttttgtacaatcaaaatttgtttcctaattcacaatcatttttatgcccagctgagtcttccaaaagaaaacacctaactaaaaatagaaaacttctaggccttaatcgcaggccccataaggagaaagtattccagtgctgacataaaaagttcagggccaggaactcacatattagctgggctgacgtggcctgctgagtagcataattattgtcctaaattgtagtataagttgcttttagggtaagtggcttgggtatgtatataaagcaataagaattttgctcctggaaaatggtaaacaactcatttcatgtcaaggccacagaacttaatgcacacttttgagagaaattataagagtcatggggaaatgcaacaataataccaaataacagacacaaaacttcactggcttacaataataaacatttatttagttcataagattgtggggttcagctgatcttggctgagtgtggcggagcttagctggacttgttcatacatctgtggttcattatgggtcaggcaggtagctctgtagctctgctgatcttgactgacttacatctctgggtatcagttggatgttgatgaatctaggataatttggggtatgggactgggatgactgaggtgactcaactcttttccttgtgttaaatcttctactagagtagtctaagcatgttcccgtgacatgccataggaataggagtgaaagctaagtaagggcttttttaagcctctgcataggccatgcctgctaacatcctattaaccaatgtcatcgcatgaccacatcatcttcaaggaatggagaaatagactcctcatctctcataagagaagctgagaatcataaagcaaaggctctgggtacagggaggagccattaatccagtcaatctaccacagaggagagaattgacgaggtcctggtcctggttttgctactagccagccatatccttgagaaagaccctaacttctctgggccacagattttcactaaataaaagaaaggatttgagtataattgctaaagtcattttctgagacgtcaaagtcatgaagggtttgactatgtaattgttaaatgttcttttttcaggttcctacagtaatctctagacacctgtgagatgattagaaattttgaaatatatttcaggactcagaggaggtataaaagcatggactatgttaggagttttcctctgtggcggtttcatggaatatatgcatatatagaggagttcacacctaagaactatgtcagaatgcatttggcttttgacttgaaataaagtttaaaaaggaaatgcatgttaggaactgtgcttggtaaatcacatggtctctagtttctgtctttcctcttttattgattcagtatttggatctacttagtattttgcctacctcgtccttgactcctccaaccttcctttctggcaacttagcaaccctcattctgcccttcacccaacagccttatcaacactttgaatctaaatctgagcattagcattccagaagtctgaagatatgagatctacaaaagaatggtttaatatttatctagaccctgaagtaatgttgttgaggaaggaagagaatgcacaaaaggagaaaattgttggaagacctttgtctaaagtggtgctattcacagtgtggttcttagaccagcagcaacagcatcaccttggagcttgttagaaatgcagggtagcatgccccaccccagatcttctgaatcagaatttgcatcttaacaaaatccccagagattttgtatgtacattaccttgtcacttttaatgtgcatccatctgtgaaattagccatagattatgaaaacagagtatgtgagaattgtaatccctctattgtaatctatggctaattcatgaaagtaaatgtgtgataatttaatttttatatattagagcagattcaaagttgagattcatgttttctatcacatctacatacttacatatatacctgtagattgtgtagggaagagggaatttacagctacagagctgtgtctccccagtgaatgtcatctattgtatgtccaatggaggaagtgttgagagcttctgcccaaaataaggataatactaaaggtattggcagattctacaaggctcaatttttaagtctcatgtccttcataaagtatttcccatattaccttaaggctacaatacagtcttcattttcagcatccacagtccatcttgtgtgtggcactcattcagtccaatgttttattttccccgtatccattgcttgtcacctaggacggattctaatttctccagtcaccacaacaccaaacagggccttgcatgggtcagagtgttcaaaataccatttattgacaaatgcatcaaaatcaacaaaaaaccagaatatagtcccaaaagagaaatccaccaagtaccataactgaccaaataatgactcaaattaactggaaagaacaaggactggttcataggcaggactttagattttttttgctgtaagtgattttttctctctttttaaaaatgaggttacacaatattaattaataagcaaatcagagtatgctaagcatttaatatgtatgatcttgtttaaaccttttaacagcccaggaaaattggttttattattcctatgttatacatgagacagttaaaattccaagagattaaataagctgagcaaggtcatatttcataaaatgcaagcattctaaaccctatgtggagaaagaatcttatctatcccaaagtgaattgtctactttgtgtagatctatggcatcagtttaacttatgttgccttcttagccctgtgtaacaggttctattgctagttggtatttgttcacaagataaaaattaattttaatattattttgaagcaaatataattatttaggaaaatctacccaaaatataggcatgcatcaaactccagcacccaataaaaagcagcagtaattgatttccattgtgaatggcctgtattcttctacattggcatggactatccagtttacttctgtttacatctggagtattttcaactttgacctagaaatacactgatcaccatttcactcctcatctttagatttcagttgccaatggcaaccttgaattacaaagttgaacaaaagctgcattttacttgagtggtttgtaattttgaacttgagttcatgttttctaggagttgtttgtctataggtgtcagtcctgcccttggttgccgaggaacccgaacattctgaatttgctatgcctctgctgggactcagtgggctttatcagtttctgaacagtttttgctttaaattattgggactgggtactcaattcacaggggtaatatgaatttggaaactgcactcattcatgggtttctaattccctttgtggatgtttttcctcaatgtgctccatgaatcatttgcttccttgcctcatctccaaggttgtggattgggttttcctagttcccatttgaagggtgggcacccctggctctattcagggacttcaggttcagcactccaacacccggcatcctgaggcctcctcttccaatctctcctcgccccgcaaaatggagaatcaattctgttaactgtgagttcctttgttatttctgcgacttaaggatttcttttccttatattcaaactcagctgtaaacttaagtgaatatgtatgtactgtttcattttgcctttccctatgtttggaatagaaaaggaaattttcagtcagccatattgactcaaagtcccatggcaatttattctaaggaaacttagtggaaaacaaataaacaaacaaaaactgaaatggttaggatatagcatgtggtcactttccaacaatccttgggtaacatgactaacctcagtctataaatttcttatgatcctgttatttttattcttgaagcaaaattcatgagattattctaaaaataagatgaggccttgcacgtttgctcaggcttaattttgaaaccattcattctatgaatgtatgattttaatgcatttcccattgcttttaatatccacttagctaactgatgatgttgaggttaaaatactatagtccttgcagtaattctcgtaaaattgtcctagtcactgtatcccacattcagagttctacatttttcttttttgtattttatagaaattatattagattttgttttcattttagaatgctatttttatgctaaaaatgaaataatcacattaccataaaagtgagaaatagaataaataaagatactcataattctaacacagtttatattttagtgtttcttttcaaagtcgttttgtattctttaaaaaaatggtcatagttattatcacagtatgtatacaactataggtacattttttcacttatcacaaaaatataattatttctccctgttttcaaagccattggtttatattatttgactacctcatagttctttaagtgagagccttatgatttttttacagaaacacttacgttttattcatgtttttgctgtttcttggcttttttgttagttttactattttccctgatctttagcagtaaattccaaaatattctgagcaagataattagagtaccatattattattgctgcctctcaaaggctaggagatatatttttaaagtgttaaaagactataaggaattaaattttaaatatatgcagcatgtattttacatctcagaattgctaagcgattaaatttcaaatgttctcaccacaaaaaatggtaagtatttgaggtgataaatatgttaattggctttatttaattactccatgttgtatttataaatcatggcatcattctgtactacataaatacatacaattttaaattgtcaattttatttatatatatgtgtatgtacacacacacacacacacacacacacacacgcacaacagatgctcccagagaagaaaaagaataaaataattgaaaatgtctactgagaaaacaaactgaaacaagtgatcctatgtctatatttaaggtaacataaccatacaaagaatataattactttcagtgaattttggcagagtaatataattgtgcatccttagtaggatatatttgatgaataaaaagaacttcaaaaaagtctcaagcttcatttgcttattttattgacaggtcataatattgaaactatttctggatatattaatataaagcaaataaataaatatgctaatgctatctgaaagcaacctttttaggaaacgtatgcttcagtctttatgggtgaaatgtcatgatgcctgaaacattttcaaatgactcagcaaaaaatatagagatagacaatacataatgcatatgtggcaaaacattgaaattaaggtagttttcacaggctggttttgttttgttttattttttggttgctttgcctgtacaaacaatgctaaatcaatgctatttttcctgtacaaaaataaatatcttagtgtattcattcttatatgttggtggttttgtttctgtgggccaaattcccaaaaatggagttgctgggttacaagcctatgtttgccttcttataaattttgtcaaattattgcccaatgtttcaaagtgtcaatttctcagaatgttattgcttctttaaaggaaatttcttttaaatttaatgaattaaattaaattaatcaatataataaatgtcccttgaaaaggtattgtgctattgcatttctctaattgttaatgagctgctttcatctatatttcaaatatatatagttgtattgtatatatattctttgtattttatttcttttcctatgaattgctttatttatgctcatttttcagagaaatggattattttcatctagataaagatatctatatttttctttcttatgtttttctgtcttgcttaaaaaggtctctgtaccccatgattatacagttattcacaatcacaattatacttttggcacattctcctagacagaagcaaataacaagcaaataacaatcctaagattgttattggcttcatattttatattacaaagtggtatatatactatacgtagtatatataatatacataatataaatattaatatatgtaatacattatattaatttattatgtttatattataaaatatttatataacatataaaatatttttatatataaatataatatattaatatttatattataaaatacattggccttatattttatattaagatctttcatacacttcattgggcaaaatgacctgagttggactctggaattccaaattttgaaaaccttgcaaatatctgtctgcacattatccagctgcatatttttttttaagttttctcaattcttctttgttattccattgtggcttattgttctctggtttcaatttgtttccttaggaaattggtttgattgtctctgattcataactcagtaatctgtcttatatttatgccacatttatgttatactgggttttgtttgtttgttttctgattgtaagctaaccttcaagagtaactttgcttgctccttggccttcacttattttttttatctaaaagctttccttaactatatcaaatctctgccttttttaaagacagaagaaaagaatgtcagagtcagaaaagcatcccaagtacaaaaatctttgacaacacaggaagaattgaatacatttgaacttgaccgtattgccttttcctgcttaactacccagagttcacaaaaatgactagtgggcaatgtcttttgaaaatcaagttaactgagaaatttagaatttgagcctgactagtcaaattaaagaactgggcctataataaaacaaactctgacaacactcttctttattaatatctgagtataataataacaactcatcttaaatttagaggttaaattcaatcatgttctttcgtctttcttgttcattttccaaaaagaggtcttatgaacttaagattaaacaaactcaagtttgacaatgttatgctagaaaggctccaaggcatagcctacaaaatcacatttgtcttgaaaatctatctgtcctgtggtgattttttttccaagaatatgctttgaggccacagcaatgaaaggatggggccagctgtgttagcttatgagtattttatgggtccaggccacataatgagactactttctgttcccctcactcaaagttatagccataatactgctgcctaacaaccaaccataaaaatcagtcacaaaacaagcatttgctaagttgatgagtctatgaactggttctggtctggaccaggctcacctgatctcagtaggcttgttcatgcctgtgtttagctggtggtcagctaggggtgagctggtttagaatagcttcacttttatatctgatagtcaattgaagtgatgcaaaaagtataataactgggccatgtgtctcctcttctggcaagctaggctgagcttgttcacatgatggctgagtaaacttctaactgtgagagcagaagcacacaaggccttgtgacgtctggactcagaacagcatatacttttgacacattctcctagacagaaccaaataacaaggcctccccagattcaagaagatgagaaatacactccgttctttgctgggatgggatgagctgcaaagtcacaccacaaaggttatgattacaaggaggggtgaagaattactgccatttgcacgaccaatctaccattcccacctaacaccttgtttcacttgcacagaatagaaattcaacacatattagagtacaaaacccagaatatggcaattagatagtatgatgctgaacctcagaacagaggcaatcaaaaggaagccctggtgatctgtggaggaccatctaagcctaggattatggggaaggaaaattaggaagaatctaaactggaattccacagttggacctaacttcgggagtcccctggttaaagccagatttaaatctgttaggggaaaggttataaattctccatgagcccagtggggctgatgaatgtgatttgaattgattgccaacaataaaaactcaggctcttacatgaagatgtggatttctgacttcaatatttaatctgacaagcatcagctagaactgagttgtttgtactccctttagacagggcctgtcatctctagctcttcagaaaccccacaaccccctctttcttgcacatagcctgctacttatttacatgacttgcctggcccctgtaacatctgagtttgcaacccttgggctggaatagctctagaccactgatggatggggctttgttggaacggagccagaattaccctgtattcttttcatattttcttacaatgaacaagtatttagtttataagaagaaaaagcaaaagctctaacttggaatgtaataaatacaattttgaaattagttcattaataattgtatggctgtttaaaaagagtgaaatatatggcacttaatatgtcatgaagcagtgacttagtttagaatataataaaatctactactatcccatgatgaaagtctactacagttataacttagccacaactgggtcaattattataaattattaaaaatcatcatcaaaattaaattactaaaatgtaggtttttcttagaattaaattatttaaaatgttaaaaagcattggtttaggtatttgacattttcttgtattttacttcttttgttaataattaaagaaatagtacttatcaagcactatggggtcttgtccaccaatgagcattaacctgagagaaattatctgctaggtcaggtacaatatatccatagctgaaggtcccccagttcaacctataagagaacaacaatctgttgttttcttaaaacaggctcacttgcttttcttccttccctatcttccttggaaacacatgtgttactgaattaaaattgaggtgaattgatgatgaggtctgaatggtagtaaatggacgctgtcaaacaacaggctaagatttcattcatgcaaaagagtacgacattgtaaaagccccacttccttctaaattgttggaacagcagggaaagaactggcaattgtcttcttcctgtttgatgccccagtgactcgtatgtgccaacatggagagtagggccctgtacaaggtgctccatcatagccacatgagtccagggccctgagcgccccctcacagcatgtttcctcctcggcttataagaatttatatgctagcaaatagattcataaataccccacattttatatgtagggagaatagttgactttcaatactcagcctaagccatttttaccagataccatttttatttttattttttcattttctatttttatttatttttatttttctttgatatttcaataatttttataaatttttaaaaatttcaacttttattttagattcagaaggtacatgtacaggtttgttacatgagtatattgtgtaacatatatgtatgagtatattgtgctgaggtttgggatacgaatgatcctgtcacaaaaataataaacatagtacccagcaattagtttttcaaggcttgcccccgactccctcccccactttattagtccccagtgtcaatcattgccatatttatgtccatgaatacccaatgtttagctcccacttataagtgagactgtgtggtatttggttttctgttcctacattaatttgcttaggataatggcctccagctgcatccatgttgctgcaaaggacatgatttcatactttttatggctgcctactattccacattataagtaccatattttctttatccagtccaccattaatgggcacctaggttgattgaatgtctttgctattgtgaatagtgctatgataaacatacaagtgcatgtcacacactttttgatgtgaaaaaaaaaaaaaaacaagtcatttaaactagatccataatctgttatctgagattcttggggcctgttgtttttcagaattttaacttttctgattttagaaaggcaatgtgatgcatataccatgagcataacactccaggcagacctgagtaatcctcaaaatcaaacaaattaatatgtctgcagttaagttcatgtatagtcatatgacagggcatacatgaaattatacatatttcatgtatcagtatcatcccaatatcagttcatgtcaatgagtctgccacaaatttgccagaaaaagaaaaagaaaaagaaaaaaaggaaacttcttctggatttcagaactttgggatagataagggattacttaatataaattaaataatttagtaatggcaaaatttatctgtcacagaagtgagagtgaaaggagttgaactaaaggggatgctcccaagctgctgacactgtctagaaggaggctaagactcaggaagacagatgtcctggagattgacttcaccctggcattccagggatcagaacaagccccagaggctgccctgaaagctgcagatggaggatgcacagccaggatcaagacaaaaagtagaactgggggctgagagtagaacccagacagggagctatcagagtggccaaagcagattaaccaccttggcatcccccaagagctattgagaaacgcaggagctcaggccccactcaggcctcctgagtcggacagaatcaagatcaaattccagacgatttgtgtgcacttaaagtttgaaaagcagggggaaaaatacaggttttaagtccatgtcttaaaaattgcctccaagctaataaggaggtgtgggggaagcatttaaccttgcatggtgtttcaaggattattctccctgctcaccaattgataagcagagataattttctttaaaattcaaggttttctcttggactcagcacagcacagctccctaccagacaactctccctgttgcccccgttctctccctgtctaccggagaatcccagcttttatattattttatgactaagacatccacgtaagtctccatttgaagaaaggcttccaggactttaaaacatctgaaaattctccagggcataaaatagacacattaagagacagtttaaagggtagctaaaatagtttacaaggcaaataaaaattagaatgaaaaatgaatcaaaataaagtggtggcaaaataagtcaaaataaaagttcaagttggttacacgagtttgtttactttgtgaaaatgtatcaagctgctccttagaccccagcattggcttccaggcctctgactaaagctgcacatctcaaagtccactccacactgctctgtctattctactcagcttcttagcttcccccagccaggttcatggctgaccttggaacgctcacctatcaatatttctcaacccctaaatgtaagaacctcagatcattttatattatttctgacacatttttctatttttctttctttcttttcctctttttctttctttctttcttttttttttttttttttggttttgagatggagtctcactctgtcgcccagactggagtgcactggcgcgatctcagctcaccacaaccactgcctcctgggttcaagcgattctcctgccccagcctcccaagtaggtgggatcacaggtgcacgctaccatacctagctaatttttgtattttagtagggatggagtttcaccatgttggctaggctggtcttaaactcctgacctcaagcaatccacctgcttcaacctcccaaagtgctgggatcacagccgcacgccactatacccagctcatttttgtattttagtagagatggagtttcaccccatgctggtcttaaactcctgacctcaagcaatcgcaatcaacctgcctcaacctcaacctcccaaagtgctgggattacacgtgtgagccaccacgcccagactctgacacctttttcaaaagacccgtgtgtgtgtgtgtgtgtgtgtgtgtgtgtgcatttgtagataccgctattcatcttattctgagtctttagccttattgtgccacacataacttgaagttgactttcagctacagacaaatgatgtgtccaactaaactttgttacatctcctctataggtgaccagtgaatgatattttaagttaatgtattcatcagccccttttgtatatctctttcagagagtttctatgggagtgggtatagaaacataaacaacttcaagtcatctcccctcttgatgtctctcagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaacccagcggttatttcttggggtcagagtcaaccttcttttgacagggaaagtggtgggagcgggcataatgccagtctttagggccatcatgcctaccctgacagggcacatccatgcctgtaaaggatattgggatgctgcaatgtgtgtgccagaggacacagttgtccttgctatcattccaccaccctccatccaggagtggaattacacttgccattgtttgcgtaatggagaccctctcttcctttctctcttccttcctttctccctgtcttccttgaccaaagttaagcaaggcaaaacagtcaaaagttttttgacataagttgcagtgacaagaactgacagagcacttgatgtaaattttcttataaaacagattttaaaagtgtttacaatattgataggataagaaatgtatgtgtgagttttatgtaaatgttccagaggcaccccaaatgcaatgtattaggtacttatttctgtgttacaaatggctctaaaatctaggggcttaaaacaatcagaattatctcttatctcttagcttctcaaaaaaaaatgtgtgggtacctagtaggtatatatatttatagggtacatgagagagagatgttgatacaggcataaaatgtgtaataattacattagggtaaatggggtatccatcacctcaagcatttatcctttccttgtgttagaaacaatccaattatactcttctaattatttttaaatgcacaataagttaattgactgtactcaccctgttgtgctatcaaacactagatcttattcattctgtctaactacatttttgctcgtattaatcatcctcactccctcttttccccaactaccctccccagcctctggtaaccatccttccactctctatcttcatgagttcagctattttaatttttatatcttaagaataagtaggacatgtgacgttcgtctttctgtgcctggcttatttcacttaccgtaatgacctctggttccatctacgttgttgcgaatgacaggatctcatttttaatggctgaatcgtactccattgtatatatgttatcatgtttcctttatccagtcatctgttgatggacacttagattactttcaaatcttggctatgataaacagtgctgcaacaaacatggtagtgcagatatctcttcaatgtactaatttcttttcttttgtatatgcctagaaatgggattgctggatcatatggtagctctacttttagtttcccaatgaatctccaaagtgttctccatagtgcttgcactaatttacattcccaccaatagtttacaaggcttcccttttctcctcattctcatcagcatttatttttctctgtcttttggataaaagccattttaactgggataagatgatatctcattgtagttgtttgatttgcatttctctgataatcaatgaggtagagtatacccgtttgccatttgtatgtcatcttttgaaaaaatgtctattcagatcttttgctcatttttaaattggatggatttcttttctaaagaattgtttgagctacttatatattctgcttattaatcccttgggagctgggaagtcttaaaatgttttctcccattctgtggattgtctcttcactttgttgattgtttccttttctgtgtagaagatttttaatctgtgtgatcccacttgtctattttccccccagttgcctgcacttgtggggtattccttaagaaatctttgtccacttcaatgtcctggagagtttccccaatattttatcttagtagtttcatagtttcaggtcttagatttaagtctttagtccattttgatttgatgtttgtatatggtgagagatagaggtcaagttttattgttctgtatatggatatacagttttcccagcaccatttattgaagagactgtcctttctccaacatatgtccttggcacctttgttcaaaatgagctcactgtagatgtagtgatttatttctgggttctctactctgttccattggtcaatgtgtctgtttctatgccagcaccatgctgtttgggttactatagctctgtagtataatttgaagtcaaataatgtggcctccccagttttgttctttttgctcatgacagctttggctattctgggccttttgtggttccacataaattttaggattttttttttctatttctgtgaagaatgtcattggtattttgatagggattgcactgaatctgtagattgctttgggtgatatggacattttaacagtattgattcttccaatccatgaacatgcaatatcgttcctttttcttgtgtcctcttcaatttcttgcatcaatgttttgtagtttttatggtacagatctttcagttctttggtttaaatttattcctaagtattttacttgtagctattataaatgggattatcttctcgatatcttcttcagattgttcactgctggtatatagaaatgctattattttttgtatgttaactttatatcctgcaactttactgaatttatttctcagttctaataatttttggtggagtcttagctttttacaaatataagattatatcatctgcaaacaaggataatttgatttttcctttccaatttggatgccatttatttccttctcttgtctgattgttctagctaagacttaaagtactgtgttcaacaacagcggtgaaagtgggcatccttctcttgttccagatcttagaggaatgacttaccatttttttcaattcagtgtgatactagctatagatttgtcatatatggcttttccttctgtgtccagttttgttagggcttttatcacaaagtgatgctgaattttatcaaatgttatctcacaggttttttgagtcaggaattcagagagggcaaagcagatatggcttgtctctatgatatctggggcctcagccagaagattagaggtctagggctagaatccactcacacatctagtggttgatgttgtatcaagtgggagcctagctggggctctggggtggaatacttgctcatgccctttctatggagaagcctgggcctgggctttttcacaatatggtagctggattccaaggaagagcctcctgagagagccagacagaaaccatcaacatttttataaccaagcctcaaagttacatacatcacttatgccagactctattcattggtgctatcacaagcctcttcccagattcaaggtgcagtaacaaacatagaccccatcttaccttgggaacacagttgatcatcctgaagaagtacatgagggatggaatgaatatataggcatgaccatctttaaaaaatataatctgccacacacagtatgcatgaagccgaatttgtgttaccttcaaagctgctccacctcctttgctttctacatcagtgaacaaaaccagtattacaaatcacactccagcctacacaaccttatggaccattccacctcataggctttttaactaccatttctttcaactgcttcatccatcctttctctttctcttaaatcactcccccagtacacgcacacagacacacaagttcctttggttccctcctttccctggctaacttctatttatcgttcagtttataacataaatgtcaattcctctaggaaccattcttggatccaccaaagcttctgccaggccccttcatctattctcccaatgcaacctgtatcagtcacccactgctgcataacaagccacagcaaaacttgatgtttgaaataactaccacttactattggttgtgggcctatggatgggtagatggctctgctgatctgagctgggctgggcttatctcagctgggctcatctatgccgctacggtaagctgagagctatctggtggctgatcatggctaggctcattgacatgtctggggccttggctggaacaaccgggctgatgtgactctaattcataggatttctcatcctctgggagataaaatgggtatccaataaaatattctccaactattaaaaagagttaaatactgatacatgctaaaacacagacaaatctttaaaactttatgctaagtgaaagaagccagatggaaaaggtcacatattgtataaatccagttgtatgaaatgtatggctttttcacatgtcagaggcaggatataaagaacacataaaagtgctcaaggtctcttgaagtctaaactcagaaccatgcaccatcacttccaccacattctattggtgaaaataagccaaaaggccagcccagataaagaataaaaggagcctccaatgtcacaaggaaaaagatgtagacacagggttgttactaaggtaatcaatccagcaatgccttgttatttcttccacatagagagtgcatgccaactccatgtaatggccttcttactaaatacatcctccatggacacctttgatgtcagatgtcatgtctcatttacgatgaatctgcacactcaccctaatgtcataacttaataaatattgcatttacagtgaataaatccatttgcttatctagctattagtgctacattagaggaaaataaacaattggctaggtacaaaggctcatgcctgtaatcctaacactttgggaggcagaggtggttggattgcttgagctcaagagttcaagaccagcttgggaagcatggtgagacccaatatcatttttcctattttaaatataatttttttccctttcctaaaatagaaaaaattagctgggcatggtggcatgcacctctagtcccagctacttgggaagctgaagttaagaaaatcacttgagcccagaaattcaatgctgcagtgagccatgattgtaccattgcactctaacctgggagacttagagcaataccctgtctcaaaaacaaacaaacaacaacaacaaaaacaaacaaacacaaagcaagaccagaaaaagaaacaactgatatctcaattatctcaataataaatgtcattaagtcaatgctacaatgctatttaggtactttctgagtcagcaacactataatagtaaggctagactacacaggagccacactctttgcctttgacttagggtaccaactccaaaacatgaaagagctagtaactgatgaaaccaaatattattttctgagacattggtgaagaaagtggggcttaccttagatcctggggttaccaagcagactctttttgcccataagagaaaattcaggagcaattcttgcccctgaacattcatgtattgttaaattgcttctttgaacactctggatattgtatctgtttgtttgttttatgtttctctctgattctggatcttttattctttttaatattgtatttaatttttttagaggcacggtctctaaaaaaggcatagtctcactctgtcacccagtctggagtgcagtggtgcattcatagctcactgaagtttcaaactcctgggcccaagcaaccctcccacatcagcctcctaagtagcggggactgcaggtgtgcacaatctagctaattttttaaataacaactttataattcatgttccataaagtacactgttttacaaagtacacactccagtgatttttagtgtaatcacagtttcttattaatcatcaccctaatttcagaacattttcatcaccccaaaaagaaacctcatacccataagaaaacacttctcattccctcccccaaacattctctcttcagcccgtgaaaaccattaattctttttctgtctctgtggatttgcctattctggacatttcatacaattgaatttatacattatgtgaccttttccatctggcttctttcacttagcataaagttttcaagattcatctatcagtatttaactctttttaatagttggagaatattttatcggaaatatattttatttattcattcacacctgatggacatttgggttgcttccattttttggttattatgaataatgctgctatgaacatttgcatacaagtctttatgtggaaatatgttttcagcttctcttgggtatatacttaggagtagaattgctatgttatatggtaactctatgcttaaccctttgaggaactgccaaactgttttccaaagtggctgtaccgctttaaatacccaacaatgtatgaagcttccaatctctcacattcttgctcacacttgttttctgtctttttgattattaatatcctagtgggtgtggaataatgtctcactgtggttttcatttgcatttctctagtaactaatatgttgtgtatcttgaccatatgcatatcttcagtggaatgtctgttcaaatcctttgcccatttttaattggttgaatatttgtttttaaatctaggtctcctttcttgatttttggcctctggtgattttgtggctgtccatcacaaaacctcatcttaggaaggctctttcaattattatttctccgaggctactgaacagctgtaggttgcatagaaatagtcctggttgttttctatgtgactccagaaagccatttgtctgcttattgttttactaaatgtcaaatatttgtttatttccccagacttctctttcttctaaaattagagtacataaaatgtctgataaatgtgagttgcattaacttgcatccagtaaatttcttacagaagaaaatgtatttattaagggcaagtgaaagtttgaatattgcaatggcgatcttagccccacacactttaaaagttgaagcaaattacataacacattatccaactgatgctgtcaagaaattcaatgtgtcaataagaaacacaccaataacaaaggaaaacaaattaccaattaaattatgactcctcatcaaacataaaggcattcaatacaatttcaggaaggttaaaagcaaaagtatatcttagaatcagtgaaatatcataatttggtttcttttttttacttccaaaactacctgttctataagaacctatggttgtacgttaatttatttaaaaccaatagaaagcacaatctccaggcaggattgtattcaaagtaaaaataccccaagaccagaaaaatagctggaaagcagagataagtttgtactaaacttgctacaaaaagtgcccaagtaagatttgattcataatctaccagagtctcttaacattgctttcatcccctctttgtctctctcgtgattgtcactgataaagaaactgccaccaaaaccacccttaaaacccagcttgtacagctcttgccttttctcccctcaccctcatctctgtatttactctattttcttgaaccatctttaatctttgcatgaatcctttaagctttccaatgtgaatcactgtattctttctgaatgctctagtgttgcttcattcagccccccaaaggctcacaaataaagcaggcaaaaatagaattatctttacactgggagaggctacagctacaccttcgttaacatattttccagtaatatactcaatcaacacatatttaataaacacctactatattctaggcattgattctgccataggctcagtcagatttaaagtgcatgtttcttggtaataatcattctcaggtaagtatatctttaagtccactctctgtgcctctactcagactctgtgtctctaccccaacacagtttgacagaaggaagggtctatttctcttttctcacagctaggctaatgctatgcaagtatgcactcttgcacgctcacacacacacacatacaaaccccagattgtggcagagggtcttcagcatcgaatggtatttaccatctttttatcctcacttgcaatttacacgcagcaaacggccaccccaagttttggaacctaggatatagcccaagagacagtttatgagttcaagtagtttatttgggagatgaatttgtaccgaaatctctattaaaaatgccaaactaggattgattcacaacacattacaaagtctctactttccccatcttttcatctccctgtttattacagtcacagattaaagacctgcccctaacatttccctcaattcccagttgatttattccattttctttctttcttctattttctttaagtgaggtgggagtgtgaggaaagttattttgatgactgggttatcactgtgaacaaaagtgctcaagccccccagtcaaactcaaaaggccttaggtgcacccctcacagttaactcaccaagacatgaagaagctgggacatttacccaccatttcccatcactcattagttgaggctttctgctcaggcactagctccttaacacttccaacttgtgcaatttattagccaagcatgctcctgtggcaagaaagcatcctcaggcagaaataaaaaactctttaggtgaagagagatttttctcaggtgatctctgaagaaggctaagggctacatcctaacacccaacatgtcaagaaaggttgcattccatctgtaagtaacatacacggaagagttaggtaaactggtttccataaagctacctatgcactaggaattatagatctttaattgttaaacctcaaggcacccccttgcccaactctgagacttatatgtgaccataattatagcttgactcatcctcaaatggaaggacccagggaataagcctatgccagccctagaattgggcttggaaacatttgagccaggaattctagggtgctggttatagtctaaaaagggtatgttgcctccagtttggcattaggccaaacagatttctccttgtggggtagacacaaccaggcaaaggccagagttaagacctctaaagcatgaggcccaaggcaagcacttctcttgcctggatccaggacagtattgcttccaaacataagcagctggataatatcaaaaatattaaataatataatattgtccctatctgatatggcttggatgtttgtcctgtccaaatctcatgttgcacatgttgaaatgtgattctcaatgttggaggtggggcctagtgggaggtcattgaatcatgggagtagatccctcatgaatggtttagcaccatccctttggtgataagtgagttcttgctcagttagtgcacatgagacctggctgttgaaacatccgagacctcatttctctctctgtctcttgctcccactctgaacgtgtgacatgctggctttccctttggcttccaccattagtaagagctccctgagcccctcaccagaaactgagcagatgccagcactatgcttcctgtacagcctgccaaactgtgagccaattaaacctcttttctttatcaattgctcagcctcaggtatttctttatagcagtgcaagaataaactaatacaccatatgatctttcatttactcaaaagtcaagcctttctgtgtttcatgtctcagagaataaaagcagtaaggtggaaagctgaaagtctgtgaatctcttcctggcatttctcattcaaaaacctgaataattggaagaatggaaaggattccagttatggacaaaatgttgaaagaaatcatgaaacaaaataatgtctgcctgatctgagaaaaataaacaaaataaacagacatggggggtgggtatgttaaaagtatagatgtcagaggttcttgagaaagaaatttagtctctttatgcaaaacaccaaagaaagaacgagatctcagagggaccacagtcaaccttagcaaattgtactaaggcagcttcaataaatccctatattctagtgtggcatggaaacaacagaaaaattccagaattcccaaggttgaaacagacaaagcagtgagaacgattgaatataaatggactaggaggacagcaacaacgtagagtggtggatgtctcagcagaggcctgcatagaaagacgacattgaggatcagtgggttctccttctggcacatcttagcgctgtgtaagcctcttggaatttagctacaactgaaaataagtgagtttctcttagcagatgggcactaaaaaaatgaactattgagttacataaaaacatcttaccaaaagcttctgaatcatgaagagagtcatttatacccaaaatgactgagcttatccgaaatgtcctttaagacctgaaggaatacacatgtatatgacacgaaagataaaaggttgttccactggccaactatgatgaagaaagagctcccttagagattcccatgttgaccactgatttttcttctcagtgcttgaaaccttgctgataatgttttcttaaatttccagatttgcccttcctcttcttctaagatttgggcacacctgaatatttaccttaatatgcttaatgccatacactgtcctttctattccaatggcccgttacggtagtctgtggtccagtatattgtattatcctacttattatgtgctggattctaattctgaggaaagaaagccattgtttatgctgtttatcttatttactgcctgcctaagcactgcataatgcaaagggagattagataaccacatgttagctattccagctgtccatggcctctcaaatcctctctgctttttgaaagttccttcttatgtcattcagcacatcaactttataatggcctctgagacagctaccattttcagttagcttcctagttcccaattttcctaacctatcttccaatttaatgattctcttttcagctgtgtctaatttgctgttaaatctgtctgttgagttgtttgctttttgtttcagctcttgcatatttttatttctagacattttttggcattcttttggaagtgctagatcactcttcatagttttctgttccctgaacattatttctacttgtctttttttcctttaagtatagtaagatgttttataaatgtcagcttcacaggttagtttctactggttcctgcttaaagtgctttattgtcttgtgtgtttaatttttactgaatagtacttattttccttgaaaaattatttatggccattctctaggatctaggatggaagtgccttctgagagaaagaattcatgtttgtttctacatggtgcctaggggagtagctaacctagatctcttcagtgtttgtttgtctatttttgatttggttttgttttttaatgtgtctaaaccactaatgtatacaatatctcattttaagaatacaatttctgatcttgccactgcactccagcctgggcaacaagggagactccgtctcaaaaaaaaaaaaaaaaaaagaatacaatttcttgtgaggccagttttgcagatacagcctttttgggaaaactttttccctagctgagaatcaaagaaactttctttgcaggccctatcataaagacagtgttaagattacttctaatttttctttatcctaattttgaatcctttgggacacctgcttaatggtcaaatggcctcttattagactttctgatttaaattaactcagactttcatttttatctgtcccatggggccatcaaaattgaagttcaaatttgccaggattggtaaacaatgccttcagtgctctacttacctctctggattctagatttcccttagagtttggcctgataattacatgctatcttgtatcttcattatttttaaaaggttttgttttctactttatctagtactttagttgttgtctcagaaaagttattgagttcctactggatatatttgaacatttttaactatttttctgaaaaatacattcagtgatacccagacctggccctgcatctggttaacatgaaatgtttactcttagtctcctgggaaagtagccaatcaaagtctaaaaatgaagtggctcatttgttgtttggggacactccatagcatcacactcatagcaactagatagaaaaatatcaggtagggatggcaaagccttcttctataatctaaagaccttcaagttgtcaaatgtatgtatgatatccttgtaagctaaatttagcacctagagctccagtttctgtctaagatgtgtaaaaactcatctagcctgacagttccctgttggctgcacctctgagaagtcaattattctcaacaatgccaattttaatttatccaccctaaattactcccaaatttctatgtgtatttttaatagaaggtataataccaaatttaagtgctaatggctttctggacagtgatataaaacctgacccttggtcatcaaattgcctgaggaaacagatgttttgattacattatatttttcactaagaaataagtataagatcaattattctttattttatctccagggcttatagtagggccaggcacaattaatgacaattaataaaggttgaataaattaattaacctgtggtagattggttgcaaaaaaaaaaaatggcactaattcttcacagacttcctgtatttttataatgtgactttgcagatcttgccatgaagaggccatgtctcttctctatccctgaatctgggctggtcttaagataggccttggctaagagagtgagttactctattattacaggtcccagattaggcgtctttttttttttttttttttttggaatcctgttaccaccatgagaacaggcctttgctagcctgttggaggaagagaaacctcataaagcagagttaacctcattttcccagctgaaggaccaaacataagatagagcccaaccaggatcagttcagccacctagccaagcagcagctgaccacccagctgagtgagcccagctaaggtagcagagctggttcaaagcagcggaactttctagccaatctgcaaacttgtaagcattaatgaatgatttttttgttttagccactaaattttggagtgcttcatttacagcagtaactaacttgcacaaaatcattgttacaaacccttctaggggtattttaaaagaaaggacaccaggttgggaatcagaagtcttcaattccatttcactctctgccatgagtttgttggtcttgcacaaaacaggccttctctgtgccttagatttgagattcctttgagttctaatcttatttttcatgtggaatcttccaaaatgttttactctgcattcctgccatccctcatgatacagtgagaaaagttgattttttttgtatacttgagaatgtattgagtctccaagggatttgcttgcatatcaagtattggaaattctagaaaattgagctgatgtatccttactctaagccttctctaaaagcatatttttagaataaatccttactgggagctttctgtgatttgtgttttcttttgtttttgttatgttattctcaaagcagaagtcaaacaaacaaactctattaaaataaatatccttgttaatcaaggctttagtgaactttgttccttttcatcatcccaaaaaggaacacaaaacagtgatttaataatggaacaaaaatatcactcagaaaaagaaagaatcctggctaacaccttgaaaccccgtctctactaaaaataaaaatattagccgggcgttgtggcgggtgcctgtagtcccagctactcaggaggctgaggcaggagaatggcgtgaacctgggaagcggagcttgcagtgagccgagatagcgccactgcactccagcctgggagaaagagcgagactccgtctcaaaaaaaaaagaaagaaagaaagaaagaaagcactccaatattcatctgatttttactaattgtttatattattggaatagagataattgtacttcatagccttcaattctgaaaagtataatggattcatatgtaatggactcaagcacacaaatttgtgtttatgcaaggggagcccatgtgacaatgattcttagtagtggagattagggatctcttagagattctgatgtaaactaagaaccttgattcagaaaatcacacaaatgtaaacattcacatagtagactttttcatgatttttgcctcctcagcactttataaacactgttctttttttttttttttttttgagatagagtctcactctgccatccaggctggagtacagtggcacaatcccacctcccaggttccagtgattctcctgcctcagcctcctgagtagctgggattacaggcatgcaccaccatgcccagctaatttttgtattttcagtagagatggggttttaccatgttagccaggctggtcttgaactcccgacctcaggtgatctgcccgcctcggcctcccaaagtgctgggattacaggcgtgagccaccacacctagcccaaacacttttcttatgtttgagaattttttccccttcttaatctgcatacctccggagtagaatctaaaaattcacttcccgtggttgcatctatgacacagacacatggtccataatcaactattcaggtagatatacacaggacatctatttgaaagcaaatgatattcaaacacatgcactcacagatccactctggctaggttggaggtgaagacattgagatttcagacacagtagtgcgtgggcagaggtactagtacattatagtgcatggcatctaagtgaggtgcagtgactgttcaggagtcggggcatcagagtattccctgaagcattgtgcagtgtaactttagagatgttcctagctgtccaactttcagcctaattcttagaccctttcagagattctgggagtcatctgatgcccttcaataaatgcttaaattatgtctgcaacagagaactctgaccaatatatgcatatcaaataaaaaaacagattttgcccttaatttcaagatttttacaagatcttctgaagatcatgcatggcttagctctcagaatacatagatgctcatttgttatattgtcagtggagaggtgatagggaatgatgctgcataaggcttcttggtacagaagaattaacactgaatagagtaagcagtcttggccctagtcttggctttgctactatttacctagtcattgcacagtaagtggtgtctatgtcccctgtcctgaatctgggcaggattgtgaccattagaataaggtagcagtggtgctgtgtgacttccaaggctaagtcaaacaaggcaacagatacaacttctgccttgtagcttgggacaccctgagccaccatacaagaagcctgattacccagaggcctctatgctgtgagcaagcccagaccatacagaacagccatgtgagttgccccagttgagaggctcagctgaggtgccagttgaaagccagtaacagctgccacatacaactctataacttctcatacagattgatacatgagcccaggacatcaggtattacccaggactgtcttgggaaaattgatgtacggccacccttttgagcatctactctgtgctaagcacttgtgccttcctttacctctgtgaactccttaaaatggggtgagggttgttgagctagtatatatcacaaatctcagtgccacaaggataaggcaagtaacaaaaacacatgagacagctgaatttgagtaacagaacatgtcaaggacgtcagtaaactgaaaggcacacacgaagtctagagggaacagatattcagctcccatatgtattatcagaaagcaatgcaggcacaattatctcctaatactctgattttttttttcaaaagaagttaaaaatatacatttttccatttaaatttaaaacgttctagacaatttttaaggtagtctttatgggttggaggatttcagtggactctccaggctaatagtccaaaataaatcaattaatgtaaataccccacaaccactcttaggtatctgctaatcctggctctccagcaggctcactttggggatagctgttatttttgttagaggggaaaccacttctataaaaagccactcttttgtctcagaattctagattgaaggtaattaaagctcccccccgcctttttttttatcttgtgtgaagaagttttaaactatcatgtttagttatataaatgtccacccaggtgcaggaaaaaaaataccaatcatgaactctgtgtattagtcagctattattgtaaaaatgttatgtagcaaatacccaaataacttacaacaagcattaatatcacagtcatagattttggggctggctaatctaggctgggctcagttggatggctctgccttacactgtgaggcagctaactatggcttacattcaggtcttctccctctgtgtttcttctgagattcagggagaaatagcagcatctatccagcagcaactctcctcacagcagatcaccagaatgcaagagctaagcctaattgaacaagttcagctaaggtctctgtttgcctcacatctgctaatatatcactgaccaaagttaagtcacaaagccaagcacaccctcaaagggcccagaaggacactccaccaacaatagaaaggggaaagaagtgaatgcttactgaaactaacccaaactctcatatcctacgtgtctttttgaaaagctgggttcttttctaaatcatccccgaacaacctctctctcaggcctcactggctccccatggagctgctggactctgggacgtcaccccaagtggattttggcctgctgtgagcgaaacacgtggtgggtggaagcaaatgccgaagacttggaactctcaggacaagtgctctaaattaggaacaaagcattccatgaactacgtcaaaactttaaaaataagcctttctccatgcacagctaatgaccttgctgaacacatttaaaaatgtctcatttaagatgtttaagtaattactcaggaggagtgaccataaggtttttccatcccatctgtgccctgcctctaagccctctctttcccttcattgccacgggtcctggttcccttgcaggctgttctcatgtaagacagcaacctaatgtaagaaatctacaaatcaatcgtgcctttgggtggcttctttgctaagaatattgttttatttactctgttcttttcatgccttctaaggagaaagaagacaactactgtcacagagagtatttctttaaggctgagccataggggaccagaggatagagaatacctacaatggtctctgatcacaaactcctttaaaatattattttttaaaagaaccatgaaacaaggtgaacatgctgcaaattcaagcctgagtaaataaaaaaccccacataacacctgatgttttgtaggagatgcaaaaaccagggtgcatagaaaacctagaagtatatattagtcggaagtagactgagatagtaggatagactgacccaggctctcaagtttcttatttactgtgtaactcaagataattgggctacctcatggtcaatcttggtacgtggttacattccgaagaaacacaagtgtctcatcaaacaaaccaaccaagaaatatgaaaatcttccatgaagactcaaagagatgtcaaagatagaggcaaattgtattgcataacacatcacactcctcttccctagcttcttgaagtcctacatctcacagcaacgatttaatcagatttattaatttcaattattcccatttgtttctccacaaatttttttttctttttttttttttaaaaaaaagacctggggccaagcataacggctaatgcctgtaaacccaacaatttgggaggccaaggcagaaggattgcttgaggccaggaatttgagactagcctgggcaacacagcaagaccttatctctaccaaaaataaaatacttagctgggcatgttggtgcatgactcctaggtacttaggaggctgagggaggatgatcacttgagaccaggaagtagaggccacagtgagctatgattgcaccactgcactttagcctgagcaacagaggaagacccctgtctcaaaaaaaaaaaaaaaaaaaaaaaaaaaaaggaaaaaaacagcaacctgggacctaaacagatacacaaaggatgcactggaaggtagagagtcagtgaatatgtatcagtagaatgtatgccttggtcacacttgctagggtcaatttccatacctcagacaagcatttgctctcatgttgggtccagagctcccctggttggacattgtattcaaagccacgctccagtttaaaaaatagaattgaggcctaaaggctttggttctaaccccagtcccatcacttaactagctgtttgcacttggacaagttactttgtttttatgaacctatttcttcaactataaaacaggaattttaaaaaatcctacctcaaggtatcatcatcaggattaaatgatatcatggaaatgaaacctggacacaagtggggactcaacaaggctgtgtgaattctgcacaacagtgaggtttagaaagtgctttgatcacctagatacgccatttttcaaatttctcttttatttatattcatcccctaaaattatattaaggcttccttactgctgtggactgaatgctccacagcctgccacaaattcacacattgcaatctaaatccccaatgtgatggtatttggaggtcaggactttggaaggcaattaggtcataagagtggagccttcatgataggatttgtgccactataagaagaggcacaatagagatgatctctctcagccaaggtgacaatacagcaggaaggtgccatctgcaaaccaggaagagcatcctcaccagacaccaaatctgctggcacctggatcctggaacccatcccagtctccagaactatgagaaataaacgttagtcatttaagccactcagtctatggtattttattacaaaagcctgagccgagtaagacagactcatatagtgccagtccactgaagtgtcttttgaatttctataggtaggacatccagccttgatttcttttccacatgtgatgaggacaagttagttaaaaagatgacagaggatgacttgggctaccctagatgatcctttctcaggaaagaatgacaaatcccaaggaaccaggtacctgctttctgagacacttcctccactcctcagtcccattcatatgtttgccctgttggtggcttttataaagtttattgagctttagtttgtctctgcctgcctttattgactatttaaacatgcctgaaacatctggtcccctgagagcttttaccaaggtctctggagtacagattaggttgtcatttgtccaatttgttgtcaaattcaaaagaagttcttctaaactgaggggattcaggacagctgcatggactcatctgtgagcacccactgagagggtaaaggaggttgaaattaagccctgagtcatgacactgggttgaagcatggtgagagggatgtcttctttgtaagttgactgcctgggggaaatgctttttttttaatctggtgattctcaaaggtcctgcagggctggctgcagtcctaaggacttttagtacaccttctgattgttcatctgagaaaattgagactggaacttatcagaactccttagagggaagatattactatatggacaagatctataattgctctcaaggcttttcatggaagctattatctatccaagagagaaaaaaactcagctaatgtccacagtccaagctaacatattgagtaaagggcctcagaaaaagtaaaagaaatatacgccattttaaaactacaaaagttagtcttcacaggagattcaagttgtcaagaattggtggtttcatttcattcgcttaagttatttaacaaaacaggatatttatcaaaacaaaatagtgtcttcacactattagacattctcctctattaagacaatagccatctgctggagtcatatgtttactaggacaagaatttttggtggggtgtggtggttgacgcctgtaatctcagcactttaagagactgaggcaggcgggcgacttgaggccaggagtttgagaccagcctggccaacatggcaaaacctcatccttactaaaaatacaaaaattagctgggcatggtggcgtgtgcatatagtcttagctatttgggagattgaggcacaagaattacttgaacttgggagtgggaggttgcaaggagctgagattgagccactgcactccagcctgggcaacagagtgagactctatctcaaaaaaaaaaaaaaaaaaaagaattatttctcattctacacctgcattattgaccatttcaatacatgtttgtaaactgaaatgtcttctcaggcttgataatgtgtcaaactcttcttcaatatagaaagaaaagttcagcaaagagatctattatcaaagttgccatgttccttagatatttatgtttgcttcttgcactagagtctgaatccccatctcccaccactgagtgtggatattaccctgattcttttccagtgcctgatttagatggatactaaataaatgcttcctgttttaatgaatgaataaactaaagttatgtcattacattgtctttcttttcaaaccttgatgtgaaatttgttctatgttggcctggcaggaaagtctccttaatgctggaattctcacataatataagttatagtatattccatatactgtataatagtatatgttacaaatgattatactatacaataacatactattattataatataataataagaaggaatgtattcttgctggtgaaaaatgttttttatatacacatatttgaatgtgtgttttatgtttgttatactctttatataatacactttataaaacacacacacacaaacatatatatatgaagattttctgttactttatcatgatccctaacaaataaatagccttgtctagccattgttcggaattgggaagtagacaaaatttctcattgctttcaattgatgagacagatgtcccaagtattgtctttcctgttcaagtagacataacctggtaaatgtatgcattttaacacaataaggatgcttctctagaccatttttccttgaagcgtggtccatggacatcatctggggacttgatagaagtgtagaatattgcccctatcctagacctactgaattagaatccacattttaataagattctgggttagaagaacatagttaaaccaaaatttggagacctcaatgactgctcagctataccgtgggaggtagtcaatgcctacgacaaggaagtccctactatccctcccagttcctgcatcttcctccttgaatttgcaatagatgggagggcagtcattcctaaacccatccttttctctcagaactggtgactggggcaaaatatgtgctttaagtggaattaataataaaatattaacccttcatgaatttgtgaaaatatttcatcctatgtttgttttctgggcttgtcagcctgggctctccttcttagaatgaagtcactatttatcttgctcttatgctcaaccttgaacagactgcttatgaacatttagtttttagtgttttctaaagatgatgacgataatgataatgacagtgatggtaatgatatgctgagagtgcttcaaatgcctcctcctaatcattctcaacaatctgcttagaattctaagtaaccagtgattttcaaaccaagacctgcagaggcctaggtgctgggtcactgcaaggggagaggaaggcaggaggtaggatggctgaatggcatggctgacccacagggactgaggttaagttccagaggatgggggacacaaacccgagcatctttactttcatctgcttttacatattgaagcctggcaaagccatttttttaacataaatttcttaggacctaatattctcctactaaagcaacctagattactactgtgatccataattagtatatcttgaaatacttagtattcatattttcctgggaaggaaagagaaacatttaagagaataaaaaattatattttggcttgaagcatattcttcaatccatgcaggttgatagactttgtttgcatatttcaaattcagacttaggttttagtaataccatgagatgttatgatgagggaaatccagtactgacaacattttaaaagttttaaaggccctgaattctttgaaagaacctggaacacacaactaagaaatgtcatgggagagtctccttgtacgggtacattctgggaagggtgatgaaaagaaaaaaatctccttggaatgtgttaaattcagtttagtctggcatcaaaggaatgggctagatactcattagtgacctgatctattacaataattctacacttccaagtttacttttgaattcctgaggtagaaatccattttagttgagaactacaaaactggcaaattaattgtattgacaacaaacccaaatttccaatctttccattgtccattccttttgccatcacttggattcataatcttttcaatccttagaaacacattgaaataagaaggaacaggaattatattcatttcaaaattgttcctaggttatgtgtgtggcagactatattttccaaagacaaccagcagatcttgctcctacagtgtgatggtgacaccacttccatccgataggggacttatgtccttttcccttgaacctgggcagaccttttgtgactgccttgatcaacagggtatggaggaagtgacactatgagattttcaagaccaagtcaaaaaatactggcactcaattctgccttggtctccttgatcactagctcttgcgaatgcacctgccatgctccgaggaagtccaagccatgtgggtagaccacatgtaggtatcccagcttacaacctcagtggagcttccagccaacaaccagcatctaccaccagacatgttcctcagggagcctttacatgactccagcatcaaccacaatttgactgcagcctatagaggaagaaaaatatcatttccttctacccatcttaggttattggctgaaggccttgtaacaaaagacagatgaacaagagaaaaacgtgcatttttatgcaatataagttttacatgtcatgggagccttcattaggaaatgaagactagagaaagcagctaaacatgggtgtttgtatggtaggttttgtgaagaatggaaagtaatggagaaatatgacaggataaaaagaagagtctgagctaactggagaaaacggcaagatgtgtttgttcagattcttgttggcatcccttatcttggaggtaaagatgttcctttactctgggtatagggaggacacctctcacatgagggtcttatgacctgcttcaagggagaagggtaggggaaggtcagagaggccttcctgcacatgctgtttctcaaattatttcagcttaaaatgtttaatatgccaaggtgccatattttggaatagcatgtcacaaactccatcaagatccatgacataccccaccaagctgaaccccagtcaactctcaaaaccatgagagataagaagaaaatgcttagagttggtttaagctattgattttggagtgatttattacacagcaaaagagaagttaacactctgttaactagggcagaagaccctgtgatcctgaatggtcaactaaattttcttccctgaatgattatctcatcattagaagtagatggtattaattttaggccttaatagccttcatttcctaagggagctgctggacttagtttataaaccaaacacatcattctaccctcaaaaccagcacctctttccaactttcctactgctgttaatgacaccaattttccaggcacttcaggatcatctctgactagaaatgtctccattttcagcatattaaccactccgttatcaaggtcttttgatactttatatttgcaatgtcttctaaattcagatacgaaaatttctctagcaactttcagcctgttgacctcctgcctccacatccccagtcctaccaccataatagcctttttacacattacattgatcatgtcattctattgccccccaaatcccctctcctgcaaacagttccactacttaaactagtgttgcagactaatgtactgataagggctaatcaagtaatgggaatgagtaaattagggcatgtgtaagacaatagtgagtgagggaattgcagtaaactagattatgcatttctcatctaagagaagtagaatcgcccaggtcacaattgttctcaaacagaaatgcaggcccagtattttcacatcatgtgattttttttcaagggaagatggcatatttctatgagatatcacccatcagatgttggcatctgagtcagtccgtttttactgggtaatacaccattccaaaacatagcttaaggcagcaaacttttacatagtggatgattctacagattagcagtttgggctggactcaactgggtagcttttctgatcttagcagggtttccttttagatctgtggttttttgctatgttggattggggaagggatcagttcttttaggaaagggtcagccatgagggcttgtctttgctccataagtctctcatgctccagcagactagcctggctttattcatacagcagagtcaaggttccaaaaataattggaaacagccaaggccttttgaagcctaagcttgaaactagcacagcatcatttcctctgcattctattgtgcaaagcaaatcacaagactagttctgattcacctagtggagaaattgactacatgtattgaggggaggagataaaaagttacattgtagagtgaatggatattggaagtagaaaaggattaggatctttcccacagtctgccaaaatatttttttaaactttaagagattcctgctaaaaagaatatgaatcaaaattatatgtctccacttggctacctgtgcttccctcttatgccctcactcatagagccacacttttctcttaccctttctctttctccttgccattattaatgcattggctccaagcacagttccatgcaggtcatttgtccttcatacctgccctgttcattttcatatttgaatgtgaatcctttgctcactcattaggaatggcttttattacctcttctgtagttcattttctcatttcctcaaaagcttcctcaaatctctgcatttccatgaagcattctttaaatgcatcatatttaatctcacccattcattacattagctcgtggggttttttttgcacgttatttatactttgattgacactactttatattgttctttaatatttttgcttgtgaatgctttgttttctcaccaaaattataagtttttagaataacaaaaccatgcaattttttcatgtagtaatcacaaattgggatatgtattatcaattagctattgctgagtaacaaatagtcccacactaaatgatttaattatacccatatagttagttcacagttctgtgagctagcaatttagggtagacttagctgaatgattctccttgttctagccaggtcccctcatatgggttggttttgctaatcttgctgtattctcccacatgtctgagtcctcagctgggtgaaatggacaaatttgtctgtgatccacatattctctcttcctctagcttaggcttgctcaccatgtcacagctaggaagagtggcaagaaaatgagtgaaaactgccaaggcttattgagcctaggctgagaactggcaaattgttacttctttgaattctgttgattaaaggaagtcacagggccagcccagatttaaggaaggagaatatagactcttgtcttaagaggagaagctaatatcacattgcaaagagattttgatacagagaggagagtagttgcagccatttttacaaataatctaccaaataatgctggcctggctcctatggattcttggaggaaccacatctgtttatccttctcattgtgtggaatttctctttcctcaatttgagctatgtcattagtgtaaaaattgtatcttcttccataatcaatgctcctctggacaaaataattggataaaggctggcctcctgtcccaaatatgttgatcacaataagttatctaccatttttcctcctgattcctgtaacagtgacctctaagactggtctagagatgtgcatacaatctaagcttttccagtgagaatacttctccagggcttttattattacaactggtgataaaaagctacgtttttctcctttgttcttggactaagagcccagccctgccatcacccatgtgcccagctgcataaagaagcctgccttcagtagaaaagctaaaactcagagaaagcagagctgatgatgtccaggtccctgctgtagcttcttttctacagattacttatgcagaagataaatttttctggtttcgcttgtgctggttcaaattgagtttctctcacttgaaagcagagaatcctgacaaatacattaggagtatccttcataatccagcacagtgctaggtccaccatgggttatttaataaatacatgttaaatacaaatagaaaataatatgacgtgatactatacaacccaaaagaatgactaaatttttaaaagacagacaataccaatgtcagtaaagatgtagagcaattgggacttttatacagtgctggtgaaaataaaaattaacacaaccattttgaaaacctctttggtagtatctagtaaagctggctatatctgtgctgcactctaggacccagtgattctaactctaagcatacatacagcaatactgtaaagatatgttcaataagacatatataagaaaacactactcatagtagcccaaactagaaacaacccaaaagtccatcaatagtagaataaataaattgtagcatattcttacaataaaatactatacagcaatcaaaatgaatgcaccacagttaatgtaacaaacatagatgaatctcaaaaacataatgatatgatttggctgtgtccccacccaagtctcatcttgaattgttgttcccataatctccatgtgtcatgggagggacccaggagaggtcattgaatcatgggggtgattacctccttgcttgttcttgtgatagtgagagtgagttctcacggtatccaatgatttcataaggggcttccccactactttgctctgcacttctccttgctgctgccatgtggagaaggatttgtttgcttccccttctgccatgattgtaagtttcctgagatctccccagccctgtaaaacggtgagtcagttaaacctcttttttaaacaaattacccagtcttgggtgcgtcctttatagcagcatgagaatggactaatacacatgatattgagcaaaagaagtcaaatacaaaagagtacatcctgtatgattttatttatagagtacaaaacaggagaaactaattttcactgctagaaattagaataggcattatccttgtgggggagttgttactggaaacagaacaagggccttctatactggctccatgggtgcataaacttatgatttgtgcactattctatatgtatgttaaacatcaatctaaagtttacttaaataaattgaagaagaaatggttctgtggatctttggacagttgtatgctggccaacttcttcctctccctccaagtgctgtgcctgacgcctcctttctctgtagtagaggggagaggaggtgagaactgtaagaagcacagctatccccataaaagagcaaagccatcaagagaaaacacttctgtgacaagggaaaaacatgttcctcgactttccccatctgtcacaccatatgccacaccatctatcaacactcaatttgctgtatgtagttgaggacattccttccacgtaggagaataacttaccccaattagatcttaagattaatttttttttgaatcttgatgctttgtgagtcattatcatttcaggcagccttaactgaacagaattggatcttgaacttaacaaaactcagaactccacacctaaaatcttaaattccaaaaatcccatgacagtccataatcctttgactttcatttctttcttccaatttctctacatttggacttcattttaattttaactccataggccattctacttccaggcattatatgagcaccttctaagggtgatagtttccctaacccatcctctttcaatagctaattgaaatctattaatttcaattagtttaatcattaacttttattcctttgttcctttaatcttcaatcacatttgcccagataaactttattcctaccattcctcattgttttaagttctatatttggtcttttgagaaccaatggtgaaaaatcacagtgatactcctacaaattcatgctctccaaccaatgcctagctttcttccttgcctggtaactctctttcaagtccatagttgattttctctctaattcccctcaaggacagttccaaatgtcaccctttctctcatttcagcagctttagtacctcctctcacttcttatttccataagaaagcccatctggagagctctgcctcctccagggctagttcataaatgtgcaaaacctgtgtaaccacacaaggtttctaagggtcttctcagccccacacttagaagagccctgtgcttgctttaatgctctgcagtaactatcttgaaattcttaatcattgtgaagaaggggtcctcaattttcattttgcactgaatcccacaaatcatgtagctggccctgcctcctgccaatagaaacatgtcatttatactcctcttggcattcctgcctcaggattaagaaggctctcctccaaccaaagagaattctttttttttccttttaagtttttttaaattgagatacaattcacacaccatcacatttatccatttaaagtgtacaatgcagtgatttttagtatattcacaaagttgtgcaaccatccccactaccaaattctcaaaaacaaaaaacaaaaaccctataccattagcagtcattcataattctcccctcccaacagcccctgaaaaccactaatctactttctgtctctatagatttgcctattgtagcattttatacaaatagaatcgtgcattatgtggccttttgtatctggcttccatggaaaccacctttgcagaattaagtcaatgagagaaatctgatatacctgactccatcttgcttctaaccttacaagctgtctttgctcattcctgagcataggccaaactaactatgggaggaatttagttcatgttttaaccataaagcaaggataataatagctccttcccaaaactactccctccttgtttgggaactgaaaccacctttataaaactaatgagaagccacaaaattagaattacgggagaggtctgaattttgctaagacctgcttatagttaaaagataactagtcattgtgtttgctcaggggtctcatatgggtggtcacaagatttgtaacttccctaattgctcctacagataacattgctgttgcaaaacctgaaactggtgtttgagatatttttcattatttttcattctggcaattgattaactacccataccaaggatctgattcaacttggccctgtgacccccatgtaggaaatggctcagcctaagaagacagcttccatccactatgatttcatccccaacccaaccagtcagcattgtccattctctaaccccctgcccaccaaactatccttgaaaaactttagcctctgaacttttggataggctgatttgagtaataaactcccattcttccatctggctagctctgtgtttattaaactctttctctactgcaataccactgtctcagcgaatagctccatctgtgcatcaggcaagaagagcctatcaggaaattacactttcacctcgcataatgttttcaaggccaaggtgaattcttgtgttccttctttggaccccagcctctcctactgtagagacaaactcagagttgttctcactctccatcgttccttttacagatcctgagtagaaggtgagtcaatgtaattaaatcctttccaatctttacaacaaaaccaattccttcaatctcacaattgcttccatgagtccgtgctctctcattttctccctagccaagcttcttagctccctctgctttctcgtctctcatttactcactgccttttcatgtccggcttctgttcccaccaggccaaagaaaatgcacctgttaagtgacaaatggattagctaccaaaccaatgatgttttctgcccttggcttccttgaccttgctgcaaggtttgacatgattgaccgctcctttgttgatacctccttttccattacctctttttctccccctaaatctctctggctatccttctcactataatttttttccagaatcttcatgtttcccttgatctccaaattccagcacatctcagaattctctatttggttcttattctcattctatatattttcattgggaccttcatccaaactgaactatcacatatacgttaaaaattcccaagtcaatgtttctagacatgctttttatcctgagtttcaaacctatatgcaaaggtctattaaatatctctttacctggatatccaccaattcttcagcccccttaaatatgcttgtcgttaaacccacaatccttttccaaacatattcaagtgaattagatccttgtctatcatccaaactattctgtgcagaagctgggactcaccatggacttcctcttacccatacacaattaatctccaagttcattccccattctccattaacatctcccaagcattgtgttagtctgcattctcttcctccccacccccataccacatcaccattggtaaagacctcagcctcaccctgccccaaacaatccgtcccacagtgcttgcagaataagctttctgaggctgggcacagtggcttatgcctgtgatcccagcactttgggaggccaagacaggtagatcacctgaggtcagaaattcaagaccagcctagccaacatggtgaaaatcaatctctactaaaaacacaaaaagttagccagtcatggtggcatgtgactatggtcccagctactctggaggctgaggcatgataatcatttgaacccgggaggcagaggttgcagtgagctgaggtcgcaccactgtactccagcctgggcaacagagtgagactccacctcaaaaaataaaaaataaaaaataaaaaaagaataagctttctgaaacacatgtcttgttattcctttcctctgctaaactcttagcttggtaactaaggcctaaactaaactacccctatgactttcttttccactgctctaatcagagcatgtcatatgatttcacagctctgtctttaaatacatatttttttctctaccagaattatccccatccactaccccatttctcagactaaataatgttctgtaactttgtaaaatattttcccaagagtttgctcttcccagaagcctaattggcacaatttagattctcctttttgcactcaacatgcacatctctctaattgcatgctagcagcatctattaatttacttgcctctttctcctacctgagtgcaagctcttgatcaatcatataccattttagtcttcatatgccagtgcctagtaatgtgaatggcacatagtaggtgctcagttaatgcataataaatgaaatgataaatcacttctagaggtcctatgcgattctgtctttttttttagctgattctcaaataaattttatacagaaagcagcacaatatactcaatggattggagacttgatggaaagcaatagaatcctgaaaactggtttgtggtcgtcaaccctttaagaatctgattatatctggattctgtccctaaaaaaaatgctcacacatacccaggggtttgtgtacaattttggtaaattcctgaaacttattcataggctctgcttgaaattttaaacctgagttctgctttctcctgtgcacttctgagcagacctagctcccaagaggaagtccctactcactaccaggattgaaataagcagactagcttgagggcatgaggacttgattaaatgtattaacatatcaaaggaaagatgtgcacagcagaagggaaatagcttagccctggaaacacataaaaatatagagttgttgtctgtttgttttttggttttgtttttttttttgagacaggatctcactctgtctcccaggctggagtgcagtggaacagtctccactcactgcagcctcaaactcccatgctcaagtcatctgcccacctttgcctcccgagtagctgggactataggtgcacaccaccacaccagctaagttttctatttaatttttgtttgcttttctgtagagaccaggtttctccatgttgcccaggctggtctcaaactccccctagcctcaagcaattctcccaccttggcctcccaaagtgctggatttacaggcatgtgcctataatgcctggccaaaaccagtttgataatgacaaaatttagcagtgtccaccttggcaccattggatcaaagtgaacattgcagttgtagcccacagaaagcatatccgatcccagagacaggaacttccctggtgggagacagaggcatcaggctcttccaaacctgagccactaattctaattctcctttatcattcagttacgtgacaaatttttattgagcacctactatgtcagctactgtgctggtgaaatcatcctatccccacagagttgacaagaattgcatgctgggttctagacagaaatatagttaaaattaagcattaatcaggcagcattttggcccacttccttgttgctaaaagtcatatagcgctagatgctagccatttgcatccccattttccccatggataggatttccaaagttttaggacattggaagtcttattattggaagaattgatttgcaacccatcattcccatagacaggatctctgacataggaatcataaggctcttgtttaaggattccttaaaaggttttttagaccctgaattccagcaaccagtttgaagactcccacagaggaactggatcagcatgagaatacagcgtctttacctccctgtcccatgacttcaccctgcactcttcaaccagtcaatgatctccacacattggcccactcccaaacccttagaaaccgtaacccccgattcctctgggaggtggatttattattccctcctatccctcatttggtgaccctgtaattaaacctttctctgctgcaacccagtgtctctgcatattgactttctatgttcatggggcaatgaatctattacagttacaatagggatggagaaacaagggtgaagatgatagatttgaactcagctctcctggagtttgccttgtgttttgtttccttgcttactcagcaaccctctgattccaatactgcagcagcctttaccagagattttgactattagatattacaatccaattattttcttctctttagtgagagatatttctagctgctctgagtagagactccaaaaaaatacaccacaaaacagatcttctaccagtaaaaaataaaaataaaaaagccacataagtgatgtccttacttatatatataaatggaggtctgttggtgccattgttctagaaaatggggaattaaaaagcaacaaaaacaaatttgtgttttgaaaagcttgggggggacaaggcacggtggctcacgcctataatcccagcactttgggaggctgggtcgggcaaatcacgaggtcaggagtttgagaccagcctgaccaacatggtaaaaccccgcttctactaaaaatacaaaaattagcaaggcgtggtggcatgtggctgtaatcccagctactcgagaggttgaggtaggagaatagcttaaacctgggaggcggaggttgcagtgagctgagatcatgccattgcactccagcctgggcgacagagtgaggctccatctcaaaaaaaaaaaaaaaaaggaaaaaagaaaagaaaaaagaaaagctcaggggggaaaaggctcctgaataccttgtgtaggagataaaggtggggtaatttttgagatcctaaggaggaagtagtccttctccagtgtgaaggtagctgtaatccttggggctgctgcagatctaacagctcacagcctttgatctgagaaacaccaggcatcaccttgaagctgagcaacaggaatttaggttttactaccacacttctgttaaaaaaaattgtcaatggttctgctagcaaagacaggaccagcattcactggagaaacatacaccccactcaccaacattttctctaagtcactctcctcttaacacagcattgatcgaccttagcctatttggcagtaagcaccacagctgggcccgtcatccaaccccaggttgaacccagggagctttggtcagctgggatgagacctccctatactgagttttgccctgctgacaaggagaccactatcagagttgctactgctggggcaacatattgacacttggggttaatacaggagcaagaagcccctcgccctgcaccggcttccctccctttaatgattcaacaaggacagcttcgactcagcaagcaggctccctccagcatggtctgggtgctgagatgggataaagaaggaaggtactatttccctgaggtatggctgtaagcacactgggacccccgagcagacactcacaggagggggagagacctggccattatcctagctactatgactggcatttgaaagtttgaagtagtgatcgggaaactttttctaaaaatagcagatatttcagttttgcgggccatatggtctgccgcagctactcaacctgcctttgtagcaggaaagcagccacagacaatgtatctaggaatcagcatggctggatttggctgctggttgtcttttgccaatccctgcttcagaactgcactctgggaaatggcttgtggcaccacaagatgtgtttgactaccctgggactcactccatcctaacaattcctcagcctccacctttgctctgcacagggagaaagcagaaataagcaaatcctgatttagcatgtttagatcttcgtgcctcttaaatgaacaaacttggctaaaggaagcccatccctgagggattggacctgtcctcactggtttttgagcttcagagcccagggtcattttaaattctccaaactaatgaatgcctcacattccctctgggggaatggccagattttgtttgtttgctggttgcattgtactgccagtactatttgtttgccttcttgtgaaggcagtgattctgatatagtatgtggagagagaatgagatattgggactcaggcaacatggtgccaaatctcaacccagtctctaatttggggaaccatttgtcctcccatgttcagctctgtcactgtctatcagggattccagcccagggccctgggatctcacagagcatcacaaggctctggaaagagcatggtggaagtgctctgcaaacaggataattccgattcttacactgaattattcaagatgtgctatccctttggttttctcatctttaaaacagtgatggggctgggcatggtggctcatgcctgtaatcccagcactttgggaggctgaggcaggctgatcatttgaagtcaggagttcaagaccagcctgaccaacatggtgaaaccccatctgtacttaaaaatacaaaaattagccaggcatggtggcgggcgcctataatcccagctaattggaaggctgaggcaggagaatcacctgaacccaggaggcagaggttgcagtgagccaagatggtgccactgcactccagcctgggcaacagagtgagactctgtctcaaaaacacaaaacaaaacaaccaaccaaccaaacaaacaaatatatatgtatttgttttatatatatatgtgtgtgtgtatgtatatatacatacacatacccacatatacaatagtgacggaaggtgctatgtcctcatagagttgtggtgaggattaaatgagaaaatccatgtgatgttatctgcatgctctctggcacattccaagtattctatccatgcttttgtcctttctgttgttttagaacagttctctgcctcaccttattttagcatagtcatgaaaagcttctggggtgcagtccatgctatgcccagtctgaaaccaagagtagtttatggtcagtagccatcatcataagtaaccaggtcctaagcctactctcaataataactacagcccatcagagatttccctaaatcagctggcctagaaaagcaggacaatgccttctgcaccatcatctacatcatttagtttaaatggcagaatctgaaagttaattgctttatttattcatctgtccttcaaaaaagcctttcattatttattattgactactttttgtaaggtgtcaagaatatcctctaaaatggacctgttttgttttgtgttttagagggtctagggatgaagaattttttttttaagaaaaagaaatgcatttctagcttatcttagttctcacctcaatacttgagtatctccttcattcattcattccttcatttattcaacaagttttaactgagctcctactatgtgtagaagcaatcatagcagtgagtagaacttatgtttcaatgtagctaagagataataaacaaataaaaatataagtgtatagtaatcagctatcaaagagtgctacggaggaaaagtaagtagaaggatgggaatgctggagatgggggaagacttgctgttttatagaagatgactgaggaaggctgcacagatattcaagccaagatccccggaaataagagagcaggctatgcagatgtatgcaggaaatgcaaagaagaggctacagcaaggtttgtaaactcatgggatatcaaggaagcttgggtgcctgaagcagagcaagcttgcagtgaaataagtgatttaaggtcatagaggtgagggcacaaaggggccatcatgtggcaccttgtagttttttctgagtagattgagaaagcctatgatggtttgagcagaggagtgacaatgtctgtgtgctggctggctgctgtgggaaaacaaactgtaaggagaccaggggggacataggagtctcagcaaatccagggagaagagatggagcttcagtacaaggtagtgatcagtggaggtcctgagaagtggtagattctaaatatacttcaataaactgttgccagaattggctggatggatttggatgaaggcaatccaatttggtggattgggtgtcacatgtaacaaagaaagaagagtcagatgattctgaggttatgcaattataaggtgagcaggaacacatgactccagagcagtgcttctctaccgtgaatgagctcacaaactacctggggatcttgttaacatgaagtttctgagtcagcaggcctgggaagggcctgagagtctgcattttgaaccagcttctagatgctactaataatgctggcccatggaccaaactttgagaaccactgttagagaaaagtaatgcatcttagtcattaataaactggtctttggagccagaatacctaggttcatgttctggctccaccatttcctaccaatgtcactacagataagctaggtatttacctgtgcctcagtttctttatctgtatcatggggatcattgtgagaatttcatgagtcagaaatataaagtacttaggggatgcgagaatagttcaacatatgcgaatcaaaaaacatgattcaccacataaacagaactaagaacaaaaaccatttgattatctcagagaaagcatttgataaaattcaacatcattttgtgatacctttgacaaactaggtacaaacagaacatacttcaaaataataagagccaaatatgacaaacccacaaccaacatcatactgaatggacaaaagttgaaatcatttatcctagtaactagaacaagacaaggatgcccactctcaccactcctattcaacatagtactggaagtcctagccagagccgtcagacaagagaaataaataaaaggcatccaaattggaaaagagtaagtcaaattgtatctgcccactgataacataattctatacatagaaaaccctaaagactcctccaaaagactcctggacttgaaaagcaacttcattaaagtctcagaatacaaaatcaacatacaaaaatcagtagcatttctatatacccataacgttcaagttgagaaacaaattaaaaactcaatcctatttatgatagccacaaaaataatctaggaatacatttaaccaaggaggtgaaagatctctacaagaaaaactccaaaacactgatgaaaaaaattgcagacaatgcaaacaagtggaaaaacatcccatgcttatggattggaagaatcaatattgttaaaatgaccatattacccaaagtaatccacagtttcaatacaattcctatcaaattaccaacatcattttttacataattagaaagaacaatcttaaatttcatatggaaccaaaaaaaagcccaaatagccaaatcactcctaagcaaaaaacaaacaaatccagaggcatcacattacctgacctcaaattatactacaagcctctagtaactgaaacagcatggtaccagtacaaaaatagacatagtgatcaatggaacagagtagagaacccagaaatgaagccacatacctacaaccaactgacattatataaagttgacaaaaataaacagtgggaaaaggacaccctattcaataaatggtgctgggaaaactggctggccatatgcagaagaataatctggacccccatctctcactatatataaaaattaactcaagatggattaaagacctaaacattagacctgaaactataaaaatacttgaagaaaacctaagaaaaattcttctggacattggtctaagtgaagaatttatgacgaagaccccaaaagcaaatgcagcaaaaacaaaaaataggcaaatgggacttggagtaaaaagcttcagcacagaagaaaaaaattcggcagaataaacagacagtctaacagaatgggagaaaatatttgtaaattatgcctttgacaaaggactaatatccagaatctacaagaaactcaaacaactcaacaacaacaacaacaacaacgacaacaacaacaaaaatccatgactcaatagtcatggattatttgttgttattgtattagtctgttttcatgccactgataaagacatatcctagactgagcaatttacaaaagaaagaagtttagtggacttatagctccacatggctggggatgcctcagaatcatgactgaaggcaaagagaggcaagtcacgtcttacatggatggcagcaggcaaagagagagagtttgtacagaagaactcctctttttaaaagcatcagatctcatgagatgtattcattatcacgagaacagcacaggaaagatgtgcccccatgattcagttacctcccaccaagtccctcttacaacacatgggaattcaagatgagatatgggtggggacacagccaaaccctatcagttataatatcaatttagtaattcacattcatcaggaaaaaaagaataggtttttaaatattaaggctatgcattgttccatgactttttttttgtatgtgtgtcttagatcatgttgtgaaatgtatttcttctatgcatttcttctgagggtcttggtcaaaaaatgtttaaaatcacttgctataaacaccaaagcaatgtaactttcaaagattaacctggtgtacagcaccaccacataacaaattcagaccagcatcctacagcaatgggcaggcattcttggggctgtgcaaggtttgtgttcagcagtgaccccatgtgatagcaaagcaaatgcattagactggtcagcgctaccagtcccctctctgcctgatgatgggaaataagtctgaccccattgaactgagctagtgacccatatgcactgaaattctggacaatttggggaggagagaagcctcaggaggcatcttgctcagcggggctgtaacaaacatgatatagtaatatttatactcccagctagttcaaaaggttatgtagttgcaaaaggttttcttaaagatttttgtagggagaaaccaggatcttcaaaattgtgttgtaaaatatgttgtttctcagtgaaagtccttccagagtggagggagccagatggcagcaaggtgtacgcctaagaagctgagaaaggttgcaggtagaaatagactgaataatcagtgactatacttcaggggtggttgctgtaatatgatacatgtgtgatatctgatgttataaattaccttatattctctgctaataattctatagtaggacaaatagttaatacagttgtgtgcctcatcatgacttttaggtcaagaatggaccactgaagtgatggtggtcccataagattataataccacattttactgtacctcttctatgtttatatatatgtagatactcaaatactttgcattgtgttccaactgcctacagtattcagtacagtaacatgctacacatgtttgtagcctaggagcagcaggctatactgtatagcctaggtgtgtaataggctacactatctaggcttctgtaagtgcactctaggatatttgcacaatgacaaaatcacctaatagcacttttctcagaattttatccccatcattaagcaacacatgactatatgttaatatttggttttatattactaaatccaaacaaggaaacttgttttaggagggcagaattttcctttttatcagtatgctgcaactattaacactggtactagttgtgacagcctaggtttttgtcccaaattgctatttaaaaacccaatattaaatggaataagtagagaaaccactgcctcaattagcctaatagaaagtgtaggtgaagagggagtgtagaaggctttgttggtatagattcagatcccaggcatatgtaaggatggcttcagccttatctcaagtagtttccctaaatagtcccatatattttgcaagaccagataccacttgaaaaaatctctcttccagataataatcatggtaattttaaaacatgtcctcaaattctgggggctctgcctgtcaaaagatgggttctatgcgcccttaatttgagtctggaccaaccctggtgacttgcttgtagtcaacagaaagcagcagaagtgacaccaggtaacttccaaggctaggtcagaaaaggctatgtggcttctgctagttctcttgtgatgctcgttctggggaagccagttatgatgtaagaaatccaactaccctgaggccactatgttggaaatgccatatgaaggtgcctccatcaagggcctaggtgagctcccggctgacaaccagtatcctatgtcagccacaagagccaccttggacacctcgccaaagtacagtggtgtggtcatggctcactgcagcctccacctcttgggctcaagcaatcctcccacctcagccttctgagtaactggaaccacaggcatgtgccaccaagtcccactgatttttaaaattttttgtagagatagattctccctatgttgcctagggtggtttcaaactcctgggcttaagtgatcctcctgactcagcttcccaaagtgctggaattagaagtatgaacaaccatgcctggccaatcatctttcattacaaaaatcacagaaataaaatcttcctaagattccctaactggcttcaggaggtaatgttttctggttaaagctaaaaacaagcatcacaaataaattttgcaagactgcacatcacttgaaaagtctctcctccagataataatcgtggtaattttaaaacgtggcctcaaacttgaagggactcctcctgtcaaatgatgggtcctatgtcctctcctcttgaatctgggccaatctctgtagttagaaattagggctttttctaactacagagagctcagagagcaaaaatatatgtaaaagtaaactgtagctaattcttaaaaataggaactatgctagcttagcaaattcactgattagagtcagatttacatttctgctttcagctgtggtcatttgtgtatttggacaacagataccctttgatccagattgaaggcccacgatgtcaatgtgtcactcctcacatctcacattggggaacacacatgcaagactaaaattggagtcaacactaacaaggaggcatgaggcagtctgcaaaattaaaccaactgtcaaacagcacaattagaagggtaagggtcacttaagggagcaaaggatgatgtttctggatgagagagatgagctaattgtccccattgggcaagggtatggttctgaggttactggcattaagataaaaagaaaacatgtcagttttaggatctgataccagatttgcttcttcaggcaaactcctcccaggaactgaacccctgtattgtctgggtatttgtagaatagacagtgcttccaaccacaactttgggcaagacatagaaatttacagttcatttaaaatgactgagaaaataaggaggtgggtacagtagggtgtgcctggaggctaaggctggaggatcacttgaacccaggagttagagactaccctgggcaacataacaagaccccatctgttaaaaataaaaaattaagaatgactgagaatatggtccataatccagatatgcagagaagggcatcttgctggtgctgctgcgatactgctctcatgtgcagggtgcccacaggctgactttctggtggaagcctgtgaagatgtttccaagggcatagttccctggcaagaagaagttctctactctacagggacctcatcagactcttctccatctctttatcttctaccctcaaggtgtaatccacagctcatgttgtcccctctgactctctactggctggggtactgaaaagacggctcaggatcaggaccctattgtccatttgactcatctggaaactcaagaacttcccctattcagaaagtggaggtggagctgctcccttccctctatcatctctcaccaatcactttaatctgatcaaaaaatccagagatagggcaacaaatgcacagagcagtgaggcaaagaaagcaagtccctctttcttccaagtaaccagacttatggtgcccttttcccttgactggaggaagggagcaccttcccttcccatatcctataggacggagtaagtttccacctgaaactcaaccccaaagtctccaacaaaatctgctaattcttttttttttttttttttttttttttgagatggagtttcactcttatccaccaggctggagtgcagcagtgcgatctcggctcactgcaacctctgtctcctaagttcaagcaattctcctgcctcagcctcctgagtagctgggattacagacgtgtgccatcatgcccagctaatttttgtatttttagtagtgacaaggtttcaccacgttggccaggctggtcttgaactcctgacctcaagtgatccacccacctcggcctcccaaagtgctgagattacaggcgtgagccaccatgccaggccctgctaattctttttatataggctggcagtaggggagtaatggggagacagttggagatgcaaatcatctgagaaatatctggcagctctttagtttccacatggcatttatctccacctctccatcgttcaaagacaactaaaaaagttatatgtaacattctcttgcacctgccccagttactcttggtattgatctagttatctacttcaccttccagactgtgatctccttgaaggcaggcatgtatcttcccatctagcatatctgaagaactggataaatatttcagtgaacagaaccagttttaagattgggacttcacttaccttgaaatcgttactgccagctttcatttcagcagagatttttatgatgcagattctaagaaaaattaattacctaggtatttctgaacttgccgaactggaagaaatgtgttcttaggataatcaaagcctggctgtgtggctcagttagaatcagagagggtaccctcatctagcctcttccaaaataccgagccaggtggctggatgaaaagagggtttgactccctgagactgcaggcaggagatgagttcctaataaataggtctcctttcgttattgtgaaataagatcagtaacagcctcagagtgagcagagataagcctttgtgcctgtggggacttgagtttaaggggtcctacagcaacactacctatcatccacatagcttggaatggccagatacagatcaggaaagcaaaattcaactgtggtccttgaggtggcaggctcaaaaaggggtcaggtatttatttgctttctctttttttgtgtgtgtggttttataactttatttgacaagcagcaattagctctcatccacattgactgtttatagatttttgatagtaacaggtacatagggaacccaaatatagagcttatttgatgaagatttatcctcattacattttctggacaattgcacgtggatgggacatgccttattcctttggtccaaacagctttgttgagccaggtatcagggtggtggctgctgtaagttggggttgctgtggcacttacttaaaataaaacaacggtgaagtttgccacatcagttgacacttgttctcacaaaaaatttctctttagcatgcaatgctctttgatagtattttacccacaatgtaacttcttttgaaattggagtgaattccctcggccctgcctttatcaactaagtttatttaatattctaattttttgtcttcattttaacaatgttcacagccttttcaccaggagtaaatttcatctcaataaactactttctttctctgctcatccagaaaaagacaattgctcatccactcaagttttatcatgaaacagcagcaattcagtcacatctttaatctccacttctaattctaggttttcgttgttgctgtttgctattttcaccatatctgcagtgacttcctccagtgaaatcctgaacacatcaaagtcatccataagagttggaatcatcttccaaattcctgttaatgctgatattatggccatgttcattaatgatcttaactagatcttctggatgacttgttgcagcttctccatcagcacttgctgctccaccttggccttttatgttatggagatggcttctttccttaaacctcaggaaccaacctctcctaacttctaactttttttctgcagcttactcacatctcttagctttcctagaattgaagagagtcacagcctcactctgaattaggctctggcctgagggaacgttttggctagttggatcttctatccagcccactcaaactttctccatattgccagaggctgttttgctttcttattcatgtgttcactggagaagcactttaatttccctgaagaacttttcctttgaaaacttggctaattgtttggcacaagaggcttaactcttggcctgtcttggctttcaacatgccttcttcattaagtttaatcatttctagattttgatttcaagtaagagatgtgcaactcttcttttcacttgaacgcttagggggtattgtatggttgttaatcggcctaattttaataatgtttcgtgtcagggaatagggaggctcaaggagaggtagagagatggggaacagctagtttttggagcagtccaaccacacccaacatttatcaattaagtttgccattttatgtgggtgcagtttgtggtacctccaaaagaattacaatagtaacctcaaagatcactgatcagagatcaccataatatgtatagtaatgaaaaaattgtaagcattgtgagaataaccagaatgttacccagagacacaaagtgagcacatgttgttggaaaaatgttgctgatagacttagttgacacagggttgccataaaccatcaatatgtaaagaatgccatatctgcaaggcacaataaaatgatgtacgcccatgttatttaaaagaacatatcaaacccagagtttctctctgtctctcccataccaggagactgtggagctcacctaactccctttgtcttcaaagctagcacagtggagaacggttaggtgatgcgcaaggtcaataaaacatccacgttgtgcccagtatacctggagtccttgcccttgtgcagtacaaggaggagcttggtaggtgtcccagatctctgtgctgatggatttttacctacaaccccaaatagagaaatgcttaaaccttacttggaaacaagagagcgattttccttttttcagaaaaaagggagagtgacatacacattggtaatctactaattgtagacatatgcacagttagggaaaatctccagttagaaaacaggcctatatcccctgagggggttccatccacccttctcttttccagagagtagctagggattcatctaatgaaacagaagggaaagaagctaaaacaaggttatgaaatagcttccagaggaatcattaagtggattccaagttttaatatgccccaatacacattagattgaactaaactgtattaattactgtcaaagattgatcccattaatggcccaattattttccctctctatatccatgccccttgccctctgactttgcaagtcatcctactgaagagaaacagtcaattcccccagtctttaaataggctagactatgtgacctgcttcggtcaacaggatgcagtggaagtgatggtgtactacttctaagccttgacttcagagaatttatgtgttttcatctgctctattgtgcctctgctatcaccatgacaacattcttggggtaacctgctggaggatgagaaataaatggaagagatgaatcacccagtcatccaagtgaaggccagcctagtgcagctgacagccagcctaaccccagatacatgaatgagtccagccaagatcagcagaactgcctagctggaccctagctggaccctaactgaccccagttgtgtgagctatcaattgacagttttatgtcactgtggttgcatggttgtctgcttcactgttgtgtatggtgaccacggatgactgacataactacctatcttcccagtggtcaatttatcactatctaaacctcccaatcatctgtgagaaatgtgtcattatttgcactttgcagatgaggaaactgaaccatataatgagattaagtgatttgcccaaaatcacaaatacagtaagacagggagtttttatatccaagtccaggattttctctaatgcattacagatgagttggaagaaagcaaagggtttttaaaataaatatgattgcagactgacttcctgggttaaattcctggccttcccatttactagatttggaacattttgcaattttcttagcctttctgagtcccagtattcatttctgtaaaatgaggattatgtcatctgccttgaaggacattcatcctataaatattattgagtgatgactatgtgcccagtactcttccaagtgctggtgaaccattactaattaaaagtaaaaagatctcgatggggaaatctatcttgcatgtttgacttgcatgtttgaagtacagcttaaacttcagaaaaaaagggagcatttggggtatagacaaaacattttggtcagtgtcttggtcattttgcattgctattaagaaatacctgagggtgggtaatttataaagataaatttttatctttatacaaaggtttgtttggctcacaattctgatagctggaagattcgaaactgggcatgtatatctgatgagggcctaaggctgcttccactcctggcagaaggtgaaggagagcagatatgtgcagaggtcacaaggtgagagaggaagcaatagagagcaggagggaggaggggacaggctctttttaacaaccagctctcttttgggaactaatagagtgagaactcattaactgcttagaaagggtgttaatctattcatgaggattccaccatcatgatccaaacacctcccattacagcccacttgccaacactgtgacactggggatcgaatttcaacatgagatttggtggggaaaaacaaaccatgtccaaacttagcagccagaaacttgaaagaaggatttcccttcctaagatttattgctacactcctccctttgggattaggattggagagtagtgcttgaaaaacatctgggatctcagagcaaagggaaacaacatctttctacctcagtgcctccattctaggggactggtttgtgagaagacacagaaaaattcccatgccctgagaatagcataacaaaatcactagaactaaagagcacgacttcttctctagtggacatctcatgaggacccatgtcaacaataatccatcaaaagattcctgccccgatccccgacatttcagaaattcattccagaattctgacataaattctgggaaggaaacactttagagaccccagttaaattttcttgctgtactgaagggatgatgcttcaaaatgcaaattattttgagttataggaaatgaaattatatttttgtaacacaattttgtagccttagattcacacattttaattaaaattaaacaaatgtcgtgttgttgtttcttttaaaataaggtaaaatgtaatgtccaacactttctgtagaagagacagctagttctccaccaaaatgtgtgctttgtgttccttgatacagtgtttagctagaaagcagctgcccagcaagagatgacatttcccagaaccctttgcatctaggcaagaccttgtgattagtttctatgagcagactgtgagtagacatgatacatgtcttttccagtttgaggtctcttctgtattatctctttcctcatcgtcgtctaaattacataggcccctgaggctctgaggaggcagaaacacaaaatggaaggaaattgagcttctgaatgtttcctggaatgcccaccttttgatcaggaatgccaacatcacattgcgacataagcaagagataaatgtctcatgttaaatcactgatatttggaggcatttttttatattaaacaatctttatttgaaaaatagtaccttgcaatcctaacacgatctatcaaacttcagtgaaagcaatttcagcaacaactaatgaacagtagctaaactgacaagagatcaatcaaaagtattttaaagtgagcagcaccagctgatgttctggtgagtctctgggtgtttaggacctggctacagggaaaacagaatcaaatcagcaggtgctgtggacccaagctcacacatcatgaccagcctccctccttgggtccctagtaggccacagtccccctggtatttccaggcccctgtgggctataggtggagccctaggagccaaagggccccttgggaaaggctggaacttggcctctcagtcagccagcttctgcctgttgcatttactttctttccagagtacctggagtggtctctcagtagataaggtggccgcccagccttcctgggccgttttctcatagaagaggatttctctctgagaactggaagtgtcttacttctattcctcggccaggtcttgggccatcttcttgtagtgatcacaggtatgtaagacacagttcaagttttagtacactttactgaggtccaagcagtagacttcctgctgagaccccatcgtgtgttcttggtgcagtccaggcaaagtgggagtcgccagctgtagcttccggaggtcccttttcagctgtccacttgcaccctacagagaggcctgctggctgagccaactttggatttatgctatgagtactttatccctttggttttcttcccacagttgcatgtctgcttctccaatctccccctcaggacatttaaagaacgcacctaagtcactgtcatcatccacactcttcagagggacttgtgcccaagacgctgggtgaccacgatgtcttgcttccctatttcccttcactaccaagtcctgatggtccacatggtctctactgcccctgagcagatgcgggattctcagtggggtgtgggccaaggaggtcagtcacctccctccaacactcactggcactagtcccaggattctgcacatcactagttctgccatccacaggtgggccatcagcagctgagtatgcatctcctagcgggcaacaggctctccatggctcttgagggctctgcagctctgcctccacttgccagtggcctgtgggccacaactgaccacttggaaccctgaggactgtctcctctccaacagaaacaagggcccaccaatcaggatagaccatctgtcgggctggactgtggggaggggaagcaccctgtgtttgaaaaaactgtgtccctgattttgtgttaatataaagtgacattacttatgcagtgccttgggggagtggaaaaagctcactgcagcccctacctcaggccactccaggccccaccgggtcctacagcgcagctagagggtcaaagcagaagcatgccacagcccggggtccacacatgatcctctcagggcagcatgctgacccgtccctgctgaggctcatgaccctgatttcaagtcttcttctgctgcagggaagcctggtcctgcctgtaaagagtctatctaccttgctagattgagcttcttgaagaagggactatgttttcttcatctccgcatccccggtagctaaccaatgtccagtatacagtagggcgtcagtcactgtcttattttcttgttgactctactctgacttatgacatgacactttcccctcttgacctctctctatttttttttttttttctgagatggatttttgctcttgttgcccaggctggagtgcagtggtgtgacctcagctcaatgcagcctcagcctcccgggttcaagccattctcctgcctcagcctcccgagtagctgggactacaggcacgcaccactatgcccagctaattttcgtatttttagtagagactgggtttcactattttggccaggatggccttgatctcttaaccttgtgacctctagctttaaaacccctccgatatagacagaactcaaactggagccggacctgaggaatggtgaatggagcattttccctggtgtgacggagaggacctacagatctggctatcttgtcccttgcatccctctgcagaatttgaccccagttttcaaatcagactcaagaatgatctttagtgtttatgattttgtgtttttcttttctttttttttttgctttgttattgacacagcttctggaaatctttttcacagagagtatggggactttttggccaaattgggcagatgcaggctccatctgctccaccaccactgtctgggccacagcatgtcccctgcgtcctgctcctctacaggggtttctgcagtggaatctgctccctcacaagcccatctacaaggtgctcctgtgctccaaccctgctgtttccaagaaggcaggtcctgggactgccaggatccctctccctcagacagcgcaatctgtgtaggcagcaggccggaagtggtgacagccaccatgacagtcagggccgagggcaggacgatcacattagaaaacagcatccggcctccaggggcgagcggagtgactcggcctccatctcccccttgaggcagccatcttggcgccgctttcctcaggagcactgcgagctcgtccttaggacccgcttctcggcttttcttctcccaactctttttaccaggcagtggcgtggcctctctggcccagcagggaatgggcgcagggaagggagtggtagtaacgagcgaggcatagaggcttttctgtaacagcagttatgttaccctgattaatacaaaattgcctccacgaatcacaaaattacccaagcaaaaaataaggtctaggttttaagaaactaactcctgaaagaattgactcgtcctgggacaatgtacagagttgatgtctggttaattagaggtcactgggatagaattcttcctgatatagcgcggcataaaggtgtgtattaaggactctaggtaaagaatcacgtggagagaatcttcaggtttaacacaaagatcccagtttttcaacaaaagggaggtaaactactcagatggggtctaagttgtagcccaatgtcacagcctgctcctgccacaatttcttattgatgccaggagactgcctttgtttactgcagtcatcatggctgttgggaagtgttaataacttgctttttattttaagcgggtgtgaattgcatgggttctgtttcctaataagagtagtgtcacctgatattttcacataaagagagctgcctcgtggcatgtcttctgaagctagcatgtgcttatccttcacaagcccacaaaaactgcagactgtaattcagaaatttgatttgatcattccactaaacctctaagcccaatgttttcttcagctcagtgttttccttgccataaacttaccctcagagggaaccactgacattttaagagctgaatccttacagacactgaggccaaaaggacttcagtgccaactctgcattttgaggccattaaaaaaaatatcatcaaagactggggttgccaatcagaggttctccatagtgagtgtccaacaataagatcatagtgactgcttattccaaaccaaagttaccacattcgatactcaaggttttcaacagaattgattccaattagagcttcacattttccattaagctgtatgaaatattataaatctattgagaacaccagtagaagaatggctaactaaatcgcagtatactggcacaagggaatactatactgcaatgagaatgaacaatcttcaattatacctgaccacatgtatgaatttcacaaacacaatatggggcacaagaaggcagacaagagagtatacaatgtgtgagtctcattatataaagctcaaaagcagaccaaattaatctattgtgttagaagccagaatgatgattaggtggagtacttactagaggaaggtataagggaacttgtggagaactcgtcatgttctgatttcagacttggtctctagttccccaagtgtgttcagcctgtaaaaaatttattaagctgtacactacctcctactgcacttttctaaatatgttatacttaaataaaatgtttacttaaaagccaataaaaaatcttaaggacccctggagagatacctcaaagtttaatgatcccaggtaatgaatcactacctcatatacttttgaaaaaatttatttttgcattttgtcatacattgccaattagagtctgtattagtcagctctaacactgctataaaaaaatacctgagtctgggtaatttaaaagaaaagaggcttaactggctcatggtcccacaggctgtacaggaagcatggcagtatctgctcagtttctggggaggcctcggagaacttacaatcatggtggaagacgaagggggagccagtacttcacatggctggagcaggaggaaggggtgtgggggaaggtgctacacacctctaaacaaccagatctcttgagcagtcactcactgtcatgagagcagcaccaggaggatggtgctaaaccattcatgaaggttcatgaagattacctccatgatcccattacctcccacaaagccccatcaccagtattggggattacggttcgacatgagatttggtcaaagacacagatccaaaccatatcagggtaaatcaggttaaaagagttttacaaatgtgagatttggaaagatgtatttatgattggattctgtttcccccttttcccccacgtctttcaatttttgattataaggaaacatacatgttttaaagtggtggctaagattcaggtgtggcctgtgctcttggcaaaagccaaatttcaacaaacttaaagatctaattggctttttcatgccttggggggcatctcatctaaagagttagaaaaggctctctgatgacctgagcaggagttggctttataggcaaaaaggggctgaagaaagcagaaacagggaacaaaaagcagattagttagcatcaggttacttcacattactctttttgaaagagttaaagtcgaggggacttccttatcatgctggctaaaactggccttttggggagtttggctactagccatccctctcctgatttcttggaaagtcagataataacacttagttttattatctaagtaatagagtaatggtaatggagaacttgaacatgactgactccatttcggtttggtctgttggagcctaatgtaggagctcagtccaaatcaatggcctcttatagattttatgtaacactccatagataatctatggacataaaaccagaccttgcttgacagtgttaagcagtcatggctattatgtgcttaagagtcagtatagcccttaaaaagttacctccatcacctcaatgggaatgaagcgcaacaaagatttgtccctcattgcttccattatgcttctctcaactcattgcttccattatgcttctctttttgattctgtcctaatgacacaaataagtcctaaccaatatgtatccatctaacattgctaagctgtgttgtttcaccaccaccaccagcatctccaccatcaccctcaaatggttagagtaatattcacttgctattgtgactgtatttcttgttattattgctgatattattgctacataacagattacaccaaaacttagcagcttttattattttatcttgttcttggtcttgtgggttaggaattcagaaacagcccagctgagcagttgtctcttggaatctctcatgcagttgcaatcagatgttggctggactgcagtcatctgaaggactggacacgcaagatggctcactcaagtgcctagcaggaggtgcaggctgtcagtggacttagctagggctgatgactggggcatctacatgtaattccccagcatgttgatgtcagggcagtcagttttcttatatggttaacctctaacttccccatagcgagtgttccctgagaacccaggggaactgactttgccttagaaatcatacagcattgcttctgttgcattcggttaattataaatgagtcacaaacccaagcaaattcaaggggaggcgattataccccacctctaaatgggaataatatcaaaggattttcagccatttttttaaaaccaccaccctgtgtgaccagggcaataaccaaattaaatttagttgattgtttttctcatgctgatgtcctttggttcttcacccagaatgttgtgtgcagtcatagaaatgcaaatcaattaatccagttgctgcattaggtatattatcaaagaagccacaagatgtttccatttaacgaacacagatttttatagggcttgctcctccaattctgtgggaaagaactttttattcacctgttccatttgaagaaatggaaacctagaagggctcacagtttcctatctcttaagttgcagggccaaaatttaaacatattttctgactctaagtccaagatttacaaatacatctctgatagtttcaagtttaaatgagcttcattcatttcagtaacatattttgcaccaagcacctggatgttttcaagatgagtatatcttacatcctagcattatatcctgggatattctgatctatttgtttaagctaggaattgtgctagcgccaatggattgaagtatctgctgctcttctgatcaaagaaatggaataaacaattttaggaactttaacagaaccatgcacccaagaggaaggacattttattctgggtgcagaatatctttatcaattgcctggctgaaagaactggggattaataaggattagaatggcaagcaaaatgaagatagatggagttgctaagggatcaagggactagactagaattcaatatgatcctgggtaaattaaaaagacagcttgttagaaatgaggaaaaaaaatcagtaggaacaaatgcaaggtggctcatcccaacaaaaatccacattgcttcaaaggtgggtaagactggctagatataaccataatagacactcgccccagagccagtgagtaccatgtgatggatgagagtcagcaatattaatttcaggtgtgggagttcatgggcaagacaagaagactttagctcaataaatggggaatttctctaaccccaccctcaaagtaaatcaactcttcttgcaatacataatcaaaactcctttatcttttatttcatggactttattactgttgtaatttttaacattttgatgtaattatgtgattaatatcgtcttttcactagatggtcagttctatgaaagcagggtctggatctgtttgcatcacgcatgcaatgcctgccatgcagtgccttccatgcgcctaatgtgcagctggtgttttctcaatggttactgaatgagtaaattaatattaggctaaaaataatgtatactagtgcttggcaaacgatggcccactaaccaaatttggcccataacctgtttttgtatggcctgtaaactaagaatggttttatatttttaatggttgaagaaatcagaagaatattttgtgatgtgaaaattatatgaaattcaagtttcagggtctataaagaaatgtttattggaacacatcccacatttgtacctattgcctatggctgctctcgtgctaaaacagcagcactgtgtagttgcaacagagaccacgtggctcacaaaatctaaaatatttactctctagccctttacagaaaaagtttgctggcccctggtatagacaatctggttctcatcatccttggggttttgtcaactcatgggcatgtattcctaagcttttggctgatatctaatggataaagtgacttttgtgccctctctccccccattgaaacaaaataaccactctcttgttttctaaaagactgaaggttataaaataagaaactgctcaggtctccagaatggcggcaacaattatcgaatgaataaattaatattgagatgagaataatgtagactagggattggcaagactaggagctctggaggcatatggaattggtttcaaatcttaattctgccacccaaatgtgtaatcttaatcaaaataattctctaagccccaactaacctttttgtaaaatcctcataggaagctgtggtggttaaattaggtatgatagataccttttagatgagtttgcccatccaaagtcctttctctgagaactgttcccccacttccaacaccaggagcaacctgtacagccctttctaccttctctcctctgaccacaatggataggacaaagcatgaacaaatgatgcaaagtttgtcttaggccaactagatgttttccctcaaaaatttgaaaatgaaacatagaaattctagttagtccacttgaggcacctggactagaaccacttgtttgggcaacaagcaaggatagaagcaactggtttgcagacagagaaaaatgaacacaaaatgaggaagatatttgtgtagagaatgaaagtagccccgctctgttgggatgggaacccttctgaacctgttatgaatggcagcaggcattttcaactcacgggtaaaggtctaagttcattaagtcctgccgttggagcccagcccacctccgtctccaagctgcttatacaattcagcccctcaagcatccatatctccctatggataagctacagaaacaggggtgattaaaggtgacttgcattccattatttgtgctaaacatttggtgcagacttctttgttctgaattctttagcatcagagggaaaagactggaaaagagaacaactacacacagaggtgggtgatcccattccataaaaccaaaactttggaacttgaacatcaaatctttcaagtctcaggtatgacgtcctagcaacatattgttaaaaattcagcttcagatccaaactgccatagcagtttcctgattgcctactctcagaagactgagttccttctgcagctgcatagaaattggatatacacagagatttataagagaacagcagtaaaggggccagagatttctcttgctacagatttttcagggaaacacatggcagtttggggaagtccctaatgctaatgactttccacttcctagtttcattcccttggtggcagcctggctacttttttgtccttggttcagggagatagtcatgcacaaaatcctgttttaaaactagctccaatggagttcagtctattctcacaaacatgcctggactgaaataatgaatttcctggtgcatacttgtcattcaacaatgtaatgattgtcaatatttttcaaagtattattagttggcattattattatggaataatgaaatattgccatggaatatacagtgaaaaccaatgaccatagtttttatagattcagactgcagtgtgcaggcataaaatgacatggtgtctgggatttgcttcagaacaattccatgataaaactttctttttgttttgttttgttttgttttgtttgtgtgtgtgtgtttccatgataaaaatttaaaaacagaaaaagaaaatgagaaagaaagaaatagatagagcaattttggtaaactcttggtaattgttgagtctgggtgatgggtatatgggaattcattgtattattcattctgctttgtgtatattagaatattttcataagaaaaattagattaagattatttttagagttaaaataattagattttaaatatagtaagttgcttacataaaagctctaaaaagtcagttcatcattacagtttgcaaagaatattttagaactatttattctttcaaaatagaaagaaacctctcttggatgacgtagagtggccctgagatagggaaatggactaaatgacattgtaagacaccctccgcacacacacatacttgtcacctctactattcttcattaatgcatttcttcctaaacaaatggtaaagcattcttccaaagaatatttagaaaaccatcaataatccatatgtgtcaaagattgcaatatgtctttaaatctcagaaggagagggaaatcacattatagatttcttctttttccaatacatcatgctaatgacaacgaattattgggtgctctttattctcatgggatgaatcaggccaagggttctgttctctgtggctggtaaatcagaccctggaaactgtgtcatcctggctggcctctttccctaagtacatgcaaccagccgcccgctagttctgggctaatgaagtccaattgctccataggctgaggtttattcagtttgtataaatgggagaaataaagaccaaatatggcctggcctaagtaagacataacagtttgaagcacagaactgagccaagaaagggaagcataggaagaaaggggcataaaacaaaggccccaacatgctctctgctctagaggcagccagagaaggagctgctcagtccatccctgagaaaaagaggctacccaaggttggcagagagggtgtgctgatgatggaaggagaaactttgatgcctccttggtccttttattccaccacctcatgaccatagcctgaaactcgtaactcctgcccatgcaggttggagaattgagaagaaattctacttgaagaaaaggtggtacctgggggcaagtgaacagaactggatgactgaacattaccctaaagaaaggaacaaggcagcacctagcacagaacctggcacataggaggttctccataaatttattcattcattagaaaaaaaatggagtgggtgcctactatgtgctctgtactaggaaattcaaccctgaaggaaataaatataaagttcttggcctcttggaacacagagtctgttgagaggattggtagttatgcagataaacgtataatcgctaagtctgataatcagaaaaacactgatctggaggggttatgggagtctttaagtgttttgtgctcaaaggcacccaatgtcagaataacatgattaactaggagtccaagctccagaaagagtcttcctggattcaaattccagttctatcattccctttctgggtgaccctaggctggttacttaacctctctgtttttctgaaaaacaatcatgttaataataaagtgaatgtgagatccagcctcagcccagaataggaacctgatctctaatggctctgccacctggccctcttgccctctgacttctggttcgatttgaccaatggaaagcatgttcaagagattagaaggctgtggtttggcaattaccaatttcttctgtctcctggccctcccctagaactctcactaactttgaaacccaccccctctagaaaagtgtctggtaaaggcaaaaagctctttgctgttgctagaacagcaacataccctgttggtttcttataatagtcccttcactaaacacccttcaactactctttttaaatgtaccatgtgctttccactgaggccctgaccagggcgcctaaaaataattcttggcccttgataaacacctgataaagagaagctaatattatccaagtaagacactgtttgagatttgtgttatgttatagacagtgtctatgacaccccctatcattgaaaacatgttgagaggagatagtctaactcttcccaaactccctagaagcccatcaaaagaggataataaaataaggacccagcaaaacactaacataaagtggccattcatgggtgaagcaataataattctggtcaccagcagcccttgcctgtgtgcaaaagttatgatgccgttataaaaaataaaaacactgtcggccctttgacaatgatgtgaaaggggagattttccagcaaaagaatctcagccaaatttgaagctgttatttacccgcttaagacagaaagtatcctctctgggttcctcgtgatctaatcctttaagccttctgctggcactggaaacaatgttaagctttgggatcaggccctttggtttctataatccatgggaatttgaagatgataaatttgtggagagcctgaaagttcctaacatttaatggaacccaagggggaaacaattaggatacagtcacgtaactccattaactcttctggaaggctctgaattatgtaagtcccctgctgcagctttcctcccctgcagccccattttgccatgcaacaaggaaaaaggcagaggcaatgaaagcaaatgaaaaaaaggaaagatctttccaatatgactatttatttgcattttctatgagaagtctggtggggaaagaattcaaactgacaacacaaatgaggggcaggaatcaacattagactgaacttactcaggctctctgagccacccccaacccttgaccatcctttccaaggataactgacaactacacacaacaaagaacacatcgaacctattctcattaataggatttgtgggggcaagatagtcctaatttatgctggcgtgggctgaactattgaaaataaaaggatgaacaagaagtttctttcatttcagctgtaactgtcactataaataggacatctacaaagagactggacttttgtgggctgtttgagcaatgcctgtgaaaggttgtaacaaaacctcaaaaaataaattcttatttctctgtttgtcggaggcactaacctagatttgccatcacacctgtgccaagaagagagcctgcaccactgcctctgtgtgggtaccactgaggggttggtagcagggagtatcagctggtgtcagaaaagagggacacctcctacacttggttcatgctgtgtgctgcttactctcttcttctctcacctacagtctcataagacattatccgactcattttcattccagtagacttggtagaagaagtctatggggaagccagacaaaaaagataattgaaagccatctgtgaatttcaagcacaaatagctctaaacaataactggcacaaagtatgggcttagtaaatgtttgtccgactcaactgaagtcagtgtgcaagtttttgttgtggagcagacatgccttggtctcaaggcatgctcgtgcacctgcaggtttgccatacttgagataaccaacatccaggtgggcttttaagccatgaggagaatggacctagccataagcaaatgtgggacaggtaaattcaggtaggtggcacaatctgaagaattgtcgggactgttctatttccaggctcttgcaattctactattagtggatcacttctgggagcaaatgttgccttcccaaaataattcatctggggagcaatttccataagatctcatatttttaggcatttaggacttttctgtttgttttcatattctttaatatgcttaattctcaaattgtttgttttcatctagatggaatctttactggtaaccactgtacaggtgaggaaattgccatcttgactttgagggaaatgctttttagaaatttgactcaggtgttccaggacaggtagtgtgtagggtgctgatctattttgcagaacaagttctctcactggagaggtagatttgtgggaagcctcagacctcttgggttgggaactgaaagcagaatctatctaaatctccaaaaaactttgcactctgcatatggttcattatgaataatttagtaaagtattcttaaattcaaaacagaacctgcaccccaaaatgatggatggatcttaagaacacttgatgaaggcaatgtctgcacactctgacagaaatgctttcaatgcagctttcttttcaatcacttggcagcaaatgtccatgtttgcaatctcatcagggagactaacacttgtgtctcctgctgatcatgccattgtgcagacagacttcatcaacaggcttgattgaacgttctgattggaaattttcctagaaagtttctgtgcagaacatgtggatactgccttgctttcaaaacatttgtctacacataggcagaaaccagtgggcttagaaggaagaattgaaagaattgttgccaagcctacgttcttgaagtaatgcagcataactacaggagacagcccttaagtatactgaagaggcatttcttaagtgtgctaaagaagcagatcttgtccaagatattccttgggcaacatctgctcagtaagaattcatcttttgatccgttccttcaaggattctttacttcatctcatttcttggcttctattttggcttgacctgaaatagtggtttcctctgttaacattacatcttcagcttcctccacctaggcctgcttccccattgccctctttctaacactggggatccaaaaagagttctcaatgtctctctgaaatttcctgatggagaacatgatactttacaaagaaagcagcacagagttaggaaaatactgctcagaaagcttttgtttcttgactgcatcagttatttattctgcaaaacaaccatcccaatttagtggcttaaaatggcacccattttagctcatgattttatgaactggcagttaggcttggctcaactgggtgattcttctggtttctactgggttggctcagagatctacagacttgtgcttatcaactggaaaatcatgtataagggggtctagctagtctaagatgctctcactcaaatatctcatggttggctcactgttacctgggatgatgagggtgaatgaaccacgtgtttctcattcttccacaggataatctggacttttatgtatggcagcttaaaacaattctgagaggatagaagcatataagtgctcttgaagctctattcaaaactagtatgtaaattccacctcattctataggccaaagaaagtcaaaaggccaacccagaatcaagacttggggaattagatgtcttgatgggagttgctgcaatggaaggtggttacagagatgagtgaagaattgaggacatgtttacatgactcagaggaagtttattgactagagaacagaacctacttacctaaatacagacttatttcctgaccccatgcacctcattctttgccctttgaaactccaagagaagttcaaagaagtcaggggacttaacacaattccatctgaatgaattagcaaaatatgggtcagagataactgtgtttttccaaaaggtggagtttatcattaatgatctcacagagcatggagagctgtagattatgccatacaagactaaacaaaacccctgatctagctatcacaaagccttggcatataaggactttttcactttagtcacaaaatatgcttcatctagcacttgtccttactaactaagcctttcagcattgtaggctttttgatcctattgtattctggatccctgcccttcagggtcagctctgggatgcccagatgtttaatcaaactcaatatatgagggctatcaaccagtctaaatagagaggcagatggaacaaagacagattagggaggcttgttgaaatttggctttgtttttttttgcccttcacagtacaattgtgttctcaagactaatgaatgatattttccacaatcatctagactgaaggaggcagagaggagtataatcaacttctgtattatcctcagctattccagtgactgcttctccaacatactgattcagatgggcctggctcttccacataaggaccagaactctgtacatacggtctccaaaatagcatcctttatccatcctccattcactctccctatactgacagttctgtgactgcttacttcatttctacagggtttgcctgtctggacaaagaatatctgactgaggcccccagtttgcttttggttatgaatggtgctacatctaattcttttccacatactgtctcctgtcagatgaaagggaataatcagacaacagaaaatgtctcacaattacaagacatcaacctctattacttatagtttctgtaaagtaactgtcatcccatttctaagcagaatatcccctcactctagtgggggttttacctctaatcacctcatcctacgggtttttcctcatgccagcctcaattgctaccctttttgaaaggtgctcagccaagctttgtttgattgattgattgattttttaaattttttgttttgagacagagtctcactctgacacgtaggctggagtgcagaggcacgatctcggctcactcaactctgcctcccaggttcaagcaattcccatgcctcagcctcccaagtagctgggattacaggcactagccagcacacccggctaatttttgtatttttcgtagagacgaggtttcaccatgttggccaggctggtcttgaactcctgacctcaggtgatccacccatcttggcctcccaaagtactgggattacaggcgtaaaccaatgcacccggctcaagctttgttttaaaatgtaggttttataatgatttagatatggtgagaccaacagataggagacagctgccgttgaaaagatagtttattactcacagttctcaagagggagcagctgtgcccttcagcgccacaccaggagaagcagccgggtccatcaggaggcagagggagcaaggggaaagtgtgggtgagagcctttcttgtggtttccatgggaagaaacaggcaaggcagggtaaacaggcttagggtttgctagtttgaatgatctcagtgggctctgaagggcccaggctgtcctgagttgtctgggatctggtcctggaatgatgagggcaagggaatattggcctggagtggaagagctaagggaggtagttggggttatgagctttggactggttggtctgcatatgagaggcatactctagttattttttctgtctaaagatgtgctaatcctaggaggggcagtctctccctggtcagcaaagccagagcatcattaatatagattccagccccttctaataggccattttcagaatgaaggggctactcactgtcgatggcccctagtgagtccttgcacatcggataccagatactcttaagacttggggacccttcctcacaatatgcagagtcagatgtagcttcccagctccacctccctctgtccttccctttggcttctctgtgctttgtttcaaatggcctgcacccaggactctatttctacaactgcctttgggctaccagagctgctctgcccacttaccctgagagctgtaagttcctagagggctatgcattcacccctctcctgggtccctgtgtccattagcctaagactggcttatataaaatacaaaagtccagctcctttccctccagtggggacaaactctgaggcatgtgtagcttatgttcctaagctcccctgtggggtcagggtcaggctgaggctgaggccacacctgaaatcatagcttccactggcttcttctccttccttttcatgcctgcctgtcccaactccttttgtggtttctcctaggcacatttcttttgaaaaaatatcactacacataaatccctatctcaggatctgcttctagggaacctgacctaagataaagaggaaaccagatgaatttatctgaaccatggtagactcttagtgcatctatcaccatctgcaatacaagttagtgtgaatcagctttttatatcatctgcctaggaaaattggtttcctagatgggtcttgtggtgtttgatctcttggggaaacatcctactgagagtcacaggggtccctcattatcctattcccccagatcatagcttattgcacccatcctgacccaaagtagcccactggttgacatttcagcagcctgtgtggccaagcctgataatatagtggaccaatgagatgctatattagtctgttttcacactgctgataaagacataccaagactgggtaattcataaaggaaagagatttaattgactcacagttccacctggctggcgaggactcacaatcatggtggaagatgaaggaagaatggcagctggtgatgagagaatgagaggcaagtgaaagaggaaaccccttataaaaccatcaaatctcatgagtcttatttactaccatgagaacggtatgggggaaactgccatcatgattcaattatctcccattaggtccctcccacaacacatgggaattatgagagctataattcaagatgatatttgagtgggaacacagccaaagcacatcagatacatttcttgggattctgaatttgtcaaacagagggactaaagctgttaacagcagggtaggcactgagtgaactaatcccacatttccttgatgaataaacccagggatatcatcatgagtgtccagtggagcccattttattgactacacatcacgtaatgtttttgcttccatccttcctgagtgcataacatatagaaaaagtgcaatcaaaattgcctttctgcaatcctctcacaaaacaatctagacgaccctctgccctttcctgttttcctggctacattatcttttactgtgagaaagactttgaacatcgctttgggggatattaacatgtccaaagtgtgctttgttttaagaaaatgttagggcagcttgacagacattgagagacatgaaactaagggagaacaaaatacaaattccagtacttaatagtaaaatagcataaactgggctccacctttggagaagagggactgcaggctagggggcagaagatgctcccagcaatgactccccttgtacagacctgtcttttgtttctttgctcctgcagggcagagagaaacccctgggaaggagaatagggcaaggtggatggagtgctctcattttgtgttttgacctttcagttcttccctttccctcagggtttgaaaggtactttgtgggtggtagactctaaagcctaagattttactcatttgaaatactagatacaagaatattttccctagtgtccttgtccatttaggctgctataacaaaatatcatagatggggtggcttataaacaatagaaatttatttctcactgttctggaggctaggaagttcaagatcaaggcactggcagatttggtgtctggtgaggtcccacttcctggttcatagacactgtcttttggctataatcttgcatggcagaagggacaagggatccctctggggtctccttgataagggaactaatcccattataacagctatgtcctcataacctaatcactcatgaaaggccctgcctcctaacaccatcaacctgtggggtgttcgaatttcaatataagaatttggcagggatgtatacattcagtcctttgcacctacttacacccattctgggtctaatcaaataacttattagtacaacagctgcatgctctatgccatggtcccttaatccatccctgacttatccacagctgtgatggggacagttcctgatggctccatcagctccccacctgaagtacctgcttctttccttttcactgcaagaagtctttctccagagcctcgaaagtgttctcaggctacctgtgatatggccaggaagttgaggatttaatgccaccaggagtgaccctcagccaatgaaaatcagaagtcagtagataaaggcctcagtttcttcattgctcagggaacagatctaaagcatgttctacgcaataccatagagagtctccatagacgtgaatgccagttatagcagtaacctgctcattggcacaccttttattggattcacttcttttccttcttcttttcccaactccctcattagtgctttcctggaatcactcaaaaataaactacttgcacccaagttcttttctcaggatctgctaattaactaggacacttgtggttaagtggaaaaatctgacccttttctcaaagtccactgactttgtcctaagacaatgcactgagtacaagttgaaattaggatggaacaaaaatgctgagcccgagaaagccatttgatagcagagacagtaagagaagtccaagttgccacaaccactacagcctatatgatgccttttgcaaatttcaaaaatattttacttcctcaagacacttttcacctattgaaacattttctgatatagaacaaggcacattattgccatatgccaggaaattgtcataataactataaaaatgtacagtctctaagatgtgaaaggctaacccaaagtccctcactttcacaaccgtatatggtaactctgcctttacttggtttcagttacaattcttgttcctctaaggcccagccaggccatgattcctgcccttgaattctgttgagaaaccgcattgcgttctgcctgtccttaaacagagcttgaatgggtctctagcctttaaagaaacagtagaaagagtcctaagtcaattattacatgtaagtcaggacctccaggccagtggtgtaatcagtttctagctctaaaatttgttgaatagatactgatgaactccagttagaaaaccggtaggataacttagatcaaggtcagtgacaccaactaattatgtagcacacaattgttaatgtaaattaggtgtttaaatgtgtatttctttatttaaaaaaatatttaggtgtattagttaggtttgtctagtgataatgctccataacaaacaattccaaaatctcagtatcttaaggcaactaacatttattttactattacagctgtggtttggccattttcagctgggtttggctaggctagaccccaagttgacttcaagttcaggtctgctttatgttttttgttccaggatgtgggctgaaggaataacatctacccagaggaccctcttttcatagcagagggtggagaataaaaggccaagtcaggccaggtgcgtggctcacacctgtaatcctagcgctttgggaggctgaggcagcccgatcagttgaggtcaggagttcaagaccagcctggccaacatgttgaaacctcatctctacaacaacaacaactacaaccatatatatacacacacacacacacacacacacacacacacacacacacacacacacacatatagagctgggtgtggtggtagatgcctgtagtccaacctacttgggagactgaggcaggagaattgcttgaacccaggaggcggaggttgcagtgagccaagatggagccactgctccagcctgggtgacagagtaagactctgtctcaaaaaaaaaaagaaaaaagattaataaatacataaataaagggccaaggcaagcaagcaagtacatttagtcttcatgttcataggcttgatttactcattccacaatgtatacctgtttcaaaacagcatgttgtacaccacagatacatacaatttcttgtcaattaaaaataaataaataaaaattatatataaaaaagaagtctctgcttggacattgcccatgtcaggtctagtcacattccattgaccagagaatgtccttgggctgagtctcatctgagaagaagtgtatcagtgcctagcaaagtgggaggcactgcacaaacagcagagtgtgcatatgtaattctattcaatggggagtaaagaattggaaattatcacaaggtggaaattcttaaacataccctagacagaatgtcataataaactccaatgtaccctatcacacagctataaccatcacctcattattaatcttctttcactcccatataatttcgaagcaaattctggatattatgtcttttaaaggaagaaaatgaatctatatttttgaagatgagagtttatttagaccttaaagagtttacaaaacaatacaaaggatttactactaagtcaacttgatataaaataagacacaaatacatattcaataacgttaagaaacagtgggccgggcgcagtggctcacacctgtaatcccaacactttcggaggctgaggcaggtggataacttgaggtcaggagtccaagaccagcctggccaacatagggaaacctcatttctactggaaacacacacacacacacacacacacacacacacataaattagccaggtctggtggtgtgtgtctgtaatcccagctacttgggaggctgaggcaggagaatcacttgaacccaggaggtggaggttgcagtaagccatgatcgccccactgcactccagcctgggcaacagagcaagactccatctcaggaaaaaaaaaaaaaaagaaacagtcaattccaggatgctgtacatgggtgttttacgctgaatattgatgaattttatacttaacttcctggtctagctgaaataatgaatactaccaaagattaaaagtaaatgcccactgtttatctagttcattaatcttagtgacaaaagtaaaaaaataatttgcaataacagaattttaagatgcaagccaaagttactttggactaagctgtggagtagaattacatcgtttttggccaaagccttgctttctcaagacactttactttcatcttcggggacatcttaaaagacaaccacaaaataaacttcaagtgagttacaaatggcaaagaagagcaaaactttaaaaagtaccaaaataaaattgtcagagtgtggttaataaaaggaatcatcagatcaatctattatcatgtcacttttgactcatacttaaaataacatctcagtttatgaaatggccaatagaaatccattttcttttttttttttttttttttttttctgagacagagcctcactcttgttgcccaggctggagtgcagtggcgtgatctcggctcactgccacctccacctccggggttcaagtgattctccctcctcagtctcctgagtagctgggattacaggcatgcaccaccacactcggctaattttggtattttagtagagacaggatttcaccatgttggccaggctggtctccaactcctcgcctcaagtgatccacctgcctcggcctcccaaagtgctgggattacaggtgtgagccactgcgcctggccagaaatccatttttaaagtcatatgcatgatttctgtattaagttgttagggctgccataacaaaataccacagaatgtgtggcttaaacaacagaaacttattttctcacagttctggaggctaaaagttgagaccaggttgtcagcaggtttagtttcttttgaggcctctttcattggcctgcagatggttgccgtctccttgtgtcctcatatgactttttctctgttctcttgcatctctggtgtctctttttcttataagaacacgagtcatataaattagggcctcagtcttatgacctcatttaacccttattacctctttacattcatattgggggtgctagtgtcaacgtgcaaatttggtagagacacagttcggtccataacaattatatcaaccagtaagtattattacaagctcttaacaactgataccaatactaaaaatagctaattagctaacaacataactaatagttaacaggccataagatagcactgactatgtgctaggatcctttccatgtgctttacaaatattcactgctttaaaacttaaaacaatcctatcatgttggtattatcaattcccctgccttacagatgagaaaactgaggcttggagaagttaaagaagtaggccaggtgcaggccgggcacagtggctcactcctgtaatcccagccctttgggaggccgaggcggacggatcacgaggtcaggagttcaagaccagcctgaccaatatggtgaaactccatctctactaaaaatacaaaaattagctgggcatggtggcacatgcctgtagtcccagctactcaggaggctgaggcaggagaatcacttgaacccaggaggcagaggttgcagtgagccaagatttcaccactgcactccagcctgggtgacagagcaagactccatctcaaaaaaaaataaaaataaaaaagagtaggccaggtgcaatggatcacacctgtaatctcagcactttgggaggctgaggtgagcagatcacttgagtccaggagctcaagatcagcctaggcaacatggcaaaaccccacatctaccaaaaaatacaaaaattagctgggcgtggtggcatgcacctgtagtcccagctactcaggaggctgaggcaggagaatctattgagcccaggaggcagaggttgcagtgagctgagatggtgacactgcactccagcctgggtgacagagtgaaactcccatctcaaaaaaaaaaaaaaaaaaaacaagtagagatagagtagccagttaaattaggatgcccagttaaatttagatttcagatcaacaatgagtaagcttttagtatgtgtatattccaaatattgcatatgacatgtctatgctaaaaaagtagaagttgctgaaattcaaatttaactgagcatcctgaatttttactttctaagtcttataaccctaagttagagataagcttttttttaaattatactggagcagtgagttttaaattgctcaagagaccctggaattttcaagagctatattaggaaattgctgacagggcaaaagagaagataaacattgagattctccctttcaaatatagcatctcctttataatatctttttatatgttactgagatttgctatgaatattcacttgagaaaaatatttctttgactttaaaaaataaatgtgcaaacctactgtttttcaagtaaaattaacataacttctggatgttttgttttttgtttggggcattttttcccccaaaatggtacctttgtcttttccaaatctgatatattctaactttctgtctccgtaaagaattccctaagactggctcatttgcttggaggaccctcaaagagaggtttgcaaactctggccaatggcctacaggcttactctgtttctgtaaataaaactgtattggcattgtccattaatttacatgttagctcttgctgtttacacattgcagggcagtgttgaatggttgtaacagagaccatgtggcccagaatgccaaaaaatattttctatattatttccaaaaaaaaaatctgtcaactcctaatccctatgtatctgcttctgattgctaaaagaatggcttagaaacaagttgtcacgaagaatttttttttttaagtttaaaagaggagatcaactgggcagatcgattttctatggtcacttttaactgctttatgtcacttggaaaaattgtcttataaaatagccaagttatccaaagtgttcttattgaagatagagtcacatgggttgttgctggtagtgatctttaattctggagagatgaaaaagacatgaagcttctactgagacaaagtctatcaatatttttctgcactgatgacgactcttttcaaaagtggaccttgaagcagaaacccgataatttcttccctgtttccacatcaccctcttgtcagttctcttaacaagttacagtggtctgcaatgttagaattccagacaaggcatttaaggccactggactcttataataatctacaagggtttaggttgataatcccaaaatcagccctggaaactttaatagaactgctgtgtctttgaagtcatatcttagcgacatcttagtcttccttcgtggaaagttgtccataaacacattatccacctcttgaccctggagaatcagttcattattgccgcctcattttgcattttaagcagttattttctgtagctcccagattcttcctgaatcaccaatagtcataattcttccagggccatgaaggactcaggagagtgaaaccacttagaaaaatgttcctctctgaaagttgaactctacatacttagtactataaaaatcacactgtcaatctagctggtacgcatatcagtaatattataatttcttgcatttttcttatttacactttcttgtgatgtggatcatgtatgattttttaaaatttagagtgtccaaaaaattaaaaacatattttaaaagaaagatgctataacataaagaaccacatgaaaaaacaggcgtacagtcatatcatagaaacgtcaacttttccatgattatcatggttcagattttttcccttgaaaccgaagagccacattaatagtatgtttcaaaaacatatttattataaatgacaagacaatctctttacatatttataatgtctacatcatttatatctatttatgataatagaaacatatttgtcctagtctcttctgcattgctgtaagagaatacctgaggctgagtaattcataaggaaaaaaggtttatttggctcctggttcttgcaggctgtacaagaagcatggcactggcatctgcatccagtgagaggcttatggtcatggtagaaggtgaagggggagcaaatgtgtcccgtggtgagagagggagcaagagagggagaaggatgccatgctcttttaaacaaccagcttccacgtgaactaatggagtgaaaattcacttattacctctgggaaagcaccaaaccattcatgagggatctgcttccatgacccaaatacctcgcaccaggcccgacctccaacacggaagaccaaatttcaacatgagatttggaaggcacgcatatccaaactatattaacattagaaaccacctccttaggaatgagacatccctttggtgcaaacaaggatcaatcagtcattttagagactttttgaatgtgtaaaaactgtttgggtggttagggaaggcaatgtgcactatcttatttgattgaggttatccacagtaacctcggcagtgtctggcgtttggtgattcatttgagactggtgttggtcctgagatgcctcttgacgatgaagcaagttgatgtatgtctagggcttaaagaataattggccaggcgcagtggctcacacctgtaatcccagcactttgggaggccgaggcgggcagatcacgaggtcaggagatcgagaccatcctggctaacatggtgaaatcccgtctctactaaaaaaaaaaaaaattagccaggcgtcgtggcaggcgcctgtagtcccagctactcaggaggctgaggcaggagaatggcgtgaggccgggaggcggagctcgcagtgagccgagatcgcgccactgcactccagcctgggcgacagagcgagactccgtctgaaaataaataaataaaataaagtaaaataaagaataatttcccctaaggacctcaataagaggcacctgaatttccaggtagaagctgggaagaagtcgtcccaggggatattgggaggctgagtgttttttcagacagaatgaaccttcactttctttctgtaacagtcatgacaagaaataattggcttgtgagaatcaacattgaagctggaaaaatgatggcatccgaacaagtagacacagccctagtcaaggcaataaactacactaaagacagaggagaaagactcaaagttgttctaacatgtgagtacctaggggtgctgcatgccgttgtgtggtttgtgtactgcatagttgtactcagccaaggaagtggatgaggccacagctttaacatgggctgctgtctgcccagaaggataatcttttccttattttatatctcatttcaggggttctccaacttctgaaatccatccagaaactccctgtatttgggtaacagtattataactttttgcaccagggcttttttgtttgtttgttaatattaattgatttttcttatgttctttatgaaagaataactcatccattaatgaaaccaaatgtgaacttagtgccttctgtgtagaaaaggctaggaatacatattgtgggagattcattacatcactggccttaatactacaccttctcatgttcccccttggctgtgtaactttctagtgtccatatgctctctcttggggtggccagtgtgacttgctttggccaatgggatattagcaaccatgacataacccgaggcttataaagttgcctgctcattgggacttgtttcactgttgcatcccagttattcacatcactccagctgacagccaaccaacaaacagccagacacgtgagcccaaccaagatcagaagaactgtcccactgagcatagtctaaattgctaacatgcaaatgcatggtaagcgctacttgtttatggcattgaggttttcttggttatttgttacacagctttattgtggcagtagataactgatactgatacacgtggtgaacatgacagataagctctctgttctcccaggcttacattttaatggggaaacaagataataaatgaacaaataaaggaacaaatgaactagaaaaaatagctggggtaagtgatatcacagaattacatcaaaacaggagaggggtggtagaattagttagggcctacacaatggctttacttttgatgctgaaggatgatcttaattagtttaagatctgaatgagaagagtcagccaggcaaagaccagtgaaagtaacaatctagacaaaaggactagctagtgccaaggtcctaaaaagggaatgaacttggagaattctagaaacagagaaagccactaggcttgtggtgtagggagtgaggcaaagaggagcagcacaagatcagatcagaaaggaagacaggataagatcagagaagaagacaggccagattacacaaggtttgtaagccaaacaaggagattagagtacccaccagagatggcctttatgtacacaccatagatggcctttgcattcccaccagagatggagtttgatgtcttttgtctcaggcctgggtcagagcacaaagcagcaataacagagaagcaaaagagacattgttggaagaaaacaatcccattcctggcttctgtaaatggaataggaggggacacagaggcagattcctggggatggaagaatgggaaggaggggaagagggaggagattcccctagactgggcagcaaagggaggtcagaaggtctgcccctccagaagaggccaaggcagagccttcaggagggacaggaactcctggggcacctgcaaggacacctaggataccttctctaggcactgcagccctggccttggcaggtgtactttgtctagaaattgcagggagcctccatggtctcagtttccaagcaccatggaaacttcccaagatgccattcattgtgactctggctcagacaatgggcatattagggaagccaatgtgcaccatcttatttgattgatattatccacagtaacctcagcaatggctggtgtttcgtgattcagcctgtgtggaataaggaagggagaggccttgccaaatatttctgtgcccgagacctcccctcctctgtagccagagttgccatgaccttgtagctgaggctggggctcagagccccaattctgactcaaaagagtgtccaggaacccaatgccatgaggctcaaggtcaagtaatttgatttttaagaaaattaagaaatgtgccctcttcatctcaaaaacactatgttgagtgaaagaaatcagacacttaaatgatattcaagaacaggaaaaactcacctatgatgataaaaatcagaacaatggtttcctctgagggttgaggcaggggccgagtgactggtaggggcatgaggaaacttcgggggtgatagaaatgtcattctcttgagccacatgaagctttcaggtcttgagctaaatgtcaccaccaaactgtacacttaagatttgtccatttcaccgtatgtaaattttgctgctataaagtattgacttgagtctcctgtggcaaggaaggaaggaaggaaggatggaaggaaggaaggaaagaaggatggaaggaagggagaaacagaggaatgaaggcaggaaaggagaaggaaataaaggtgcacgtgttgcagatcccaggctgtcacccattgcacactttccacctgttttttccacaaaataagcacctagtttgtgagaggttgtgccaagcatctagtctgtgccaagtggccagagagaaaaaatatgtaaacaaagggtaagcatacaaagctcagacctgggcagtattagttctatccaagggtgaaggagacaagctctcagaaagatttaaaggggagagaaagggtcatgagggctggagggatggggattctctgagatctgaattcaccttgcacttctttttctttttgagaaacagaccacagcaaggtaatcttacagcccaggactcagctgctgcaatctctgtgaaaggtacttatgactaatgctgatgccaccatgaagctcaggaaacaatttacagggacatgggctgttctgagaccccacagccatgaatcgcctaatcattctgacagatttctgcagatgctgtgctcaggtcactgagtttcccagttgtcagtggtgaactggagcggaggcagaaggaaactcttcagacacactgttcccttcaggaaacaagggacaaaagggctgccctgaggagacttgggaaagtgacatttcctcaggctcgaggacatcccgaggtgactttccaaaacactgggttaaattggcctgattgtttattttcctcagctcgctttagaaaaaaaaaaagtccatctgtcctttgatatcaataaaaagagcatttgagactattaaaaacactgatggagatttgtttgggagaacggaaaatcgtgccaccattgaaaatggcaacacacacaaccttccatatggccatttctctgcctcagtacttccaggctgaatttcttgtcagctccagcttctcgccattttgttctcagggaaaaaaactcaggaactatccattcccatgtatttaaatgaaaacttcccaagatgccattcatcttgagtctggaagcaaaatgtaaacatgtttcataaggagtattttgccgacaccctataatctggtttatgacactgctttgtcaagaggcaaaggtttattccctccttttcaaatgaattggagatgttctaagtcagtggttcttgaaatgtggtccctggaccagcagcaacagcatcaccagggaacttgttacaagtgcaaattctcagccaggggcagtgacacgcagcatagcaagaccctgtctcaaaaaaaaaaaaaagaaagaaagaaaagaaaatcctctgactgcagcctagacctacataatcaaaaaccctaggggtgtgcccagtaatctgtgttttagcaagttctctaatgcagttttgaagaaccaagaagctaggctctctcagttcaggattgaattcagcctcgattaaaaactttcaaaataacagtgacttaaacaaagcagaagttcatttctctaacacataaaagaagtccaaaggtagatgttcagggctagtatgaaggctccatggtgacagaggaaacctaagttttttctatttttctgctctgctatcctttgtgtatggttttttatttcaagctggcttcatggttcaaaatggctacaggagctccaaccattacttctctgttccaggcagaaagcagaagttgggggatagagcaagcaagtagggtctactcctgctgtttgtgtccctctgcaggaattttctcaacagtctcacctaacaattccatttatatttttggccacctatagctgttaagagaagcttagaaatacggtcttttatcttaaattaaaattgtcattactgataggtaactcactttctctgccaccatgattccagaccctcttccatataaataaacataattccaaatacaaagcgaggttaaactcttctatcccaaggaaatatcaaacatgagtatgactacatttttagtaattttatgaaagaatagtaaatgatatattgagaatctcataaatgatcttatttaaactttccatttcacaaatgaacaaactgtggcccagagagggagattttcatgtccgtaagagctggtgagaaacagaccggggtgctagaacctgaaggagctaggaataaatccaaagcttcctgaaatgtatgccaaagcagtcgtctcataggagactccatggacaaaaatctccatgatcaagtgttgtcagttaacattacaaagaacttggagcccattaagattaaattttttaaaaaaacaggctgttcttcatactcaacacacagactatttatcacttaaagtgagttcttagaacattaaaagtaaaatggttgtatcagaataaattttattgcaaattctcaggacttatttcagaactcctgaaacctactttgatgatttcaggttctgctcatgaaacagagacaaccatgtgtggtgcctgcattcttggcctgcggggagtggaaaggagacaaagagtaaaacacggtgggaaagaagaaaaagaggttaagaaaagcaaatgtgcctactccaggtaattttgacttagggaccctgattaacttacacactaattaaaccatttccagattttgtgcagtctgaaagcagcccattttccccaacaccaggtcgctcaagatgaccacaggaaggttgtcatcttcatgtctaaaagccagttgacactcaagggtgtcatttcacttcagtgaaatgagaagcttcacagatgtgtagactctgaaaaatctaactggaaaacaatacagggaaatagcaatactaggcatcaaagcagcaaaaaaactactcaattatctgatatggggattatcaatggaataaatgtggggtttgttgtttgttgttgggattgttgtgggttttgtttcattttttagggtctcacttttctccaccaattagatctgtgctgtgagccacacaggttttgagtacatgttttgggactttatatcggtcagactttgccatggtaacactgtgtaacgagcagccccaaaaatctcagtggtggtcaaaagcaaacctttatttctcattcatgggttttcagtttgttcaggctaaaagtaaaatacacagattcttcacctgtctttcattccatgctgaaggagcaattgactgcctgggacatacttttctcataacagaggcaagggtgaaaaacaccaagtcatcttgattatgcaatcccatttttaatgtaaacaatgtcatgtctgcttctatttcattgagcaaagcaagtcatataggcaagcccaacatcagtggggtgataaagcacactctccaatggaaggaggaggggagcatgatcatttgctgaacagtaatgcaagatagcacaagacttgtctggggtgagagagagatcaaagctgtggatcccacccagtcttcaaccaaagcaatgtggctttgacctgttttctgtcttggacttgaataatactttatttgaaagaagtgttaaattgtttattaaaaaaaaagacaagtttgaaaa

SEQ ID NO: 32 - DNA, 65297 bp, Homo sapiens
  source 1..65297: mol_type = genomic DNA
gagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgagtaggggcccggcggccggggaagcccctgggctgggtgggaggtccaagtcggtctctgagacacgcacaggggccggcgacttggcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtaagttcttcatctttttagaaaagttctgggaatggaatgtatcttaaatttatttttatatacctttggagtgactagtaattgatagttctctagcgttactaaaccccagggtataccctgttggcacgtcacactccagctaattgaagacatttaccaccctgagtaggtcctgctgcttcattaagagtttttcttcctaacactgtacctcttgaacgaactagtagagaaaataaacaataggtattgtttagggagtaaacatataaaatatatttggcaattgccttgagacacatagcgtaaatgatatgttttcttaagtattttataaagtaggacttaccaaatacaactctgtggtggcatttttaaaagctctcaatatttacttcaaaatctgttatacttgtacatatttatagggtacatgtgatattctggcacatgcatacagtgtgtcatgatcaatcagggtaattggatagccagtacctcaaacacttggtgtttgtgtggagaatattccaaatcttctcttcttgctactttgaaaaaatatatgtatatatataaattgggatatatatatagggagagagatatatataattgggatatatatatataaggagatatataattgggatatatataaggagatatatatagggagagatatatatatatagggagatatatatatatagggagagagatatatatagggagagagagatgtataaactgggatatagacaggtagataggttgattgttaaaaatgaataagaggcccagtgaagagttgtttgggggctaacacagtaaccgtgtttgatactgatacctagtagaattaaaagaaatgaagatttcttgttttaggtgaatatacatacagtcatccacaccttatgtgccctttgatttcataaaatatatattggcattatcttggaggaaaaaaatctgttacttacatagccctgtattagctttgagatatatgagtagagataaagataaagagacccgataacctgactttgaacaacttaaatcaatagaagctactgtaaatacagaaattggcacaaatacctttagaagccatgcgtgaaataggctttaactttttatttttatccacaatagaggcagtaggatgaagtacatagtctttgcacatgtatcatgttttaactcttccccatgttattactttatccaatcctccaaacaaccttatgaggtaagttggggctcttacactctttttatggcggaggagacagaccccagtagtttaataacttcctcaagagcagcagcttttacgccaaaaccaaggtgtaaacttgggtcttctgactacaaatccaatgatgacccttccacttgaccatgcctctctagattcacatttgtgggcaatctgtttacagatgtaaatactttatgtatacaatttgtgggcaatctgtttacaggtgtaaatactttatgtatacaattgactcatccttgcccccagggctcatgggaattaaatgagtttgtacgtaaataaatattagctgctattattgttgtgcaggacattagtccaggggtctggaaataccctattcctgtactgtatggtgctgtgtagttctttagggcagggtaaggaaaccaacatttattgaatgccagaactgggccaggcaacttaaatttttttttttttttaagtggggatagtgatatgtgtgtaccaactctacttcctaagcctctagtaactaggaaacaaagtatacatgtgaatacatttgctacattgcaagtgccatggtgatattaatatagttaagtactaaatatgcgcaaagcagtaaagaaagggggttattagggtccagataattaaatatagattataaaacaaaaattgatactacattttttgttgctgcttttgttaatacttttaggtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaagtgagtaaaattttttaaagtattttcaaccatctggtgtttgggggaaatagtatcccttccttcattcatgctagaactctatgtgtatatattattatataggatgtttcttgataggaccatgagtgtcaatttattttgaattagactaaatatttatgtggtaggaatacttattcattcaaaaatttcacatttaattagtttgaggttacctaaaataaaacaagtatatattctaaattcgttgctttttcaaaacttattataaagagaaattagaattaaagaagtctaagggtcaggcatggtggctcatacctgtaatcccagcactttgggagacagaggcaggtggaccacttgaggtcaggagattgagagtagcctggccaacatgatgaaaccctgactctactaaaaatacaaaaactagctgggtgtggtggcgcatgcctgtaatcccagcttcttggaaggctgaggcaggagaatcccttgaacctgggaggcagaggttgcagtgagctgagattatgtcaccgcgctccagcctgggcaacagagcaaaactccatctcaaaaaaaaaaaaaaaaaagtctaaggataagaaatatcaatggttcagatgatgaatttacatatatgtgcttgataattttttcaaaatttttacctgagctttattgaggtataatcgacaaatattatcttaggtgtacaacatgatgttttgatatatgtgcacattgtgaaatgattaacacagtcaagctaattaacatatctaccacctcacatagttaccttctttgtgtgtatgcctgataatttaattttaaaaaatcaatttgtattctattctagagaaatcatgccctaatccgggagaaatacgaaatggtcagattgatgtaccaggtggcatattatttggtgcaaccatctccttctcatgtaacacagggtaagtttgggcatactaaaaccctgtatttaggaaatgagaaaacaaattaggacttaaggtgagattgttagtttcatgactggtattcacagctagtagcaattaaaacaatccctctcctcaaagacccttcatcatgagctcatcacagttaaatttagtaaaatgggggcaagaaaggaagatttcttaaaccaccagaattctctaaattctgatttcagtaaatatgtgattcaatataaaattttaaatgtgattaataaaaaaatttgagatgatgatacttgcagaaatcttcaaatgttaaatactaaaccaatctttagttgacctaaataatgaatttgcatgagtttttctatatgcaaacaagctgttacaaaacagcatgagttaaagacattcctagtgtgaaagtattctaagttctttgataagttctctgtatagggagaaggaactcattcattgagtaccatcaatgtctcagacactgttgaaaactttacatttattttctcatttcatatctgtaaattaaataattctattttactctgtgtgtgtccctattctttataaagtaaaaatatcagtatcacttgtctcctatacgaaacacagatattggttaggtcatgaacacaaaatctgggaagtactttgaaccctttaaatataagtacattctattattctgtgaagcccatatttagaactcagaggtataaaatgttcaatcatctatgtcatttaaaaatgtttaaaacacttttatgctttctaacatattccccatgcaaataaaaaatgtacatgtcttatctgtttttactctttggatgtcacgtttttaaacttaatttttcttttcctttaaactactgtgtggacttttatcaactactgttttatattcacctaattgtgtagtaaatattttaagataataacctggagaatttgaggaaagtcaaatatgtgtgaatgtaacaaactcttttttcttcccctgttgctttaggtacaaattatttggctcgacttctagtttttgtcttatttcaggcagctctgtccagtggagtgacccgttgccagagtgcagaggtaagagttaaaaaatctaagcactcagattgtgaggctgagtactcaatgataaattaatttctgccccttaagaatattagcacagtgtgtatttgtagcaaacccacctttcaatatatgagtgctttgctaattttaagaccttttctagtgatgttccttcatttagcagctgtgaagataaaccagcaagttttctgagtcccaattcccaaattgtagaatgaggattaaaaacaaacttaggtttgtattgcacttggtcatttattgtctaaccattacttctaaagtcaagtatgataggtgaaagatttccgccccacaattttgtgtaagaaaatagtgtcaatcagagggtctgtaagacttgaccccatatcctaaaacaagtggcaatggaaggcatttaaccaggtctcttatttcaaacccagcatttttctaaaatccagtgttgcctacatgctgcttcttaggattaaaataattaaccgagataattatctagaggggttttaaggtgtgatatattcttatcattagagagataagcttataccgtcaagaagaaatactgtgtctgtatttgagaatcttctcaaagaaagatatggtgcagaaataatattataaatggatatatatccagtcaaatttatgtcaattagagacacatgtctcttggaaattgagaggaataaaatacatgcaacattttaaaatgtaggcttgctttctttccatccttctctctctccacacacaatgtgccctcctgcaaatgacttctgaaggccctattgtcaaaattattgataagttaaagtttttgtatgttactaggggaagaaaactagagtagatttagtgtaatttatcaagcatttatcgattgacactctggtaggcaacgtgtacggtcaactgacacgaagacaaataaaatgaagccgtgccattaaggagcctgtccctgccacacccaccatgtgcccttctttttgagatgtcatactactaccttttttttctcattgtagttgtttttaaatttttcatcattgctacccagtagcacctttcccattttcgttgtccagtaagagacattgtaaatgatagtaaattaaagatagaaaacaaggaaaagctgggccatatcttttgtttgacccaggcaacatgtcacaaagttcagacaaacagtctcccatctgaagccagtattttcacaagcacctgctgtgtcatgaatttgacagaaatgcaaacccactttatcttcctgcttgcacatctaggccacagccttgcttccctatctggtgtcttgaactccatgctgaatattctgatgttcatgttttcctccttgactcttctatcctctctgtgactcagcaaccactgacatctgcatcctgtaggaaagagcccctgttcttaagcaatcccagtgccttcaaatatccctataaggccttacttctttcaggatcattttgattttccacataacttgttttgaccataccaaaaagattgaatggaaagtgaattcttaaacaatgtactgcttcacctcaagtatgtagccctagactataaacacatgaggttgcttcagtgtccatgcgtgaatatggatacgaagaaggaaagaacagtggacacattcactaattgtctatagttatacagaaaacagaggtgctgctagtttacctctgaatagagcctcactgtcagaggacctgtttgcttatctctctgccaatgttttctttttcaaaattttagttgactgatggtatctgctaacctagaatcaatccctgctatatgactatcatgccagacccttctctttatcttaactccccacatctcatccctaaatcattgtgctttacctcctcaatctgtttttcaaacttgtgttttgctctccatctgtatatttctagcatagtttattattcctcctgtggactattgcaattagggccacccctaacattttcagggcccaggcaagaatataaatggaggtcgctggcctaagacccaccttgtatcaaatagcccttcctcttcccacactgtatgggttctctggtgcacataagcggacaactcagcctacatacccaagacatgtccaccacatccaccataacttgtatccaccctccattgtctgttgggttagaggtgagtatatcagcaggatagaccaccctcaagaacatggaccagtgggagggaccctctcaggccctggaaggggtgttggcacagggaattctgggtgctagttcctggagcatgttctggaatggaggagaagtcgtaggacaggctgtcattgagtatatgctatcagcctacaaacatcccaccaacaggggagaaatgcatccagaggagggccagagcacagccttttaaaatgtggggtttgaggcagcaatcttagttgcctgagttcaagagtgacactgatagcaatggcctcctgcctccattctttcactctattaatgtttcatccatattttacccagagcgatctgaaacacagatgtgacttagacatctatttcctccttagagcttattcatatctcctatcacttaaaaagcccaaattccttagtatagtgtacaaggcagccatggtctacctactgcttgacactcaggtcttgccttcatgttttatgccttatacatgcaaactgctgtggtttccatgtacctcttttttttcttttttttaaattgagacagggtctcactctgttgcccaggctgaagtgcagtggtgcgatcacagctcactgcagcctcaacctccttggcccaagtgatcctcccacctcagcctcccttgtagctgggactataggtgcacaccaccatgcccagctaatttatgtattttttgcatagacagggcttcctcatgttgtccaggctggtctcgaactcctgggctcaagcagtctgcccgcctcagcctcccaaagttctgggattacaggtgtgaaccaccatgccccgctgccccttctttacttagctatattttccttactaagagttagttccctagcccatcagaaagattcccaggctggctacttcgggatgacccttgcattttttattgaaatcatttctgaatcttttttcccactagcttttaagacataggaactatatcttgttcagctttgcgcttccaattataaaaaaatgcctggcgtgtgttaggcactcagaaaatgtttgaactgaaccaatggtgtgtgtgtctctgcacactctaagttagtgtaaatcagaacagcttgttgttgctgcttgttttgatccaagaccaaagagtgattgataaatgtgctaagtattttctgtgttcttaagtatgtttggtgtaacataatttggcatacacacatattaaattgccttcattcttaaaaaaaaaaaaaaggacaacaacatcatgcctttagattatgtggaaccattgaattttttctcagggtaactgccagggagtggtccctttttacagtataactaaaaaaacttctgcttgtatttattttgtaagttcagctgctcagtaagattgttttgagtgaagtctctgtgagtccatatgtgctaaaaatttttactctagaagtcaaaatgtaatcctgacatttaagatctctgctgtatccaaaatgatctatacttaactcttaaacatgctgcttgaattttcaactccttgcatttgctagcgtttccctcttagagtgaagagcaacgctttctccgctgttctctctcaaaagcatggtacatattaggtttaaactcaagttctatttccctgcccaagtcttctctgactacactgctttcatctctaaaatcctgcagcattcacttttcctagcaccgttttgatatgcacacatcttactataatttttcttttacatacatgttctgaatcttattatttctatgaattggtctcaaggttagcatttgtcttctacaccatttgcattcaaagctcccacatactaccaattacttaataggcatttataagcatctcttgttggtaatgctgaatttagaaaaatgatattttgatttctttaaaatataatctttaacatgttttgatcttatttgtaaaaatactttactagttttatttatttaaaagatgttggaattgttttttaagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggtaatcactttggatagttatatttttgctttattcttaccctcaggtctatatgtgggttgcagacattcaatgaaccccctaagaaaaaaatgtaaaatgtttacatatacatatttgtatttttctgtgggacacaatttttctacagcttctcagaagggtctatggcttgtatacacacacacacacacatactcacacatattatgatgtgtatatataaaataggcctcatatttttggcaaatttgcttacatttgctgttttataccatgttgctttcagtaagttaatataggtactttgtttatacaaagagatataaagtggtttattggagggagaatcttagattgaaggctctagatagtgatcatacctgttgcaacaactgggaaactcttgccatctgttgacttcactgaattaacattcaattcttttctgcctccagaatttctattattatccattctccttcatccttctagacgtttttctttcaatgtctttttatacccagaaggtactctcagaatccttcgaactgctttttaaatatattttaaaagaaatatttagaagatcagtgaagctggactaaacattgcctagtatcaataggtggcgtttaagtagtggtgaataccaacatgactcaagcatttgagtatttacttttataattataattgaaattttattagtatgaattttaaaaattccttattaaaatagatttttattataagtgttatacatagacataatgacataatattaaagccagggagatgagtacaaaatgggaagtgaaagtctcttctctatcactagtcctactcggagaggtaacaattttttacaaattcttttgttttattctagaatataaataaacatacaaatattttttatttattatatcaatggtgtgggtattcatttatctaaccagtcctctattgatgacaatttaggttttttgttctagtttgattttttttatgaactattattacaaatgatgctataatattcttgtacatctgtcactgcacatatatgcaagtacatttgtacaataaattccttgtagtataattatttataacaaaggtatgtgaattacatttttcatgcccattagtagcactgctttttaaaagactgtaccaatttagtctcccactgatacaacatcattgtggtgtttgcacctttaatgataatgattgttagggagatttgacaatgtaaatggtaaaaatttgtattatttgaattcatttaattatgaagtttagtgtgtgtgcttttttaatttggccatttgatccagttcatatttatttttccaagttttattaaatgatcagttatttagagcttaaaaaaccatatggaagtacccaagtaggtcatggcaggctgatgcttccattaaaacgactataaaatctcaatagattaccaaaaaattatattttttaaggcataagatacagctgtggaagcaacaaggtctgaatgaactaaaattcctgggggcaggtggtgaaggcaacccatcctgatgtaaggcagttttccctagggacctttgctgattctgaacctggactaaggattcaccttgacccagacaaaagaccacttctaggaaagagaaaccagcaaagctttaatggttatggagggatagggtaatacactggaaattgaggccctcaaatgcagaaccaatttttcctaaaggccatttgcaaattttggggctgcatgtgaggctgggaaggttgacccagagcttctaaagtacaaaatgaaatctctcagaacctgatggtatttggatagcatatacccaccagaggaacaggcttttatctagcataccacaggtctcccctttagcacatctgtgctcattttgaaactgtatagggaaggacattaggtggctgggagaactctgaaggacagacctggatctcctgccaccttccaaaggtgaaacaacaaaaatccgccaggctttcagtcagaagcccggaagggccactcccaaggaacagaggcaagagcagaagtagatggagtcttactgaaactgaaacccagctcaattcctaataggttgaagatatgattacctcaatgcagtctgcttatcagaaaggcatatcatatcatccggatggtttatatacaatgtttggcatacaacaaaagactgttagatatggaaggaagcaagaaaatgtgaccaaatcaagagaaaacaaaaccaaataaagaatatccagataattgagttagcaaatgagaaccttaaaataactgattaacaagtttaagatgataaaagaaaagagaacttcagttggaatctgcaaaaatggtgtaaaatgaatattctacaactggaaaatatctgaaattaagaacacaatagataggtttagctattcaggcagagcaggaaacagtattaggaactgaaagatcggttaaaaatacccaaactgatgcacaaagagaaaaaggaatgtgaaatatagataaaagtttgagacatttgagacatgttaaactgtgctaacacattaggaaaaagagaaagtgagacaaaaaggaagaggggaaggaggaggaggagaagagaaataggagcagaagaaatatttaaaatgatacttactcagaattttccaaaactgataaagtacattagccaacagattcaagaagctctctgactctaagctgaataaaaataaaaccactttagcaaaaaatctaactctaagctgaacaaaaataaaaccactcgtagcaaaaacaaacaacaaaaacttcaaagaagcaacagtataactgattactgctcagcaaaaaatgatgcaaaccaaaagacaataagaagaaatctttaaaatactgtaagaaaattactgttcacctagaattttatacccagttaatatatccttcaaaactgaatgcaaaatagagatgtattcagacaaaaaccaagaaaactttgcactagcagaccaaacatgcacagaatgagaaactaaaggaaattcttcaagtagaatgaaaataatgccaggtaaaacatgaaaatacaaaaggaaatgaacagtgacaaggataaatgaatactgagtttacaaacagtgaatgtaatgtcctgtggggtctgaattatacatagaatacaaatgcacaataacaatgcgaaaggcagaaagaggtaaattcatttaaaggttacacagttctagcagtactgaaaaggtggtaaaagtgatagtttgcataattgacttatagtctaataaatattgtgatctctagggttgctacaaatgaatgacagaagaatacataaatcacaagctaataaaagaataataatggatatttaatccaaaagagaacgagagagagagaagcagaaaggaacacagaatagatgggagaaatagaaaactaataaggttgttgatataaacccaagtatgtcagtaattatgttaagtgcaatttgaccaagattgtcagacttaaaaagattttaaaaagaacctagttctttactatttacaagagacacagtttaattacaagaacacagaatagttgaaagtaaaggatggaaaaatataccatgcaaatattaacccttcaaaataagctgacacagttacattaatatcaatgtatattttaagatgaaacagttcataatgataaggaggccaactcaacagtaatatatcataatctggaatctatatgtacttgataaaatagcttcaatctatatgtagcaaaaatggacagaaaaaatagacaaatacacactcatagttagaaaattccacacctatctcaatagctaataggacaagcaaccaaaaatcagtgagactaaagatctgagcaacaattaaacatatatacatatgagaccattgaatctattaggaccgatgacaggtatgttttttcaagtgcgcatgggctatttaccaaaattgaccctttgctgggctctaagctacaatacattgcaaaagattgaagttattcagagcataccttctagccacagtggaattaaactagatgtcagtaacgaaaagataactaaaaaattaacttctaggaaatttaaactctaaggtagtatatacattctctggatcaaaactgagaactaacttgatagaacaaagaataatttagaatagtttttatataggagggtcttagaatgaaaagttcataaaaaaactttacttatcttaataatgattatcattgtttgagtgcctgctaaatgctgttacctgctaggcgttttactcaatttatcccttatagcagcctgtgagataggttaggaggcagaaaaaaatgaccgataccatctgagttcctagggcatcccgtgtgtgatggggctggcaacagtcatcctggatgatgtaatctcttgcttcagggacagacactgtgaaatagcttactcaattatttcccttaatccttcctcaataataattactcaatctgttctgcttttatcctcattttacagatgaggaaactatagcttagaagggttagggacttgctagagctcactaatacgtggtgaaatcaggcttcggcactacccaatactgcctcaacaggggactttgtataagtgacccaatggcagttgggctctgaagactgaaaaagttgctctgctgttagatttatgcttttcagaatatgttcttaatgaaagtttcacctgacttgttatctagtctgaaatctaaagaggaactggtgtatggaaagttggtaaccagcacaagagaattaaaaggagttatttttactcagactcgagtatcactttaaacaagacgtgaaacaaaacaaattctcaggctcattaaggttaagtgatagaaaaggctgtgactgtctctgttggcttagttgttctagaacaacatcctgttgttctttagtattagcacaaaagataatttgggagacaaaatagagatgtgccacagaataagatcactagtgactctttgatttgtttatttcacaagaagcagcttaagcacctcagtatactttggtataagtcttctttagttacccataggtataatttatatcaaagcaaacgcaacttagaacttcagctccttgagaaatactcaataagagttggtttcctgaaagtcatacctaggtgtttgtggggagagagaaaggatagccacagagcaagcaatggctaagaatgttaatgtggccagcaatatttagctaacttgtttctcaaccttttctttcacaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacaccttagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggtaaaaaaaaaaaaattctgtttcctgtagtagttttagggagtcaacgaattattcaagaccccttcaaagaaccaaatatgtactgtctttaaggctgagtcctgggtctggttcattgatagagatccatccctcaaagtatgctaaggaatcttcccggattccctagagttgcagatctgctaaagcatctcaatagtgtcgtctaagtaattgaaaatacagagatcctttcaaatagttcgtattattacaaggctctataaacgataggttctcagtggcaccaagtaattgtgttttatctatagttttacccattatgaccgtattttcaaaatgattttatatatttcataattgttaccttgaagcctattttgccagcacctggatatttttaagaatttaaacattatggatgttatcgttaaagttcccttaaaacatttccccagcccatttttctccctctaaggcaattactgccctgaaactgatgtgcttacttcctgtctgttttcattcttatactccatgtttccataagtagtacataataatgtttcatatttttaaaataatttacagaaactgtgtatgtttcattacctcttagcactcagcattggttttgtggcttacattgattaatttagatttactatactaattttaattctttatgtggtttttttacttctttacaattttatgacttctcttggtctaaaatttctaggttgaacacgtccagtttttaatagggcaaggcaaagagaaataagcatcacttataaatttgttatagaactaactttattgacatatttccttctgtaaaaagtataagataatttaagacatttaaactgaacctgatgagtcaattataatatatcaatatttgggatcaaattttactcttaggtacaattaatttactctttcagggcacaatataaaaaaattgtagccaccacttactgagtatatactatagtgatatgttccgttcaccttctgtttgatgccactcgtctgtaccacaaccttgcaaagtatcttcagattgattttatagatgaggaattagaggcttagagattaattcatccagttcatatccagtgcacagtttaatcctgcactttttctgctgagtaatattgcttgttctaaatggcactcttgagtcaatgtgttcacctcgcttaggagagcagcttatttattgttataaatatgcttatctgaaagtaaatttatttttgcaatgccccatccgtagtcattgaaagatataaataataaggtgatatggcatttttgagttttgatatagtctgctaaaagggacttagtcgtcttatagtttcttgttagtaggattggatcagcaattatttactgtttaagttttcaaacatgtttcttgccctcaagtcctataaccaaatttaaatggcatttgttttggtaatcaataactctttatcataatttatatttacagtgttgattctgttgaacaggtatagacagtaatgtttacattctacttgattaagttaatgtgtaattgtttttataaatttataattatttcatttgtggaaatttgagttgctttcgagttttctagtgtagtttattgatagtatatgaaattgctagcaaatcaatgactttaacaaatttttgttgttaatcctttttttccccttcgtctgtaggtactacccgtcttctatctggtaagtttggctctcaggccattaaaagaaattgttttcactgtgggatatacaatccatattcctgggagataatattgtcttcttgtttttaaaaaaatgtatcctgcaatttatttttaaactttttagtatggaaaactttaaacgtcactcaaatagggaaaatagtacagtgaatcctcatatactcgctcggattcagcaattttcaactcatggatacccacttcacccacactccctggattatttggaagataatcccagacatcgtatcatttccttcataaacatttcactaagtaacctttataaaaacataaccatgtagcatacctaaaaaaatccagtaattccttaatatcagcaaatatttagtcaatatccaaacttccctgattatcttataattttttaattgatacataatgttttatatatttatgaggtacatgtgatattttgttacatgcatggactgtgtgattctcaagttggtatttggggtattcatcaccttgagtattatttttgtgtgttggaaacattttaggtcctttcttctagtgactatgaaaaatatatcacacattattgctaactatactcaccctactctgctattgaatattagaatgtaatccttctatctaattgtatgtttatacccatcggccaaagtctcttcatcctccctcctactcacacacttttctcagcctctggtatctaacattcttctctctacctccatgagaacttttttaggtctcacatgtgagtaagagcatgtgatatttgtcttttttgcttggcttatttcatttaatataatggcctctagttccattcatgttgctgcaaatgacataactttattctttttatggctgaatgtatttcattctatatatgctagatttgttttctttcttttcttttttttatttttattttttttttgagacaggttctcgtcctgtcacccaggctggtatgcggtggtgtgatcgtagctcactgcagtctcgaactcctgggttcaagcgatccttccacttcagcctcccaagtagctggtactacaggtgtgtgccacgacacccggctaagtttttgaaatttattttttgtagagacaggattttcctatgttgcccaggctggtttcaaactcctggccgtaagcgatttttccggcctcccaaaacgttgcgattataagtgtgagccactgcacctggccccacattttctttatccatttgtacattgatggacacttaagatgattccatatctttgctattgtgaatagtgcttcaataaatatgtgaatgcacatatctttttgatatattggttttattttcctttggataaatacccagtagtgggattgctggatcctaagatagttatatttttttatgttttcaggaacctccatattgttttccacagtggttgtactaatttacattctcaccaacagtatataagatttcccttttcttcacgtcctcaccagcgtctgttattttttgtctaaaaatggccattctaactgaggttaagaactgatagctcattgtggagcttgatttgcatttccatgatgattagtgatgagcagtttttcatatacctgctgagaaatgtctgttcatgtcttttgcccactttttagtgtgattatttgtttttcgctagtaagttgagttcgttgtatattctggatattagtacctttacagatgaatagtttatagatattttcttccatttagcaggttgtctcttcactctgttgattgtttcctttgctgtacacaagctttttagtttaatatagtcctatttatctatttttgtttttattgtctatgcttttgaggttttagccattaaacctttgcctagactaatgtcctgtagcatcttcctgatgttttcttctagtatttttatagttgtggatcttatgtttaagtttttaatcatctcgatttgatttttgtacatggtgaggggcagaggtccagtttcattcttctgtattttcccagcactatttattgaagaaggtatccattttccaatgtatgttcttggcacctttgtaaaaaaatcagttagctataaatatgtggatttatttctgggttctctattctgttccattattctgtgtgcctgtttttataccaataccatgctgtttttggttactataaccttatattttgaagtcaggtagcgtgatgctgccagctttgtttttgctcgggttgtgttagctctttggactcttttggttccacaatcattttaggacttttttttttctatttctgtgaaaaatggcattgatatcttgataggggttgtactgaatctttagattgctttggcagtgtagtcattttaacaataatagctcttccagtccgtgagcatgggatgtctttccctttgtgccctcttcgatttcttttatctatgttttgtagttttccttgtaggggtctttcacctccttagttaaatctgttcctaggtattttatttatttttttagttattgtcaatggaattgccttcttgatttctttctcagtttgttcattattgtatagaaatgttattgatttttgtatgttgatcttgtttcctgcaactgtactgaatttatcagatctaagagtttttggtgaagtctttaaggatttttttttacatataaaatcgtatcattaaaaaagagggacaatttgacttcctctattccagtttggatgccttttatttctttcttttgcctggctgcaagttaataaatgaaaacttggttctctatgagccaaatgaaacttggttcttcaatgaaatggaaactagggcttacagcattatgttgaatagaagtggtgaaagtagacatccttctcttgatccagttcttagaagaaaggctttcagcttttcctcattcaacagaatattagctgtgggtttgtcatgtatgacctttatgatgttaatatgcttcttctatgcctagtttgttgagagttttattgatttctatgtgttgaatcatccttgcatccctggtcgaaatcccacttggtcttggcatactaattttttgatgtggtgttggatttggtttgctaatactttgctgagaatttttgtgtctatattcatcaagagtattggcctgtgattttgttgttcttgttgtgttcttgtctggttttggtatcagggtaatgctggccttatagaatgagttagggaaagtttcctcctcttcaattttttggaattgtttcaggagaattggtattagttctcttttgtatgtttggtagcatttggctttgaatccatccagtcctgggcttttctttgtcaggagactttttattacaattcagtcttactactcattattggtctgttcagattttctgtttcttcctgactcagtcttgatagggagcatgtctccaagaatttattcatttcctctaggttttccagtttgtcaatgtataggtgtttataatagtctctgatattttgtatttctgtggtatcagttgtaatgtctcttttttcatttctgattttatttggggcttctctctttttttcttggttagtctagcaagtactttatcagtttggtttatcttttcaaaaaaacaagttttcactttattgttttttagtctctattttgtttagctctgctctgatttttcttacttctttccttctgctaattttggggttggtttgttcttccttctctagttccttaagatgcattgttagattgtttatttgaaatctttctacttttttgatgtaatcatttattgctgtaaacttccctgttagcactgcttttgctatgtctgataagttttgctacactgttgccatttctattttttcaagaaattttttgtctaatcctgaatttctcccttgacctaatggtcattcagaagcatgttgtttaattttcatttatttgtacggtttccaaagttcctgttgttattaatttctagtttaattccattatggtttgagaagatacttgatacaattttgactttttcaaatttattgagacttgtttggtatcctaacatatgttctattctggagattgtttcatgtgccattgagaaaattctgtagctattgggtgaactcttctgttagtgtctgttaggtccatttggtctaatgtgcaatttaaatccaatgtttctttgtgaattttttgtccagatgagctaatgctgacagtgggatgttgaagttcttaacaattattgtattggagtctatccctttagattggacaatatttgctttatatgtttgggtactccaggattgggtgcatacatacttagaattgttatatcctcttgctgaattgatctctttgtcaattatataatgacctcctttgtctctttttactgttttttacctaaagtctgtttcatctgatataagtacagctactcctgtttgtttttggtttgtgttagcatggagtatctttttccatctctttactttcagtcacaatgtgttttcacagatgagatgaatttcttgaaagaaacgtatagttgggttgtgtttttgcatccattcagccagtatacatcttttaagaggaaagtttaatctgtttacattcagggttattgatatgtgaggaattattcctgtcatcttattaattgatttctggttgttttgttccttttgttctctcttattattgtgatgtagagtttttctttcataacattttagtcttttctcttctttgtgtgtttgctctaccagtggtttttaaaatttctgtgtgttttcatgattgtagatatcattctttctcttctgggtatagcactcccttaagcatttcttgtaagccatctcatggtgatgaattccatcatggtgattaattccatcagctttcttttgtctgggaaagacattgtttctccttcatttatgaaggataactttcctaatccttggttggtagtctttttctttcagcgctttgagtatatcatcccgttctctcctggcctgtaaggtttctgctgagaaatccattgttagtctgatgggtttcctttataagtgactagatgcttttcccttgctgtttttagaactctctctgtctttgacttttgacagtttgagtatagtttgtcatggagaaaacctttttttttttttggttttgagacagagtctcattctgtcactcagcctggagtacagtggcgcaatctcagctcactgcagcctctgcctcccaagttcaagcgattctcccacctcagcctcctgagtagtagctgggattacaggtgtgtgttaccacacccatctaatttttgtatttttaatagagacagggtttcaccatgttggccagtctggtctcgaactcctgacctcaggtgatccacctgcctcggcctcccaaagtgctgggattacaggcatgagccaccgcaccgggccagagaagacctttttaaattgtatctacttggtgatctctgagcctcctgtgtcaggatgtctacatttcttgttagacttgagaaattttcctctgttgttttagtaatagattttctaatcctttcactttctcttcaccttctgagactcctaaaatttgaatagttggccactttagggtgtcccatatgtcatgtaaactttgcccatttttttattcttttttccttattcttatctgactgtgttatctcaaaagacctgtcttcaagttctgagattctttcttctgcttgatctagcctattattgatgctttcaagtatattatgtatttaatatttcatcaagtatattatgtatttcatcaataaattatttccagaagttgtttggttcttttatatgtatctttttttgataaacatctcattaatatcctgaattgtttttctgatttctttgtatttttttaaaacaaattttaaagtttgtatctcacctccctgagcttttttaatatcacaactttgaattcttttcccagaattttgtaagtttacttttgattgggatctgttgctggagaattattgtgttcctttggtggtatcatattttcttgttttttcacgtttcctgcatcctgaagttgatatctgtgcatctgatgtgatatttgctgtttctaatttttcaaatttgcttttgtaggggaggacttttcctgaagatgtatttatggtgtcagttaggtggggcactttggctttaattctgggtgcatgcagtagtgtagtttctgtatgactttcagctgtaaatatcatcagtggtatctgtcatttcctcagtgctttaggatgcggttactagtggagatttgctagggaataggatgccatgtgggccaatgttcggacccaagtgttggcagtggtgggctgagtttgcctgtccttgggcccagggtgatgttgctggcaccagtgttagcaagcccaatcaggccagttattgggtctccaggtggctcacttgggtgccagaaatggcgggtgacctggttctcaggctacttggcagcaagtgggggcatgggtgatggcagtagtagtggtgggacaaccctgtgggacacaagcagtctgtgccagtgttggctgtgggtgcggtgattgggtggatcagtttccaggtctgcaggtggcttaccagctgtgatgttagtggcaggttgagtgggcctgacttcagacaccaggaagagtgctcagctgctattggtggtggactggctgagcatccgggtacctgatggcaggcttgtgtactgagagggtgacgctgggccagatggacttgtcctcaggcctccctgtggtgcatgtgagtgctggctgtggtaggaagaggtagagtattcctaggctactggtggaatgcttaggtgaggacagtgtggctgtgctgtggaccagctacttgggacagcagtgttgttttcagttgggagcagccacagagaggtggctggggcacatgcagtttgctcatgcctcagcccaaagcagccagcagcagccatagccgcatgcactggaatttgtcctcagggaaccagaaaatgcctggctgctcctctattgggggtgtcaggtcgctgccagtggctcctgctttggcttaggcaacagtggccacagagcaagatgcagtctgggaggggctgggctctcaaaatagtcttgtgctgtggctgcttaggactcagtggtttatagtactcagtgtgaacttactctctggagtaatgccatcacactgtctccaggcagcttcctatgttagatctagagcctacgagaatcaagggactcctgtagctaggattgtgggagtcttcagagggaatgtggactgctggggttctctcacttactcttttcctgcattagggagtctctccaggcttccaggcaatctcagccaaacaggctgccttgcttctgtctccttccttgctttggtgcatcctgtcacttgtttgttaaattctagtgttctctctttgatgatctcttcaaaatgtgattatgtaattcctgcttaggtttctctccatggaagaggagaagaccagaggcatctagtcagacatcttgaagccactccccatgatactgtcttaggaaaacaatcaacatgtagcattcatggataccaaagggaaaatgggtaaacacatttttttttttttagacggaatctcgctctgtcacccaggctggagtgcagtggcgtgatctcggctcactgcaagctctgcctcccgggttcacgccattctcctgcctcagcctcccaagtagctgggactataggcgcctgccaccacacccggctaattttttgtatttttcagtagagacggtgtttcaccgtgttatccaggatggtcttgatctcctggcctcgagatctgcctgcctcggcctcccaaagtgctgggattacaggcgtgagccaccgcacctggccaggtaaacacattttttttcttccaccttttattttaggtttgggaggtacaggtgaaggtttgttacatgggtaaattgtgtgtcattagggttgagtgtacataatatttcatcacccaggtagtgagcttagtacccaataggtagtttattgattctcaccctcctcccaccttccattctcaaataagccctggtggccattgttcccttctttgcatccatgtgtactcattgtttagttcccacttataggtgagaagatgcagtatttggttttctgttcctgcattaattcacttaggataatggtttccagctgcatccatattactgcaaaggacatgatttcattcctttctatgtttgtgtaatatcccgtggtgtatatataccacattttctttatccagttcaccactgatgtgcatctaggttgattccatgttattgtgaaaagtgctgatgaacatatgtgtgcatatgtctttatggtagaatgatttttgttggtttgggtatatacccaataatgagattgctaggtcacatggtggttctaagttctttgagaaatctccaaactgctttccacagaggctgaactaattacattcccaccagcaatgtataagtgttctctgttttccacaaccttaccaacatttgttattttttcactttttaataatagccattctgtctgctatgagatggtatctcattgtggttttgattgcatttctctaatgattagtgatgttgagcatttttttcatatgcttgttggcctcatgtatgtcttcttttgagaagtgtctgtttatgtcctttgcccattttttaagggttggtttgatttttgtttgttgatttgtttaagttccttagagattttgaatattagaactttgttagatgcatagtttgcaaatattttctccttttctgtaggttgtctgttttctctgttgatatatatttttttgccatgcagaagcactttagtttaattatgtcccacttgtcaatttttgtttttgttgcaattgcttttggagacctcatcatgaaatatttaccaacacctatgtcagaatggtatttcctaggttttcttctagagtttttatacttttaggttttaagtttaattctttaatccatattgagttgatttttgtatatggtgaaaggtaggggtccattttcaatcttctgcatatggctagccagttatagcatttattgaatagagaatccattccccattgcttgttattgtcgacttcattgaagatcagatggttgtaggggtgtggctttatatctgggttttctaacctcttccattggtctatgtgtctatttttgtaccagtaccatgctgttttggttactgtagccttgtaatatagtttgaaatcaggtagtgtgatgcttccagctttgttctttttacttacggttgttttggctatttgggttcttttttgattccatatgaattttagaatgtatattttttaattctctgaaagatatcattggtagtttgataggaatagcattggatctataaattgctttaggcagtatggccctttttaaaaattttgtattaattttttttttttttgagacagagtctcactctgtcactcaggctggagtgcagtggcatgatcttggttcactgcaacctccgtctcctgggttcaagtgattctcttgcctcagcctcccaagtagctacgattacaggtgcacaccaccacacccagctaatttttgtatttctagtagagatgaggtttcaccatgttggccaagctagtctcaaactcctgacctcaagtgatccacctgcctcagccttgcaaagtgctgggattacaggcatgagccaccatgcccgcagtatggcccttttaaaaatatttattcttcctatgcatgagcatggaatatttttccatttgtttgtattgtctctgtcttctttgttttgtatttctctatagagatcattcacctccctggttagctgtattcataggtattttatccttttgtggctattgtgaataggattgcattcttgatttggctgtcagcttgacattgttggtgtatagaaatgcttctgatttttgtaccccgaagctttactgatgttgtttaacagttctaaaagcttttgggcagactatggagtattctaggtttaaactcatatcatctgtgaagagagatagtttacttcctctcttcctatatggatgccttttatttccttgcctgattgctgtggctaggatttccagtaccatgttgaataggaatgataataatggacatccttgtcttgtactggttttcaaggtgaatgcttccagcttttgctcattcagtatgatgttggctgtgggtttttcctggcggctcttattattttgtggtatgttcctttgatgcctagtttgttgatgacttttaacatgaagggatgttgaatgttgtcaaaagccttttctacaacaattgagatgatcatgtggtttttttgtttgtagttctgtttatgtgatgaatcacatttattgatttggatatgttgagccaaccttgcatcccaggaataaagcctacttgatcgtggtaagttaggtatttgatgtgctgctggatttgatctgctagtattttgttgaggatttttgcatttactttcatcagggatgttggcctgaagttttctttttttgtcctgtctctttgccagattttggtatcagtgtgatgctggccttatagaatgaggagtccctcctccttgatttttggcatagtttcagtatgattggtaccggctcttgtttgtatgtttggtggaatttgtctgtgaatccatctggtacagggctctttctggttggtaggttttttaaattactgattcaatttaagaacttgttattggtctgttcaggtatttaatttcttcctggttcaatcttaggaggttgtatttttccaagaatttaccatttcttctacgttttctagtttatgtacatagaggtgttcaaaatagtctctgagggtgttttgtatttctgtggggttggtggtaatgtcccctttgtcatctgagattgtgtttatttggatgttctctctctttattaatctagctagttgtctatcaatcttatttattctttcaaaaaaccagctttggttttgttgatcttttgtatggatttttgcatctcaattttattcagttcagctctgattttggttattttttttcttctgctagcttttgggttggtttgctcttgttttttctacatcctctagaggtgatgttactttgttaatttgagatttttctaacattttgatgtaggtgtttaatgctacaaactttcctcttgacattgttctggctgtgtcccagacactctggtatgttgtatctttgttttcactagtttcaaagaatttcttgatttctgccttaattttcagaatgccaaaagtcattcaggattaggttgtttaatttccatgttattgtatagttttaagagatcttcctggtattgatttatattttatgctgtggcctaagagtatggttagtatgattttggttttttgaatttgtttaaaattgctttatggttgagcatgtggtcaatcttagagtatgtgctatgtgcagatgagaagaatgtatatcctgttgttcttgggtgtaatgttatgtagatgtctgttaagtccatttggtcaagtgtcaagtttaggtcatgaatatctttgttagttttctgccttgattatgtgtctaacattgtcaatggggtgttgaagtctcccactatattgtgtggttatttccatctcttcataggtctttaagaacttgtcttatgaatctggatgatccagtgttggatctgaaaagagtaataaaaacattatcattactatcattattatttattgtggttattttatattttgaatgaacttctaagctaaaagatttatcttgaaagattccaactgttggaattcactttgttttaaatagaaataaatgtgtttcaaatgaaagtctgatgatttaatgatcacaaaagtgatgagtttaataaatgagttttttctcacctgctcaatggcactcaatgaaggtttgaaatgcctttttttcctgaaattctttaagtattataccctttgattttctagaaaactttccttagtcggcattccagcttgtgttaaaaaataaagaggaagtccttccttcttaaactggacatatggcaacattttttgtgtgtgatttcatatttgtaggacataaacctgaaaattatattcattaaatttattatgtgaatgaggttactcttctttaaagataaattaactctactgcaagaaaattgtttcatcaattacactgcaatgtaagtaaaatgatacagatgatctttgaattttggaagtatttgatttttttttcctattctgctaaggaagaaagactgactaatgttacagaactttctaatttgccttgtaaatgaagcatgtgttgtgaattttaaatcttttcttccgttggctttgtataagtgtttcccaatttttttttgtggggggtggggggtgcgttaattcttgctctcttctcaccaaagacctttttagacatttttttttgatcatcctccaccacacatatactgtaaatcagtttatgtatcacatatatatctgcactctgtacttaaaaaaggaaaatttttttttaactttcatcaggtatcacccccattgagaatgcttgctttctgttggttttgtttttattgtttttaaagacaaaatcatatagaagaaagagcttaacctctggagtcaaaccagtcggatgttggtttgaatcctgtttttttcacttagtaattattcaacccaagtgattaagtgattaacttaatctctctgagactcagttttctcatttaagagatagagattgtgattcctatgtgaagtatttgaagcttaatgtgattagtgggtatgaaaactccaagcacagtcctaaaagttgaataaatattagcttaaggaagtcactgcatgcaatcactattattttcctaagctggatttctgataatttcatcactccctctggccacaccaaagaataagaacagtcttttattcaggtaatatttacatgttttctctgtggcaagtactgtactgattttttttaatgtattatttcatattcttctcacaacaatcttataatgtagcatttttatcccattttcagctaagataactgtggttttgcaaaatttgtaacttgcctttcacagagctagtaggcaataaatagaggccgatgactagtttctctattaccaggtttttttttttttttttttttttttggatgggggacagggtctcactctgtcacccaggctggtgtgcagtggtgcaatctcggctcacggcaacctctgtttcccaggctcaagtgatcttcccaggtactttaaaagatagaaagatgctcatcctagtgacagaccaagagacaatacaacccaaattggacaattaaggtgccgtgattccctacaagtattgctttattcccctctgttgccaaagtcctatactgagacattcataagtccctcatggggactaatagatcaatttaaagaataataaataagaagtcaggaaatattcagtgaaatatagaaaatattttttctgtatcccctaacaattgtgtacttatttatcctttaaacttgaatatggcatatattacagactagcccaaatctaaatgtactttcaagagtcttgactcttaagtagctatttgaagttaataagatgtggttacaggggtctttatgtcttattacatgcccctatacatgacaaacttaagtcccattataaagtgacatcagttatctgcctgttattcaggtttaagtcagataatataatcatataatctttctgtgatacgtttagtctggaaaaggaagtatgtgaatttcccttattaaaaaaattgaagaaatacagaggtacagaaaatccaacgatgatggcaagacacttaaagggtcctgtggatgtctctctgaggaagcagagttgaatctgcatttacaaaatggaaaatttaagggttactcaagcatactgtttttcaaatcatctacgaaaatctcttcccagggtgccttcacttgtccacaggccctttattctgttacattaagtatgatataagcaagaacaaaacctttccataactttttgttttcatagcacatgcattgcatttccactttgttagctctgcaagttagaccttttgaagtgtctgggtcatcccacatttcttcaaaaaagatgatgtgcatcctctaggtcactccagttcttggaggtaggtagatagaattctaagttgggttctttggcagtgaagatgataccctatatattaatgtagtatctgtctaatgtaaattttgtttgatgaatatcaggtattttattgaaaatatttcaaacagttaaaattatggcctgaatctggggctagaagtgagtttttctatggcaataaactgacttaccctttcttggtctcagttttcttatctggaaacaagatattaagtgcaatttaataaatatttgttaaacactttctactgtttgccatgtactgtgttaataatgagaggtgatcaaatgagataataggtggcaaactgctttgcaatgttttcaacactgcaatacagttctacatgatggggaaccttactaaaatactccttttgtgggggagaaaacctttttctaacattatgttattttcccacctaagagctcttcagtttaatcttaggaacattggaatcataattattatttcattcattatttcatactttcatttttcccaagttgtataaatcttaatgttgattcacctttggttttctgtagataccaagtgaattttgagatcataaacagttgcctttgaacctgaaagttttgtttctaatttgggagataatatgctcttattaatttactgagaagatacgtagaattttgtttttcatatttctgtgttttgccttggttttctgttaaaccatcagcctctacactttcttctagaactatgtatatgtgttgagcattgttctgggaatagccttttacttctgtcatctggatgttctagatcactctgaattttctgtcttgatttagtattcaaataaaaaataagatattgaaagtggtggaattagtgggaactggtgacagaaagggggaaacccaaaattttttaggagctgtgatttatttcatggatagtctctctaagttaatgatacaattctaggggatcagttaaataaacttctaaagtaaaatactgtaaaaacttacctgtggtagaaatagctgttttttaaatcacaattttcacatggcagtgcaattgtacagtgtctctattttgctgatttggagccaaatacactcattagtcacgttagattcagttactattctagtgtcatctgtcatttcctttgtagtaaagaccaatagagttgagtccaaggacactgggcagggttggtgggggtggtggtgggaggggggctgttggtgaggaaagagagaatgaggatggtgagagaaaagggcaaatgggtgcatttgagaagaaagattgtgtaagctataaaaatgatttgatgttgatcaacttatttgaccaattatttgctgttgttcagctcaaaatagtgctttgaatcttaaaagtgaatataatttttgaaatgaaatttaatctaccatagactgaacactaaaaagcatattctgtaggcaaagtaaatatagtttgccctccaatctcagatgataatagtacaggcatatttcctgtgatggagaaatgtctacatatctgttatatctactgtaaactaggtaaatgtccttcccattaaccacatatgttaatgttcaacttccttctgagactcaatttactcatctaaaaaatgaaagtgaactctaagatgctttctagctctaaaataacataattctgtcaccatatttgaatgctcaacgatcaaaacatttaaaatcgagcatgattgggttgaaacacttaagaagcctctcaaacctgtcaaaaaattttatttgagcattgtgatattctaaatatatttcttcctttttctttcgaagaaaacaggacaaataaaacatgcatttgtcaaaaatttgtgacataaggaagccatatacaaaatgcaattaatatctcctatttgtaactcacttcataaccagtatgtatgtcattgtgaaactataatgtaattttaattgctcatgtttctattaactgtgttaccatatcttttccccttcaaggatttcttgctggtactctattaattggtaccctaattctagtcattggactatggaaaatcagagtgagcagaaattctgatgatttttaaaaatttattcctagtttatttccagtaaaatttggtactgtatcagtagatgactctcttagctttatttaaattttggcgtgtctctgtattcatttttgtctgtaattactatcctggattaacagacttcatgtctgttttttctcaatatattcaaaggcgcatttcaaagcaaagtgacttgaagtctcattttgtgatctattaatccactgatttttttccactcagtgtaatttatgatagtatctagtgttgcacagaagcaaagaaatctaggaaaaatcaacctctaacatactgtgaaattgcctgtgattagggctttttctcacttatattaatagatgccagtccagctcaaaacagcacagtggttaaggcagcagacaaatgggggaaatatagtacctacctcatatgattataatcatatatcaaatgagttgccacctgtcaagtgcttagaacattgcttggcacatagtaagcactcagatattaaaacaacaacagcacacacacacatcagtattatttaaaatatctaatctgcattgaatatacataatgttaagtataaatgtcacgattggctctgatgtgtcctgtagacagatgatgatttaaatcgaccctcttctgttttgtagttttaactgttcagaaaactagttgtggaatttatacaaacttgagttatttctaagctgccctaatgcctgtccgtttttcccattaataagaaaactattaatttaatgctgttattaaattgtctgttttaattctttagatgatgtgacctatctcctttttaccctctacaatttttctacttaaattaagaatattacttaagcctattataagttaaagcatgtaaatattctttaactcactaaatgagtcagtcttgtagaaaaatatttgaccattaggtccaggggagtgattaataatttttacaggcatttgtttaatatcaacaaaatattctagctgtcatgatagcaaatatagtaagacataactttttctccagatatatcagaaacgttttaggaatgtgatttagagcctagcaaaaactcacagttagtactaagtcatctaaagtgagttggtatggaagcatcagcaaagctactctgaaaaaaaataaaaccaccaatcttacgtactttcttgtacttgttccaactttccttttgaaatactgttatcagtttatcaagttataaagtatcaatgtatagagtattatcaatttaccaaagctactgctttgagactccctggatcggtgggaatggagactgggcgggggagggcggagggcgggcgggggcagggcagcaagatgtgataagtttaccaggtgctgtctcttggctttcatcagtttctttacatactttggtaaggtgattggctgtgatacttgtatgtcctattaaggacataaagtactggaacatcgaaggagggaatacagtaatttctgcttatcctcggttggggggcagggtgtttcaagaacccccagtgaatgcttgaaacaacagatagtgcctaaccctatatatgctgtgttttttcctgtatgtacatacctatgagataaagtttaatttataaatgaggcacagtaagagattaacaccaacgaataatcaattagaacaatttattgtagcaaaagttatgtgaatggggtctctctctctctcaaaatatcttattgtattgtactcacctattttcagattgcagttgactgtgggtaactgaaaccacagataagcagactaatgtatttgttttgaattgtattttggggttttgcagtgaacttaattgcttattttctgaattagagggaaagtcatgcaaactcctaagaaagaatttgtcttttttatgtgcacataaaaaacactccacttgctttattttggaaacataagctgttgagggtaagagctagctttatatatgtttggctagcctcctgatttcatactgatttaattaaatatttgatcttaattaagacaggatatagttaatgtgcaagtgataatgtggtttcatttaatgattcttcatgtttgcctatcagaggattgatttatttcttttagaagagttaggtctgtatgataaattttagtttagggatggaagtgtaagcagatgcctgacttcgttttttgattgaaatgacagttacataattcaattcaatagtttttttcttctctactattcagctcttataatgcacatgagagcaacaaagtactcaatgttgtgtttgaccatttaagtgtgactggtggtacctcagaaataagactttctggtaaattataaaaggtatatatggtttaataaaattacatttctgtatcttgcaaaatatccattaatacccttggctagggggttcttcatgacttttaaaggataatagaggcttaagtctctgtcactagagttgtttttttctttgttgaatgactaatacattgaatctctcattactatgacatatcgtcagttctggacttggtagcagtaatgcttatcatctcatcctacattttgaactcagtttattgtaacgattagatgctataatgccacaaatattcggggggaaagggatgatacattaggacttttaaagagaatgccttcattatgataatttgcatcatgagatggttgacctaccttgtatttctccttttgcttggtggcttttagagttttcaatgtttaagaaaaattataatatgtgctaagatatccttttataggtcatgtttatagatcttaaaagacatctcatatctttatacaaaattatcacacaaaaataacttggtgtaaatgtatctgtaaaactttctgagtgtcttcatctcttaatcttctcttccacatgtagtagtattcaggggtttttatttatttttatatttttttaacatctcccacacttaggaattcattgacttttaatctgaaggtaccttaattcattctagcttagccactgttcaactcgagaaactaaaaactccacgtcacattttagttgttgctgtagctgataaaccccacctgtagaatcttgtccatattctattactcattattttttttgttttgcaccccaaattaactgattctttttggtgatttatcacatagtaactaaaaatttatatttatcactagtaaataaaatcattttgattttaacttttttttttttttttttttaattttcagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaaccacagttatcacaactagcagttgtgatagtttctaatttcctaatagtttctaatattaggaaattctttgaactttcctagaagttctaagagtaggcacatatccatccacctattcattcattcatttgttaaatatgagggcccgctctgcctattctgtaataacccagtgcttccagggatagcaataacactggctcagctattcagaaaaaaagctgagtgcctactatgtgcaagttgtcatatgctaaaatgtgagcttaccaagataactgcaagtgtctgccctcaagttgcttatagtttgccacaggaagaccaaaatatatacttattgagagaaagaagataaagttacgagtgttacagccccgaatatggtgggtgcttaagctgtttgttaagcagttgagtggcagggagggagatattcaaggcagaaagctgattgagaaagcagtaatagatgagattatagtggcaggatggtcgaagtaggaaaggcttagagcaagggctagactatgtcatgtgttctgtgtagaagtgaaaatttgtaagctctagactttttattctgctcgatctaattagaatcagtgagcataaaataggtttctaatagcaagaacttgctatttagataagggtaaaagcggaaatactattaaacagtcatttaccttgaagaaaatataaacagtaggcttgtgagggtaaagatattttcttgtaggatttatatttaccgtgtatcctgtagttatgaggttgagtggttttatttttgcttaagataacctctcctgtgagattttactttgattgcaaaggttgtattgcttttcctcttgagactgatgtatttgttacagcaagttatacctgctcactgtagaaatttgagttttataatatttagccccctatcactgtcacttttctgggaatacttgaacatgaataatttttgtcttgtcacaccctagccctgtttgctttggttaatgtccaatgtgcaaatgcctcattttcctcccacccatcctgagtgttttcttcctccttaccgaaactaaaaacagccccttccctgaaggtactgcttcctttgcagcctattccagtggtggctggtttattttcatccatatgactcattgttaagaggtggcggaggtgttttccttgttcctttgtcatgtcttccatctcaacccccacacacatctctttaaaaagagtaactgtccattcactctggtagggtaatttactaaaatgtcaaatgtttttcctataattctccttggtgaaaagcatggattctggagacaaatcggagccctggcatttatcagctgcaggactcaagggatgttccttgtcagtgtaccttagttatctatgtgtaaagtgggcctaaaatcagtaccagcctcataggatttgcaatgagaattaagttaatacacgtagagcttaaaatagtgccagccatgtagtaagtgctcagtaagttttagctctttttagtgcacaggtggagagattgccttaggtggaagcatgcagggcttcagtacatactaggagggaactgttgcaggtgggttggagatgcccatggtggcagcttttggaaattgatttcacatttcttctgttttctcagggacatatacatcaaggtcatcataaaaatgatgacacatgaggaggtgttatgtttgaagacaggcagagaaggaaaggactagagacatttagtcaattagcaggcaatgctaaagacccagttgaggtgagtgctcatgaatttagagtgcaatcatcaagcttcgttctgagtttttctgcagtcatatttagctttctagatacagtctcagaaaaaaccagttgcttggatttaatcatgattgggtgttcccaggtgaatttgatgacgtgagttgagcatgtgcacaagggagtgattaaaatgatggaccatagaatttaagctatgtgagaagggaagtgaagacatatgagtggtaagaaacaatgagtaacaggatcaatattttgtagaccttaatggggtcatgtcattgttagacttggggtactatttaggatgaactagaatggtaatatgcagtagtgagaaataagaatgcgtcaattgagggtaaaacagaattggcaaccagaggacaaagctgtctacaaatacacttccccttcattttgggcacaaagttagacacatttcctggcactcttgcagttaagtgtagacataggactgagttctggccaaaggaacgtgatcagagatgtgtagcatttctgggtctggccctaaaacatccccatatgtgatcctccttgcctccttccctacactgagttgatgaaagtgactgtagtaacctagtaagtcatgtgctaaagataacagaaccacagaaaggaaggagcttgagtcattgctttgaggagagctgtctgctgatcaagaacacccactttagatttcatgtgaagaagaaataaacttctgtaatgtttgagttctaacattttggggattggtgtgttacgttattgtggttgacattatctaaactaacactgaagccttctagattttggtgatacaagggtttaaacagaactatggttgtgagaagttgagataaaatggtggacaaaagtattggtgcggaggaggccatggaacatcttaattgatactgaaatcaccaagaagcatggggattcatgttagagagtgatactgagtcaggggctaaaatcttcacgaaatgagtggtttgtacatctgaagatgattgcaaacaagaagatagcaggtgctatattctgatgatacgtgactcgaaggaaagggttttgtggaaaggaaggaggactggtctgcaaatagcaatgatgaataaaatagggcaccaacttcacctctatgcctggtactatgtggaatgaaagtgcaatgagatatttttgcctatcagagatttgtttgcacattcaaacccactgtatgatcctcttccaccccttgttattgcaatccccctactttctggtcacccacccctgtctgttgagggatttggaactggctcactgtctcccaaccatcctacaatctggtattatccataattatttcacattgacaaggatgactccttataacatctgtgcctctggttttattgaccttttgatttctaatgacctccttcactctacctgagtcactcatctccatggaaccttcttaaatcactaattcaggcatattttcttgctcaatataatcttttccgctttctagtttagttactgcagtatgttcatcaactctccactttcttcctatttataagtctcctactgtgatggatattttctgtttgttcatccaggaccactctctagcacactccaacttgctgtgacctcagaggctgacctataatggaagctgtggaggggagagctgcattccttctaatttttgttttgtctcaaaacactccacaacttcttattttatttcactttttttttctaccatcctatcaccaaaggatggctccccttccttttgaccttttcctcttttaggaactacacctttcaaaggctatcaactcagatcacattatgtttatggccctttcctgaaggtagtgcttgtagttagtgctctggtctacaaggacaccttttcagcattttcatttttacggcagactcttactttctggcaatggttttggagcaatttgaggactttgctagctcagcttttttcactttcattgaagtctttccacagactgcccttgctcaccacagaggcttctaggagcagtgtgaaggactcctgggttgtttttgttttgtttgttttcttataggcaatttgaagtaggtgctttgtcttctagttatgttgagaatgtggttttcatgtgaccagacttcctattggtgtggctgtggaaaatcagatgtttttatatattattggtgggaatgcaaactgatacggccattttataggggaattttccaatatctaaaaaaaaccccacacatacgcatttaccctttgatccaccagtctcacatctagaaatgaactctgaagatatacctccaataatatgaaaatatacagtacaaggatattcaccaaaacattgtttgtcattgcaaaagactggaaaccacctaaatgctcatatgtaggacttgctcaataagctatgttatatccaaacagtggagcattatgcagctctgaaaaaagaatgaggaatatctgtatgaactattatgaagtatttctaggatatattattaagtgaaaaaagtaaatacaaaagactggtatgctacttttcatgtgaaaaagaagaaataaaaaatacacatcctcgtttgtacaaaaagaaacataggaaggataaactagaaacaatgagatagttatatacaaggtataggtggaaatgatggagaagatgggaattccttctaatttttgttttgtctcaaaaattttagaataattgtctcacatattaaaaagccaagtaaatataagcaatgaaaatagggagagaggggagagaaaaaaactcaacagaatacaaacacaacaaatgaacctttatatatatatatatatatttttttttttttttttgagatggagtctcactctgtcgtccaggctggagtgcagtggtgcaacccccatctcggctcactgcaacccccatctcccaggctcaagcaagtcttctgcctcatcctcccaagtagctgggattacaggcatgtgccaccatgcccaggtaatttttatatttttagtagagatggggtttcgccatgttggccaggctggtcttgaactcctgacctcaagtgttcggcctctcaaagtgttgggtttacaggcgtgagccaccacaccccaccccttactgtatttcaaatgaataacgaccacagttaagagggagctgtgaggtagaattgaattaacctcggaacacagtattttgattatacaaacaaagggctaaagacaagaatatgaacaaatgttggattttgtctagtgggtttgtttttcatagtagtatgggttagcagtttcaacactgcattctaagatggggtaggtaagcaaatatattgcaaataatgagtcaggattctcactgttgaagggaattacaaataagggaacactagcatggagcctgtggtatttgtaatttgagttatcagtataaactcatgatttggaacataactgatacacagagaaacgtgtatacacacacatgcatgtgcatatctgtattaggttctccagagaaacagaatcattaagatatatatagatatatgaaaagatttactgtgggaatttgctcatgcaattatagaaacctagaagtcccataatatgccatcttcaagctggaatcccaggaaagcaggtggtgtaattctgagattgaagtcttgagaaccgggggagtcaatggtgtaactcccaatctagggcttaaggcccaaggaccagggctgctggtgtgcagatgcaaatcctggagttcaaaggattgagaaccaggagctctggtgtctgagggcagtagaagatggatgttccagctcaagaagggaaagtaagaatccgtccttcctccacttttttgttctattcagatgagccctcaatggactgaacgatgctcacccacactgtgagggctggtcttctttattcaatccactgacttaagtgctgatctcttctggaaacaccttcacagacacacccagaaataatgttctaccagccatgggcctgttacttagcccagtcaagttgacacagaaaattagctatcacaacatctgtgtgtgtatatacatatgtatttgcatgtgtgtgtatatatgtgtatatatattcatgtgtgtgtatatgtgtgtatgttgtgactgggtgtatacacatccatatacataaaatatttcaatatattatattttgtatatatgttatatatgttatatattatatagtaatataaaatatatttaagacatttttataatctatattgttatacattatgtaaatatatgtatatataaattatatacttataaatgttatatgttatgtatattatatatgctatatgtattatatgttatgtcatatataatttattgaatatatttatagtatatgaaacatatatagtctgtcttcttggaaaagcatacaaacaatgagactccagatccagatttctttttttttttgagacagagtcttactctgtcacccaggcaggagtgtggtggtgtgatcttcgctcactgcaacctctgcctcctgagttcaagcaattctcctgcctcagccttcggagtagctgggattacaggcaagcaccactacgcctggctaatttttgtattcagatccagatttctaaatgtctttctccagttaaaaaaaaaatagggctcctgggagaaatggctgatttctgggctagggtagggaaagtaaaagatgaacctggaaatatcttgtggtatcacaaattaagtgttctgaaaataagtgctgaaaaaattattgtgacatgtcaaatggattcagaagccaacatgaacaagctcccactgaccaaatctgaaacaattacagcaaataaataaataaataacgatggcaatggatcatagcacatagaataaaataagaatttgagtccatactgatataattgaataataaagagaagaaagacaccttctttatagcaagattccaattacctacatgtagtaaaaatgatgcaattagaaagtcagcatttggcaaccatcacagtaataattatttcaggcaagaatcaatgaatgctaaatcagtaaaagtctgatgagaaataattatatactcttcaattttttctccacaaaatacttaattgcaaataataactttgcggaagaaaaacctgacagacactattttagccaagtgatcaaaactaacatcactgatattgggacaaataacacctagttcctcctgataggatacattgaaaagaactctgtcatttctgtgtgattgttgccaaaaatcataatctgaatcaaaatatgaggaagtatccgaaaaaagacaacttgaccgtcatcctacaaaatacctcttccagagtggaaaggtagtgaaaatcaagtagaagaagggaaatagaaatttaaaaaattaagaaatgaaataataaaggtaagtgtaaaaattaaaatagaaaacaaaaataatagtgaaaatgaaatcaaaagctgggtctttaaaaaaaataaaattgataaacttccatttagatgggtaaagaataaagagataagacagaaattgccacccatgaacttttagtaatgcaacagaatacatcactcactgcagagcataatcattggaagaaaaatatgagaatatggcaggcaactttatgccaataaattcaataaactggggatcacgattatgatcaacattcacttttgaaagggccatggaggaaaatgaaccaggaagatcctccctggggcagagctaccactggatgaaatgaacaattcattgaaagacacaaattaccaaaactaacccaataagcaatataaaacttgaattgccctattaattcaagaaattgcatttttaattaaaaatctttccaaaaagaaaaattcatgcctaaatggcttcacttgtaaactctagcatttaaggaagaaataaaaccaattgtacacaaactctttgagaaaatagaaaatacttccaaactcatttcatgaggccaaatatattaaaaaactacagacaaatatccctcatgaatatagacacaaatatacttaacaaaattttaacaaaacaaattagtatatgtaaaagaatacttactatacatcatgatggaatgaggtttatctggggagtgaaaggttggtttgacatccaaaaattaatcaatgtaattcaccatattagaataaagaagaaaatataatcatttcaataaatgcaggaaaagctttttgtaaagttcaacactaatttgtgatttcaaaaaatctatcagcaaactaagaataaaagaaacatttctcttaatctaattaagggcatcttcaaaaacctacatctttcactgtactcaatattgaaagcctcaatgctttctacctaagataaggaacaaggcagggatatctattctgccatttctgttcaacattatactggaagttttagccagtgcagtaaggcaagaaaaagaaatgacagtcaataaattggaaagggagaagaaagtcgtttttattggtagatgacatgaccaagtattaatacatagaaagcttaaagagtctactagaactaataagtgaatttattgaggtcagaatacaatgttaatgtataaaaattataattttatgtattagcaatgaacaattagaaaatgaatttcgaaaacaacttcatttccaacagcatccaaaaacatgttagagataaattttacaaaacatggaagatagtttcttttcctgtgcagaagcgctttagtttaattagatcccatttttcataaaaaaagaatgagatcatgtcctttgcagggacatgaatgaagctggaagccaacattctcagcaaactaacacaggaacggaaaaccaaacaccacatgttttcactcataagtgggagttcaacaatgagaacagatggacacagggaggggaacatcacacaccagggcctgtcagggagtggggggcaaggagaaggagagcattaggacaaatacctaatacatgcggggcttaaaacctagatgacaggttgatggctgcagcaaaccaccatggcacatatatgcctatgtaacaaacctgcatgttctgcacatgtatcccagaacttaaagtaacattttttaaaaacggaagaattctatttaaaaaaaaaaaactataaattttgctgagagaaattacagacttaagtaaatgttattaacatcattttcgtgggttggaacactcaatattgttaagatagcaattctccacacatcaatttataactccaatagatatttttaaaaagtgattccaaatttatattaaaatgaattgcctctcttaaacctcccttataatttttttaaaagatttcagaagactaaacactatattacacagactccattgaagctaggagtctaggagaaaatttgatctacaacgtaacaagcagttatgtgatatttatttggaggtcagaattaaggtgtaggtcaacttcctactgctgcttctatttccagcaagataagatcagccacaggtgattgtggtggtctttttctactttcatttatctagtcatcaactttatgggaataaaaatctgcggtagtgtgtctggaattgctgggttcttggtctcgctgacttcaagaatgaagccgcagaccctcacggtgagtgttacagttcttaaagatgatgtgtctggagtttcttcttactggtgggtttgtggtctcgctgacttcaggattgaagctgcagaccttcacagtgagtgttacagctcttaaaggcggcgcgtctggagttgtttgttcccttcagtgggttcgtggtctcgctggcctcaggaatgaagctgcagaccttcgtggtgagtgttacagctcataagggtggtgcggacccaaagggtgagcagcagcaagatttattgtgaagagcaaaagaacaaagctaccacacagtggaaaaggacccaactgggttgccgctgctggcgggggcagcctgcttttattcccttatctggccccacccacatcctggcgattggtccattgtacagagagatgattgttccattttacagagagctgattggcccattttacggagagctgattgttctgttttgacagggtgctgattggtgcgtttagaaacctggagctagacagagtactgattggtgcatttacaatcctttagctagacacaaaagttctccaagtccccactagaataggtagacacagagcactgattggtgtctttacacaccttgagctagacacagaacgctgattggtgcatttacaaacctttagctagacattaaaattctccaaatccccacctgactcaggagaccagctggcttctcctagtggatcctgccctgggcagagctgcccgccagtcgcacgctgcggcgtgggcactcctcagcccttgggcagtcgatgggaccaggcgtggcagagcagggggcagcacccatctgggaggctcaggccacgcaggagcccaccggtaggggggctcaggcatggtgggctgcaggtcccgagccctgccccgcagggaggtggctgaggcctgggagaatttgagcgcggcacgggcgggccggcagtgctgagggacctggcgcaccctccacagctgctggcccgggtgctaagcccctcactgcccggggctggcagcaccagccggctgctctgagtgtggggcccgctgtgccttacccacccagaactggcgctggtctgcgagcgcggcatgcagccccggttcctgcctgcgcctctccctccacacctcccggcaagcagagggagccggctccggcccggccagcccagagaggggctcccacagtgcagcggcgggctgaagggctcctcaagcatggccagagcggacacggaggccgaggaggcgccgagagtgaacgagggctgctagcacgttgtcacctctcagtaggagagcgattgtagcagcagcagattcctgaactccatgatttcgatggtgtgatcctgaagtcagttgttcagaggcagttctctaacatttccagctttctttcaaagaaactaagagggatttttgttttcttcactgaaatttggctaatccaatattccacaactcttaactatttttatttcagtttccttccccttagctaatcaattaagttaatccactaagttcatcagtgccttccagtccactgattctctctcaacattcacttttgaaagggccatggaggaaaatgaaccaggaagatcctccctggggcagagctaccacactagaggcacacagtattgagtataatgagacttacagagaagaatatagcaatctggggaagcagaccacacttactgaaagtagcactgcagaagtagtgtttattaatttagattgtaatttgaaattgccacattattcatttctaagatttcaaattgctttatatctgacagtttgtacttcagacctgcctatttttgttttacaggtcctatttagttactaatggatattgatcctttatttctcagatttgttttgatatgtttatcacatttttctattaagagaaattccacttagagtcagttcctttccaaagttgattttgttggctctctctcatggcattgcatttcttcacattttacagttgtgatttgcaagttttttaagtagactttttagtttgtttcattctttggtagattgtattaatgtttctaattctttactccttcccttttacagaattataactggacatcttttgccaggtgacttttcagtgccttccactatagtagatggaatatacttccccactccattgagtccattttttgttggctaacctgtagttttaagattgtaatttttttaaatctagttaccttgattgctttttagagagctattagtcccaataacttagaccaccattatttaaaaatggaattcctaaccacaatgtgtgcacctcatcataggaaggaacacaaatgggggagtagaagaaaacagaaatgtattaataggcgacagtgagtacttcagctttatgtgtaatgttttatttcttgtattacaaagtaaaagatatgaagcatttgactaaaaatgttaatttatataatttgaatgatgggtacatgggcagttgttatatttatatatacttttatgtattctaaatttttttctcaaaataaaaaagagaaacagtcaagggttagtattgtgtcatcaaactcattacagacctcaattcattttgttttatttatttctgaacaacataatttgaggaagtaaagcatactttaaggaaatctgtagaagggcaaagtaaaagcatttgaaaaagtctcatcacctgaaaaaggcagagaaaaaaagaacaaaaggaagaagtgttctagaggtctcatctagtttgtatagggaagaaagttgaggtaatacagctgtgtgggaaaagggatagattcatatatacttgttcttgagagcagacatgttgttaacaatgaatgaaatggaaacacacaactaatctttgaaagaatgagatgaacctgaaaaaaaaaacaacaaaaataagaaaaaaaggaaataatgatttaaaatagataatgaagaaactaagatacagacattaaataaaatgtaaatggattgttttctttcactaaagcttaaagattagaaaacaaaagctgtgtatgagggacatggtgaaatagtaaagaagggtggaaaataaaagataagcaaagataaaatgtaaggtcagaccaattataaaaggcaaagatttatgaaaaaggtaacattcataaatatgtatatatcaaactacatgcaactagctaaatacataaagcaaagtcattaggaatttgataagcctaataaaatataattatgactgaagatttcaatacatctctaccaaaatcaaacagattttgtagagagaaagaaacccaggacagggaaaaacaaccttatattatctagagacaatatgttggctttcctctacactaagacattttgatactggtgctttcttgatttcttgatcttaccagaacatgtcaagtgaaggttttacacaactacaatgccactcctatgggctgacagctgtaaagagatgcatcccaattctagagatgttaacacgtgagaaaaatgtttcttagaatcaaagatatgaggggtttttccatacatcaatgaaacatttgctcaaaaacgtcatatacttggccataaagtatattcacttttttaaaaggccgtgttgataaatatgaaaaagagagaaggtgatcaacaaaatcttaaccacttgaaaattaagatgctcctagatcacccttatatcaaagataaaatttaaaaaattaaaaactatttaggaaagagtgaaaagaagaacacactaaattatttggaacacagagaacttttcagtggaacttgcaagctttaaatgccttcgttattaaggaaaacattaaaaataaaggaatttgaactcatctgtggaaactaaagagcaacaaactaaataaaaagttttaacatattagtcaagatacatatataaacatagaatatcaaataaaacctgacacctcaatctaaggtctgtaaaaaactttaaaacaaagattggaatcgtaagagttaaagaaatatagacatttttgacaatgcaaaaaatgtaaataatggttagaaaaagtggaaataaattgctaaaacacaaaagagagattaatggtttgtgtctataatagacaaaaagctcttacattgataggtaaatgacataaaacccaatacaacgtggacaggtatactgataggaaatttttagcaaggtaaatcagattgatcaagaacatatgaaaagatgttgacattcactaggagtcagagtaaagaaaatcaaaataattttccgaggtgtgaagtattagaatgaacacagaatgatggcatttcagggctaaggctggaaatggcccctctaagttgccatgggaactgagtaaacctggtcttaaccatgtattggagaaggaatctatccacaaaccaaggaggagtgtgggtgcgggttgggaccgggctgaccaaaggccgccggagaggaggaggcctggggatcacaaaatgcttgaggatggcactgcgtcctgggtctgtacagtatggtttgcaataaaactcaaaatcttccagccgagataagaaaaaaaataattacaaattacatgaatacctacctagacaatccaattaaactctaacaaaatatgttggatttaacaatggacctaatattaggtaaatagtgacaataataaattggatatgacaatgcaaaaataatcctgtttatgagtgataatcatcttaaaatatcgaagaatgtaggtacccaggaagattcttcaaatatgtgaaggaactattcacatttctttaaaaattgtaagaacagctctgaaaatttaaggtaagtcatttccttgttgaaaaatgtgaaaataactagtcatcacaaatttaaaaataaaatcaatgcaattccaaacaaattccaatgaagtttttgttgaagtgagctggacaaaagataatgaaggtttgtatgtgtgaaagaaataattcaattgtattattgattatataaggaaaattcattatttctgaaaaattataatttactttaatcattagctttttaatcataagtgttactactatatgaacaaaaacaggtgaggttgttattcataagtccaagaaatgacgttgaattttgttagttctcaaaaaaaaagtaacttttaggaatgaagttcatgcagtgttctaatttataaaacaaacattagttttcagtcaaccattggcatatgatatggtacccagatattctaattgtagtaattttttagtgctacataatttgtaatatagtctaagattgatgagaagtaatttagaatgacactgcttatgtaaattgttaatcattttagttgagcatatatattaaatttacataaattcaaatagtatcatagataacatcaaatatttatgtttcatttaatttaggcttttttaatgaaaaaaaaagttttggcacatactaaaatcaagaccagctacataatttgtagagcccagttcaaaatgaaaatacagaatcccttgttcctaaatcattaagaatttcaagatggtgaccacagggctctaaaccaagggcccttgtgagcatgagtcccagtgtgattataagagttgcatgcccatgaagccagccctgactaacataccatgcatgcatttatttttacactgaaacagctgagagaagacatagagctttttaataccccaaatacataaaacgatacaatttatccaatggtttaccttgattaaggttatgatgaacttggattataaatgtaattatttagcatgtaagagtaaagctttgtaattcctggtttaaaatacttatttcagaagttttcagtctttaaagatacaaatttaggtttaaaatttatttacctttttacagaaaaaatggatgagaacttaaatttccatttttcttgtttaaatactttctgaaggacagaaagagtttaaatttgggaaaataaattttcaattaatcatttagatgtttttatgcatagacttatgagtatttttcttttttcttgccaaaaatgtgacatctatttttaactcaatatcattaactaaagggcttaaaactcaattgaataatgtccttttaaaatgaatttggcaggagctgtttccaaggagaaaagacttttgagatacagttctctaataaattagtctattttatttataaaaactacattgacctggtgactgtagagcctttactttttccccagcaggtgtgttttcttataccatgaccaaatatgaagaattagaaagttttgctttgtttcttaattttttgcaaatttttagagtcattctatatttagacaactattaagtgatttttaatgccaattaaaacagggattccattatttaagggacttatcagaattatctaaaaacacacaaactagtctagattttaaaaatcctccaatcataacctgtacctaccctggaattatttcatttctgaagaagtctgcagtaataggtgcgtcatcatcaaatgcgaaatctctttttggagttctgggaattccccattcctcagggaggattccaattttgttggaactaaaaattatacaaatgttgaggggagggataatttttaagaaaaaaaatacaaaaccatgaattaaaatttagtttctactgccttggaaggaaccatacaaggaaagccccctgaagcattaacatcaagggtaaaccttcctctggccacatcccacctctcaattcaggttggcattcataaaggggaggaggtaatcacccttaatcaatgtctacaatacttttcttccatggaaaataaagaactgtacatattctgaacaagtttaggtaagctgatagaaggttgtctttctgattgcctgcttggcacaaggttcaagagggaagcacatactcggaagaaaaaaaaaaaatccttccattcagctaccctgagcttccacttctgctcaaccagacattcatctgccctattctccagatggtggcagttccttgcaatgaggaacgccatcgatctactaaggagagggctctgctttttactgaaatgtcatattgaggcaggagaatagagtctggagacagggagcctaaggccaacccactgctgacttcttggaattggaccaaaaggaaaaccccacctcttcatgcccaagtgataaggggccagaggcccccttcttctacaaaaccccctttcccctttgtcacaaacaacaaatgcctctaattagtcccaggccgaaccttcacttcagcctctgattagtcggggatcaatccttcatttgcatagggtgtaaccaattggagacctctaaagtgtacctagtggtgttaccaaattcttttagcttaatgaaaaccctaaagaacattgcaattggggctcttgagctgcttgtttgagcctgctcccgctctgtgaagtgtactttcttttcaataaatctgtgctttcgttgattccttcttttattgctttggttgtgggttttaattatttgttcagccagccaagaacccaacttgcagtcaaggctttccatccagtagcaatattttgttagctggcttacttatgttaagtgttgctcactttcaatccatgaattttattttacgacattttaagattcaccaatttggcaaatttttaaagttaattccatttttaatttttgttaacaaatgtattttcacaaaattcgtctgatgtttttctcttaaaattgattaattctgttctagagtatatcacatgtatttctgtcaataatagcttttacttctcataattttgttttatatgtgcatttttattgaattaatctttcattttgataactatatacttaataataaaggacttttggacattgcttttagtgtatcatgtgttaaagctaaatgtcttatttatttattttattatactttaagttctagggtacatgtgcacaaagtgcaggtttgttacatatgtatacatgtaccatgttggtgtgctgcacccattaactcatcatttacattaggtatttctcctaatgctatccctccccgctctccccaccccacaacaggcccccgtgtgtgatgttccccaccccatgtccaagtgttctcatttttcaattcccacctatgagtgagaacatgtggtgttagaattcgttttttagatgtttactgctcctattgcaaattagtattgacgtgaattcacagagcttgaaagacttccaagctgcattttcagctttcgctcctcagcctgctcaccaacatccaaataatccttcaattttcattatttagatgtctgcgtctttcttttgtcattattttatataatgtttattggattgtgaaaatgaataaataattgttgagaaatgatttgtggtgctttgtttgatttcagtttcctattgaatcattcagaaacaattaaatattttggcttgtagtgccaaagtaaaatatctgaaatttttctagaattttggacaaagttccagacatttctactagcatgcactgatgacaccagttctctctgtatagaattcagtgacattttcaaataaatatttctaattgacacaacttttcgttttaggaatatttgtgtgtgtgtgtgtgtgtgtgaagagacaaggtatcactctgctattggagtgcagtggtgcaatcatgctcactgcagccttgaacacctgggctcaagcaatcctcccacctcagcctcctgagtagcaaggactataggtatgagccaccatgccccactgatttttttatttttatttttgtagagacagggtcttgctgtgttgcccaggctggtcttgaactcctggcctcaagcgatcctcccacctcgtcctcccaaagtgcttgattacaggcataagccaccaagcacagctatcaatactatttttatcaataaataagtatagattttgctttaattcagatgttacattaattacattaattctagcactaccaaatcattaaattacaaggaattttacatttaaagtaagtaaataaaatatatatttatgtcaaataaaatttggaaatagattcagttctataagagattttaatatatgatgaagaaataatagattatggtatggtttgttaaattaatagtgctgccataattgataattgattaaaacaataatcccttgctttgtaagttttcataaaagttattttctcattttaatagaatatgtgttgtgacaagtggtccacaaccctagataacaatgaaaaacatatcattattattttttgaagtgatattaagcattttactctgaaattgctttagtatttttaactaatcatagtgtttaaattatgatggtttattctcagttttaaaattcatttcatcaatacattgataaaagattgtttcagaaactttaaaatatttaaaggtagaacttatttaatatgtgcttttaattatgtctcttgatgattataactattctttatttcagcatgagttttacaaaattttagtcctgttttggtgaatctatgaatgttcccacttttaaagatacaacatttaagtgccatttgcatccattttctttttcagtatttttttcctcaatatgaaaggatacttaagagttttctggcatttcctgatgtttctcagttaagacttttactgcacttttttttttttttttttttttttgagatggagtctcactctgtcacccaggctgaagtgcagtggtgtgatctcagcttactgcaacctccgccccctgggttcaagtgattctcctgcctcagcctcccaagcagctgggactacaagcacatgccaccaagccttgctaattttttttttttttctgtgtttttagtagagacgtggtttcaccatattggtcaggctagtcttaaactcctgacctcgtgatctgcctgcctcaacaggcatgagccaccgcacccggcgaccttttctactatatcaggtgatgttccaggctgtagcacattgatataatcttattttctcagagattcagaagattcatattaataatagtaaaaagaggaacattaagaaacatattcagaatttgttggatgtttattttcaatattaatacaccttattcactaagtatcaaagtactacatatttactagtcacatataaatctcactctaaccataatatcaaatcaaactagttagaaacaagcaggtatgagcaaaagaagtgttatgatttaaattatcattaaaaagatagttaatatgcatattggataaatatccacgttaaaacaattttaagagtgaggcaaatcgagttttaaaatttttacaagccattattttattacacaggaatcttattcctgcaccaaggaaaaaggaagctcaattagctcattcagaacttttcttccttaagttcatgtgacattacttcaattatatcgtgaatttaaaggaggacatctcaaaatattattcatagttaacaaattccaggtcattggcattattatatggctctgtgttcaatacaggttattctattgatttaatttgcttaaatgttttcactcattcaaaataatgacaaattgaaattaaatatatcttatttgaaaagagttgacatatttccactaaggattcttcttttccaggaacaggaataaggacaacttgacactttgatcttctttaccaataactgatctgttaaaaataacttgggtactatgcttactacgtgggtgacaaaataacctgtacaacaaacccccatgacatgaatttacctatatgacaaacctgcacatgtaccccgaacctaaaataaaagtttaaaaaacaaataaatactttggaaggttgaggcaggtggattgcctaagctcaggagttcgagaccaacctgggcaacacggtgaaaccctgtctctactaaaatacaaaaaattagccgggaatggtggtgtgcctgtagtcccagctactcaggaggctgaggcaggagaattgcttgaaccggggagatggagcttgcagtgagccgagatcacgccactgtactccagctctgggtgatggagtgggactccatctcttaaaaaaataaaaaaaataagtaaataaataaaaataaatggtctggttacacattttttttcacttcttacgtaagttttggtaatttatttttcttagaaaaattgcttttgaatccgttttttcatttataagaataatttgtgcctataatcacagtactttgggaggctgaggcaggcagatcacttgaggtcaggagttcaagaccagcccggccaatatgctaaacctcgtctctactaaaaatacaaaaactagccaggcatgacggtgcatgcctgtaatccctgctacttgggaggctgaggcaggagaatcacttgaacttgggaggcggaggttgcagtgagccgagatcacaccactgcactccagcttaggtgacagagagaggctccacctcaaaaaagaaaaaaacaaaaaagaataatttgttattttataattatttcaatttcctcccttttttgctcatttgttttttcaatgaaaatctactgagggcatagcaagtttctaggtactgttccaatatttagtatatattggtgaataaaatggatgaagtttcttctattttgggtcttcaatgttagtgaggaaagacatgggaaaaagcagcaaagtgatttcaggtagagtaagtgccataaaggtaatatagcagtgtgataggagagagaataaatggtagaaggaatttttttagagtggtcagaaaaggatattttgaaaaattgacatttaagctgagacctgaaagatgaggaggaaccagcaacacagatgtgggaagatctaggaaaataatatctccggaagaaagaaaataccaaaagctctgaaaagaaaatgaggttaaattatatttatttctatattttctttgctaattcactgtatttgtggtttgcctcttttttctcattgcttgtggtttaatttttattcctaagtcagagaattagcattgaatttgtttcttcattctactacttgttttctttttctttttttattttaaggcgttattaaaatatgattgacaaattgcacttgtttaaaatgtacaatcggatacattttttacctatttatacccccatgaaatcatcatcttctgttactatgaagataccctttgtgctcttttcctaagcagtccctccacttggtgcaatcaatgccatccactcttgcctactccaggatgtgttcttgcaatcattcctcctctttatcctctggaatcagtttcttgtttctatattctcctcctcttgcagccccaaactttccaaagaagttctctattctcattatctctgatttctcacctgcctttctctcttgaatccaatctaattaagccccctttcccatcaccccaccaaaatggctcttgtcaaaattactgatgacttccatgttaccagactggatggccaattcttgagattcaactctcagcagcttttattatatataaatttctttatttgttagttgttacaacccatagaatgtaaggtctttgttttgttcactgctatattcctaaaatctatcatagtttgtagcacatagtaagggcaagttaactatttgctgaatgaatggtaattgaatctccttcatgtgtagttttctagtgtataatcttctctataatattttatgttccctttctccactgggaaggggaggcatgtcaatatcatttcataggtcacatgagttttttttcctagttactaatattcttaaaaagataggatctttagggcatatactgagtggggtgagtcaaggagagtgcttcagtattgttgactctaatcatctcagtaatttttcgtttgtttgtttgagacagagtctgactctgtcgcccaggctggagtgcagtggtgctatttctgctcactgcaacccctgtctcctggttcaagtgattctcttgcctccacctcccaagtagctggcattatagatgtggaccaccatccccggctaatttttgtatttttagtagagatggggtttcacctttttggctaggctggtctcgaactcctggactcaagcattccacccacctcagcctcccaaagtgctgggattacaggcatgagccactgtgcccagcctaatcatctcagtaattggactctaggctaacaggaagtctttctaagtcattaagtattgtacagtatgtttcctcatggaaatttgtataacagctatttcaaagctgtctgctcttcactttttctccttcactctaatgtactcaagcctgatttttgcaaagaaggcatgacattgctttttgttacatttgttactgctaagtccttcttcccttgacactccaaagtctcaaatgggctatcgatactccctactcccaatctattctatttatttacctgaaatattatattttttgtttacttgctattttatgtatcccccaactagaacacaagcatcatgaggagctctgtttattttattcgttgctgaattctttgtggctagaaaagtgccaggcatgttattggctcagtaaatgaatgtatgaatctacttaaataccaggtgttatatgtgcctcagtaagggatatgaaaaggccacaggtgcgatccatccaaaattactttctctcagcaaaaattccatcttggcatccagaggtttattggggtttgttacacatgcattctattcaatactgttcattgaaaagaaagattcagttagcctttctaccttctttattatctatgagatttgttataattccaccttggggggaacatgggtgatttttaacgtaatttgttacccattgttttgttttcaaaataatgttttatttctagatttaaaaggtgtaaataggttggagtttaataagaggaacaatgtatatttcttaatggggggaagaagaagacaaagatacaggtatgtttgtgtatttcatggtgtgaaaatgagagtattctttactgttgcctgccattttcttagtgaattaaaaagtaaattatcacctggatgtggaacatcatggaaaagaatatgacatattttagaagaacaatggcatgatacagtaatctaatgaaaaccttaggacgcgttggaaatgctgaatacagtttaaggtttctaaacattaatatgtagtgaaaacaatcaacccagatgtgtggattttttttccagcaattttcagctgctaaagtccacatacgtagaaagagtagatgattgaattcatccagggttggagcatatgtatgctagagagaaattgagacaacgaatacaagcaaatttgcaagagtgattatgatgtactacaccatcaaaactgagaaagaagagtgtgtagaagggactaatggatggtgagtaaagtgctggaatcaatctaaaggtcttatttagattaaaaaaattctgaggtggaaagtgttttaataaatgaactggaagtttaagaggtagtagatgtaggatgtttcagatcacaagaggtaaagagtcaagaaactttaaggtcagaatattcaatggattattaagtgaatggtgatagcataaagatatttctttgtctgtacacaacctgtcaaatcttgcatgttctggccccatctctcactcaagatttatcttaagctgcctcactcttgctccataagctttagccacatcagtctattctcagttatttccctcctaagcgccttctcacaagatgctagttgtattgtacaggtttctatcttagaggccctttatgacctgcctctcttccccacatcttacctgtcacatctcttctctctgtgtttcttaatttatgctgtatcaaaagcaaactcgcacaccccacacacactattttctattcaatattttctattcaattacatatcacttcttactgttataattatatattttgcttcatatagatatttgtgatatttatcctattttgttgttgactgcgtattgttagttttacagctgaaattattaaaggatcagtgaaattcttatggtggtaagaattaactcactattttataagctagtttcatgagttatgagtagatgtttaactgttactttatttttatgtgagatgctgaattctgttgttggtttcctgataaatatttcttttttatttttcagattatcatatcttcctttacattaatttatcagacttagcctcttcttctgctggtagtattaatctcaaggacaaagtcaaaagtatttataaggattcaaagaggtgctcatagagctattgagaaattttttttaatttcttcctagcatttagaaatattctactttaaaaggtaagataaataaaagaagagatgaaaaaggagacattacaaccaataccacaaaaattcaaaagatcattagaaggtattatgagcaactgtatgcaaatgaattggaaaacctgaaagaaatggataagttcctagacatatatacctactgagattgaatcatgaagagatagaccacctaaataggccaataacaagtaataagatagacacagtaataaaaagtgttccatcaaagaaaatcccagaaccttatggctttcctgctaaattccactaaacacttcaagaagaactaatatcaatcctactcaaactatttcaaaaaattacagagaagaaaatacatccaaattcattttataaggccagcattacccagatatcaaaaacagacaaagatacacaacaatgaaaaaa

SEQ ID NO: 33 - DNA, 95627 bp, Homo sapiens
  source 1..95627: mol_type = genomic DNA
acagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagtctcagtaaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaggccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttggattgtcagctagagtaagatcatttaaagcacagttttttgctgggcgcggtggctcactcctgtaatgccagcaccttgggaggctgagatgggcagatcacaaggtcaggagatcgagaccatcctggctaacacagtgaaaccccgtctctgctaaaaatacaaaaaattagtcgggcatggtggtgggcacctgtagtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaaaagacagagtttttctatacatccttgaatgtcctatccctttgttggggaaagtcttccttttttgttgttgttttgttttgttttgttttgagacagagtcttgccctatcgcccaggctggactgtggtggcacgattgtggctcactgcaacctctggctcactgaaacctccacctcacgagctaaagcaattttcctgtctcagcctcccgagtagctgggattacaggcgtgtgccaccacagccagctaatttttatatttttagtagagacagggtttcaccatgtttgcctggctcgtcttaaactcctgacatgaggtaatctgccctccttggcctcccaaagtgctgggagctgggattacaggtgtgagccactgctcccgtcctgttagggcagtactcttaaccaaactaaatgctaagattactttttctctgagatgattggacatccaggtgccttcagaccaagcatgtgctctgcaggccatattattacaactggagatccttgaaagtgcctgcacccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccaggtatgtttttattgttgtccatgctcatggggccgtttggaaagaaagcgggctcttaacctttgatgattaaaaaagaaaaacaattaagcatgctaaagaaatcttagcctgactaaaggcagtcttggtacccaagaaagtagctataatacactaccatggacatcagtggatggacaatttggtagcaagaaaaaaaaaatcactaggcagagcaggccactaaagaggtgaacagagaaaaaaatgcccaaagccttcctaatgccattaatccctgaaataaacttcagcctaaaatccctacctaatggaagaagatgtaaagagagaattcgattgagactttgactccaatcaaagaactcaaaatgagtggatatgtgacacggaagaaaaggttctggtgcccaagtatcttgtgacagatatcatcaaacacatacatgataccacacagtatggcaggcatgccacccttcaattgatccaggactatgtctttgggacacacttaaagaagactatccaaaaaataatttaaaaatacctacttggtgcccagaacaatcttaagactggtcctccacccccagtaccaaggattcaagcaagaggtgcagggctattagaggactggcaaattgattttaccgtgatgccaagggtagcaggaaattttaaatacttgcttgtatttttagatacattttcaagataaacaaaatcattccgctgcaagaccaagagaatgtctgagctaatgagagccttggtagagaagattaccctcaggtttaggtggcctgtctccatccagtgtgaccatagtgcaatttctgtagcctaggacaccatatattccaggccctcagcataatctggaatcttcatacagcctgcagactgaagtctactgaaaaaactcaaaagataaatcatactatataaaacaaaacaaattttagctaagatttgccaagaaactaacaacctggaataacattctgtccattgccctgctcagagtaagggtggtccctaaaagtgggcttaaattaagccctttaaaaattttacatgggagatcattcttccgttaccttctcagactaaggaatgccaataacatacacataaataaattagatattatcaaatatacacaatctttaggttgtactttaactactattcacgagtttgtggttccagcagattgtggtatccaactgacattctctttcatcccatccaacccagagactgggttctgctcaagaccaggaaaagtcgacatcctggggaccacttaaaacacagtgaaagaggccatgcaaagcatgactggtgacccattcctctgttcagcttgaaggacttagaccctggattcaccacagccatataaaacccgccccgccagattcttgtcctatcaagaaatgtagagaggccacttcaacttcagagactgtctcaaccctatctgaatggataagtaaatctttgatgggcctcaaatatcttttgaggaaaaatatcagataagtaactttaatgaaattagacaaaacatatgtcttcttgacaactacaatagttactttgagcataacaggaatgtttgttattataattattttatataaaaaggtgagataccttcctgtctattccctgccttactgaatgcttaagccatatatttacttggtcattataattgcctagataattacaattgctacccttatagacattacttcataattgccttggtcaatacaattgttagacttatagattttctagacattctatgccatgctaacatagtctcatgccactcattatgtggacattctaaaatttagaaatggtcactcttgttttaaaacttctaattatacctctcctgttactacagtgcctagacaggcatagcaacactgtagttcaactgtttcaaggtattgccactggaagaaacttaccagaatgatggatctgtcagtaactcccccaaactattcaaaataagcattttctgttagtcatacttgtcactgactttctggatgttccaaatatgactacctatctgcaccagcttctttccatggctactttccaggtccaagtaatagtacaccaagaaatcaccaccccatgtgtcaatctctctctgcctatcataaatggaaagtcattccattacataggccctccatggcccatggcatactgggcagacaaacgcagctaggagaagggaaataaaactaaaagtttctccttactatgccaaaaatatttacagtggggaatatcacacaaattctggggagcctgtaaaaaaagatccctagttcaattccatttgtctatattccccatgaaaaaatccatcaataaatgcacccttgagggctttacctgtgtgcccccttggtacatgtttatttgtggcataggatcagaccctcctctgttagggcaagcccactggtgtctcaataacctgtatattaagggctctcacttactgagatacttctcagtccatcctaatgacaaaatattctgcccattttcccaccgactccaaaagggactgccaggcatatatcaatatatctggtggcagagccttctaggcatcacgagtcctagctatggagtatacactcactgggacatgatcagaaacttattggcaaccacagaaataattgcaaaagaggctgctaagaacattgaggctgagaaaactcttcaaatttacttgcccagatagttcttgacaacggaactacacttgattttctcttggctttacagagaggagtctgtacagtgatcaataccacctgttgtacttatatcaatgcttctggtaaaataaaaaccaaactaaagaaaatatttcagcagtctcgctggagaccatatgtctctaccacagaccctatgtctgaatagttttttgagctttccgcctgcatactccatgttttccagtccatttttcaaggactcttgaagttcaagctcacaattctgtttatagggattataatttacatgattcaattaaatattacaataaaaccatagactgaagtactaacatgttcatccagcaccctaagctgggtataacagcttgcaggttgttacaagacggtttcattcctctaatcctgactctctctctgtgccccgtgtcagcaaaaagaagctagaatggccattgcccgattcataccatattagcttttacacctcagaattgagaagggatcaagcccggaaggaactgaaactgtccctaggaaagttatataaaattgattaagggggaaaaattcaactatgatttcaggaaaatcagcagtaatcactaaatcagctttccatttgtccaacttctctgtagctggtcattgattactaccctaggataaagaagcccttgtcacaagacattttggtccttttcctttctatagataaaatctaagacattgtgagatgataatctttctgcatgagtttctcctttaggttctgcatatgaaaaaaaaacctagcaacatactggtcaacaaggcaaaacctcattttcacaaaaaattaaaaaattagccgggcattatggcacaggtctgtagtaccagctgctcaggagatctgaggtgggaggaccacttgagcctgggaggcagaagttgcagtgagctgtgatcacgctactgaaatccagatgggcaacagagcaagatcatcttgctcaaaaacaaaacacacacacacacacaaacatacacacacagacacacagacacacacatcagctggtctaaagagcccagcaaaaagctgactcaggaaataatgcaggttccacatcctggtgacttcatcccccttaccctgaccaattgacaacccaaattttctagcccgtcaccctccatgatccccttaaggtctcttgcacatagccccttctcagaacagatctggggcttgagaatcctcccaattccttgtttggtgcccttgtgttgattaaagcctttctttgctgcaaaccctactgtctcagcgtattggtctattgctaaacagtgggcatgtgaacctgatagtcttataacaaaatagaatagaagctatttataggatcgatccatgcatgtgagtctatttctggacaccgttttctcttctattcttccacgtgtttgtcctttaaccagtatcatgagatcctttactcactgtagctttttttaagtcttaaaatttggtaatgtgagtttttcaacttctcttatcttttgaagaattgtttagctgttttagcccctttacctttccatatgactttagaatcagcatgttcgtatgtgcaaaacattgtgcttggttattcactagaactgggacacattcacagatgaatctggggagaactgatatgtaatagtattaaatttttcaatccatgaatattatatatcctttgatttagtaagatcatacagtcttaccctagttttttttattttaagcatacagatcctgtattttactagatttataactaaatattttgtatttcatccatcaacgaaaaattcaatttgtttaatagacagaatttattaatgctacctaatccttcttgagagagccatgatagtttgtggcttcagtaattttttaattcattcaagttcttgaatttattgacatggcattattcagaatattttttatttttcttttaatatatgtaaaaaccataatgatgtcatttctgtcattgctgttataagcaatttgtgttattttttctgatttagtctgtctaaaggtttctcaattatagagatctaaaataacaagcttttggtttccttgtttatatacatatttacttctttattatttcatctctgatctttattgtagtatttcttctgcttactttgagattaattttttctacttttactaatatctaatggtagaggctaaggttattgaagtggaacaccgtcattttctatcccaggtatttagtgacaccaatttatttcatactgctctagtgccattccacaacttttgatatatagtatatcaatcagtgtttggctggagtagggtgagtattccataaaagatttactgtgatttttggagggaggtgtgaagagggtattattaccaaaatgtggatttttttttaactccattctgtattttggctaagagaagcagctttggaacttctcaagtctgtacatctgtgagaccccaaggattacttgttttaatttttttttaagtttaggtttgttttgggtcaacttagttctttcaaggcttatttttaagcttttaaaaagcttaaaaaaccccagagatagtttgttcagaatattaagctgcttctgatgtctctactacgtgacctagatgttcaaacgagtctttctactctgattgattccatttaaatgtctccctgtgttgtgtgtgtgctctgggaatcctttacctttttgttctctggtagtgttcttcatctgataggtatcctttgtccattcttggggagttttgctctactctccagagtgtcaatattcagccaaataatctagggagttgctgtggaaatttgtagagccctttcactccatagtttcttcttttctcactctgtttcctgcagattctagtgaactcatcttctttgggaacactgagttttgtttcttctactcagcaagtgtggcactttctgctgaattctccttctccatgctgctgtttggaaaatttctcccagcataaagtcactttgatgatggaactcatctcattgtcactttttctctggaattaggtgcttcctgctttccaatgtctgaaaatgttattttcatctattttgttccatttccttatttgtggcaagaactctgttttacttgattattcttgcctggtcttttacctttttaaattgtctgtactgattgttttctatttggtttcttctcatatttggatttgtttcaaaatttatactcatgctggattttgtctggtttctttgttataatttattataaataataatttattttcagtttttattcttttcttttatagctatataatgataaatttccctctgaggattgttcgagtgtcatctcaccaagtttaatttaatatgtttttattatcattcaattcaaaatatttaatgtttcctcttctgattttctccttatccatgagttatttaaaaatgaagctgagttctgggaagcaacctagtaaacgacagtaatttctttttttgggttattattattattattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacagcagtccccacagtgtgatgttccccttcctgtgtccacgtgttctcattgttcagttcccatctatgagtgagaacatgtggtgtttggttttttgtccttgcgatagtttactgagaatgatgatttccaatttcatccatgtccctacaaaggacatgaactcctcattttttatggctgcatagtattccatggtgtatatgtgccacattttcttaatccagtctatcattgttgaacatttgggttggttccaagtctttgctattgtgaataatgccgcaataaacatacatgtgcatgtaaccgacagtaatttctatcatcagttaacagaaacagtaacttccactctttcaagttaagttctacataatttgaggaatcatcattttggcctttcaagataaataaatctgttactgttcctcgtcttctttgaactccacatgtccatttactttgaagcacacaataagaatgacatttcaaattcttggagccaaaggctatgaaaattattttggcagattttctaagatcatcacaggatctcagatactccaattggctaaatgagatttggaattgccagaagatctacaataggcaagattaaaaagtcctaagaaataatactcattgtctattgagttctgacatgctgtagaattccaaatccattagacaaacagatttccaataatttcttagaaataattgtaagtgtcttaaatagagccttgttttaaaaagtgatgaagagtcttgatgtaatgtctttggcaactctgagcttattttccttgacttaagtatttgaatgcttatggttatccaggttttcagttacaaatgactcattattttttatatttacatattacttaaattcttataaaatgttattgatcatatgcttgtctttttcttattctcttcccttttagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattagtaagtaatttattatgtttgtattgattatccagatgatacacaaaagtttactaactttagtctttttgtgggggctgatataatttcatttgaaaagataagaaaaaaaaacctgcaggaacaaagcagacatcaattttttttccttttcacattaattactcagatattagtctgtctttccattcaggcttttcctactctaaagcattctgtgttacagaaacaagttagggagctttatgtgtattctggtttaaactgattttgctttagctgagacctttatgactgttaatatatatctgttttataagattagacttttacatcaaattctttactcctagatacaaaagcaatgtttttattgaagatatggatgcctagtgcataacatcaaaataatttaaactctataatttgtagatttgacactgtaggatatgtctaatactgaatatcttccctcttagaaatttttcataaatatttaggtagtagagagacaaaatattcctagatggtaccaatttctgctctgttgtatgatttccctaccacactatctagatatttatgaagatttccctaccacactatctagatatttatgaaaattttctgggaacaattggttcaatttgtcttattttttgcaaaaccactcagtaatatgtgtgtgtgtgtgtgtgtgtgtgtatacgtatatatgtatatatatatatatatatatatatatatatatagagagagagagagagagagagagagagagagagagagagagagagagagatggagtcttgctctgtcgtcggccaggctggagtgcagtggcatgatcttggctcactgcaacctccattttccgttttcaagcaattctcctacctcagcctcctgaatagctgggattacaggcaccctccatcatgcctgcctaattttcgtatttttaatagagacagggttttgccatgttagccaggctggtctcgaactcttaatctcaaatgatcctcctgcctctcagtaatatatttgaagtaatatttaatatactcatgttaagtgaagtgaataaggtattcatgtatactgttttcattttttaatgtctgtgcttaatatgaggtctagtttacaaaaaatgttagtcctcataaaaaagctaattttatactaaatttttattaattattcttttaagattttcttattattaaagagaaaatgtcttgtataacataggaatttatattttcagtctttttctcctttttacatatgtctcaactacgaattagtttggactcttaatttacaaaattctgttatgattttctttaaaaaataatgtatacctgtaatggcctgttttattactagcattgtcataaatgctttagtataaatgaattaagaaaaatgtttttaaaatatattttggggcttaagcaatgaaaaaaaatgttgtgtagaaagatatactttcacttttgacaactattttacgacaacaaattctcaccagtcatagattatttttgtacggtacctatttattagtagatctaatcaataaagctttttcttcttagaatgggaaatactcagattgtttattagatgacattagaaatgacattctaaattttttatgcactagaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatggtaagtactggtttttcagaaattcattttcaaaatgaaaataaatctgttttccaattttaaaaatttgaattatatagaggaattgttaaggaatgttgattaaaatcaagatatctcctgatttgacataaactgggaaaagaagggagttttgaaaatatctctaaagtagtgcattaaattaatacttcctatgggccacctaccttccagatttgtgattataatataattgcttttgttaccctaaataaaagctttcaaattatttagaacctagcacttattaccaaaattatagttggttacaacttcctcagctaatttgtttttttaatttctactttacatcttctatcttgtgtgttaatttctgtactttctgagtgtagttctttattttctaaatttgaaaagttctgaagaccattacatgaatctcatttacgtttctcaatcagccatctatttttcagggttagaagaaggattggctctgtgggaaaacaagtatatgcagagtgttccaaggcaaagaaaaatatgtgcaaagctgtaaaaacaaaacaatatatttcaaggtggtaaagcagagtctatcctgctgaggctagatgggaggcaaggaaacaattatccagatcagctcaaggcatcatatcatttggattcattttatgactaatgaaaacccataaaagagttttaagaaaaggaatggtataatttgatttctagttttgttggattgttttcctggatgctgtactttttgtaggcaagaggcgacaccatgagtccaggtagggtgagaaagtgtggggactgagagagagtgatgataggggaggtgcagagcagaaggctgatttggaaaacatttaggtgatgaaaagtacaggtgatgttactaaatgttgggtgtgaaaaagagtgagattaagggactcacatgtttgttttcaattgttttctcacaagtatgtaggtaaatggcaataaccattttgtaaaatggtactgactggatagaatgcattttgagagggctttgcaacttttgacttggacacattatgattgagtcgccaatggaaaatcaaaactggatatgtgaagtgtggagttggatatgcatctagagaggagatatgcatttcggaatatcatcatataaatgatgacgctaaattggataagaatacagaatgaaaagagcaaagagctcaagatgaagccctgaaacattaccacatttatatataagacagaagagcaatagatagtaaagaaaatggggaaaaaaggaggacccagagaaacaggagaaaaaatctagaatgttgccatagacataaaaataaggaaattattaatgaaaaggtagtgtaacagattgcttaataagtcatcctgtctgaattctaattccactgcttgctgggcatgtatctttggccaacacagcaagtctatttgaagctttgttgactctttcttgttggtaaaatgtcacatatttacaaacagttctaatatttcaaaggattgtgttagttagcagactaaaatatttataaatatttattgccatagtgccttatataataaagtcaaagaagttgtaatttaattaccttaatatcattatcaaagtgataaatatttctaatttagttattatattctgttcagaaattgtgatggattaggtaaggtacaggccaatgacaagtgtaacaaaaatggattttaatagagtagaagagacagaccctacatagaatctgccaataaaaataatgagctagacattcaatacagactgtagacataactctttcaagattctggctttgaatctaataggaagatcagaatattgcttgaggaaagttgtgcactgaagggataattaaaagaaaaaagatggaagacaccagagcagatacagcaaaaggggagctgcaaaggctgaacacatgacttacatagttgccctgagaaaatgcgaggggaaaggactcacagctactgtggaggtattgtgctttggtggcaacaggactgcttacaaccttgtgacaggtggcaacaggactgcttacaactttgtgacaggagatgggaaggaaaatgagcagtaacgttggaaaatggtagaagctgatggattctgttttgaagtatgagacatggtcatctgagattgaatagtgtgtgggcgaaggaggaggaagagtactaggtagaatagaaaagttttgaaatagtcacagctgagaaagagaatgagtacattgtagatgaaaggcagtgtcaaaggtccagttaaatttgactcattcctgctgttgtaaacacctatcataggacaggagaaaatggtgaaaacacaagcacaggtctacttatccagagattttattctaatataagacagtggaaaactaaaaagagataagccaaatatccaagtaataaaaatatttaaaatatattttatgtatcactgtgtacagagaaatagaaaatccaataattgagatagaaaataggagggaaggaactggagatctgttttacataggaagtcatcgatgcaaagaatggttgaaagccatttgttatagtgagaagggtatgtgcaacagctgaggcagcgaagaacttgacctttttaataaaattcaaagatcataaaatctgaatcctggatttagtggaggagagagacatttgataacattggaagagtaggcatggatcataaagaggttgagttttgctctaattgagagggggaggcttaatttaagagactcataaatttcttttctgtgatgataggtaaatttaggttttatgaagccagaagcttttacaattttgaggggtcttcttcaaaaaagaacacaaaattgtgaatatattgcttcagtagtctttccaatcaccagacatgaaatgaaaacctaaaggagagaaagttggagtggcggacatagcagtagaagctgatgtagaaaatgtctttctattgcaaattgtacaaagacttaggatcatttgaacacataactaggaatttgctagtatagtacaggcctccaaacattaaacgaagaaataccagcttagtattcttttcaaatattcttctctcagccatgtaacagaaaactgcatgtggattgacagacatctgagtatatttcaagtgtcctaggaggtctcttctttgtggaaaggtttccacagaattgttattatggagcacttaagctaaataaggagtatgtatctcagagttaaaaattcatattaacatttcacatatctagtactaggacttagggttttgagttttagatgaagaaaaatatttctaattcatggagtgtccattcacattcttctctaaatcacgttttgtaagttattacctctatataaatacagcatttgaataatacccaataatcaagatcttaactttcctttttaagataatgcttttcacaatattacaacagacagaatttatataaaattagcacaaaatacgtgaacaaacacacatacaaaaaaaagaattgctatgtagaagattggtatagacttttaggagagaaatcccagtgattctcattcaagtgtgattttctcaaataatctgcaaaactcattaaaacaaacacaaaagcaaatttttgtagttattattttgtgacattacttttaagaatagttttaaatctaattttgtaattgtattttaataattgaggttatgatgtaattaattttctttttagtatgattctaatttatgaattctagcttgtacttttctaagttagcaagaaaggaggattctgaataagaaaaataatattttggataatatttagtaatgttgctgatttttaaaaattataaacatgtaagagataattttacacatttcttatctgaatcagaataattatcaaatttattaaacattgatataaatagtacatataacaaaaattgttatatgttaacataaatattcaggatacctagaatttgcctttccatgtgaacttgaaaatttatcttggtttgttttctttatttgtaatatattaattatgtgttttttatattttttttaacttaaaatatattagaaatgctattttgggttctttttccttgattacattaaacaaaaataccaattttaattaatttcttagtgcatatatcttcactaataaatctttgatgagaatttacctttttgtgatgtatatgtcagtcatcaagaattataaacatgatgagaccagaaatcatttgaggttgtttagtttcagttaaataaagttatcattgactctgcaatgacagatattataccatcattattctcgggatcctccccagttctattataaatttaacttcttaagatatttccatggtgttttatgatgtgttcttttatttttaaaattttaatttctatgttttatatgtttagatggtccaaatgcagttttgttgcatggatatattgcatagtggtgaagtctgtacttttagtgtattcatcacccaaatactgaacattgcacccattaggtaatttcttattcctcaccctcctgctatcctgccacatttctgagtctccaatgtctgttactcagcactctctgtccatatgtacgcattatttagctctcacttataagtgacaatatgtgggattttactttctgaatctgaattattttacctaaaataatggcctttagttttatacatgttgcttctgaaggcatgattttattctttttttttctttttattttttgttttggctgagtagtattctatggcatatatctataccacatattctttatccaatcatctgttggtggacaattagtttgattccatattattgctactgtgagtagtgaggctataaacatatgagtctgggtatcattttgatatgataattgatttcctttgggtagatacacagtagtgggattgctgggtgaaatggtagttctgtttttagttctttgggaaatgtccattctgttttccatagaggttgtactaatttacattcccaccaacagcgtataagcattcttctttctcctcactgtcaccaacatttattattttttgactatttgacagtggccactgtgtctaatgtaagatgataactcatttttttaattcgcatttctctgatgattactgatattgagtttttatttcatatttcttggtcattttcatgtcttcttttgcaaaatatctcttcatatcctttgtccactttttcatgggattattatttttttttcttgttgtgttgtttcagttctttgcagattctggatattagccctttttcagattcatagtttgcaaatattttcttccattctgaggttgtctgtttactctgtttattatttcctttgctgtgaagaaaatttttagtttaattcacaatcacccagaagcaggtcatttaattttcatgtatatggatagttttgaaaattctttatgatattgatttatagttatatttcaccaagttctgataagatacttgatattatttctaacctttaaaattttgggaacttgctttgtagctgtagcctagcatatggtctattttggagaatgttccatgcacaggtgagaaaaacatatattctgaggttgttgggtggaatgtcgttaaaatgtctgttaggtccatttgttctacagtccaatttaagtatgaggtttctttgtttatttttttgtccctgcaatctgtctagtatagtcattgggggtgtggaggttgcttgccctcattatattgctgtttatctttctacttagctctagtagcatttcatttatgaatctgagtgctgaggttttgagtgcatatatatttagaattgttatatcttcttgcttcctttatcattgtgtaatgaacttcttgtcttttttttcttgttgatttgaaatctttttttatatataaatataactataccaaatgctttttgtttctgttgttcaaaatatctgtctccatacctttaccatgagtttgtataggtttctctaagttaggtgggtttcttttgagcagcatgtggttggtttctgttttccaaatttggtccacaaatctatatcttttaagtggaacatttaatctatttatgttaaaagttaatattgtcatgtgaggttttgttcttgtcattatgttagttgttacctagctggtttgtagtcccaactgtgtaattttttaataagacctgtgagttttgtacttttgcatgtctttatgatagtgagtattgaccatctatttccatgttcaggactccctggatcatttcttgtggggtgaattcctaaagtggatttctagtggtgatgaacttccttagtattagcttgtttgggaaagactttatatattcttcatttatgaagtttagtttagcaaaatacaaaatatatctctaatatatgttttttcaataaatatgaactaatctttctttaagaaccctgaaaataggacaccaatatcttctggcttgtacagtttctgctgagaagtccactgttagtcttacgagatttccgttatagttgattagatgcttttctcttgctgattttataatttttcccgttcacattgactttagatagcctgatgactatatgtttgtagaagttcatctcgcaatgcatcttcctggtgttatctgagcctcttgtataaggatttctatgtctctagcaagagggcaagaggagataaattttcctcaaaaaggtttttttagctttttcttctccctcaagaatatctataactcttaagttttctcattttttagaacgtcatttttctcaaaacctttgctcattaaaaaatgttatttgctctttatttttgtctgacagggttaattggaaagacctgtcttcaagctctgagagcaagtttttctgcttgatgtaatctgtaattaaatctttcaactatattttgtaattcttcaatgaatttttaatttccataagttctatttgttttttaaaaaatatttttagtacatttttcattcatatcctgagttttttttctaatttctttgtgttgcttttcaactttctcttggactccatttagctactttaaaataaatattttaaattctttggtatttcaaagattttattttggttaggacttattgctgaagagttagtgtgatcctttgcgagtgttgtaatacgctgttttaaatcatacttccagaaatgtttcagtggtttcttctcatccagatgaactatcccttcttatttttaagtccagtttccaacagacaggattttttttttccctttgagaatatgactacgatgtatgttgtatagggctatttggtttaggttctgggttctttcagtggtaaagactctgtttgagtaccttggttagagataacttttgtatgatggctttcttaattgctggttgtagtagttatgtactgggtgtatgacgaggcttactgcctcctgaagggctggtatggaggactacgcagaaaactaaccttgttctgcatcatgccctagtgtcagcattttgcactgggctgtgcagttcaacattcaggacagtaggtggcacggacaggtaagagccagctgcagcagaggcagatgagcctatgcttgtcactgtttatgggagactctctgttgccccaaggaatggactgatctgtgaaaggtacagtggtctgaggagctggggacaaagcgggatagatctgtaccactaagctcacccttggatgctccaaggatgagcacaagcaccagccctgacaggggtgtcaggggaagaccctggggagatacccgtagcttgtctttcttgcaagcctggcttcattgggcacatgaccagtggagttgtagccaccccctaatacccctacaatgtccgtcctctggtgtgtctacaccagtctcctttgcgagtgaccacagctatgaacacagaattggatccacgggacatgttcccctctctacatccgtgcccaagcgctgggaccattgggctcctgggatggatctatactcctcccttgcagagccaaacaccgcgtctgcgtgtctgctggaagtggcgtagtcattttcagcccacaagcaggttgctcttgcacacaggaaagtgaatgctacagtcttctttgccacaaggggtgttcctttgttgcactttccattaggaatagcctccctggtggttaaactattgggaatgctgtaactcctttgggtccagccagctatgggtgactgccacatccaagcaggtgacagggaatatttgtgcggctctggtgttatggggacagagggctgaggttcctgggtaggaaacagtccccacatgagtgcactgcaggcatgaaacctaccactgcagctcaggcccaaggggaaggcagatgaccctattcaactagtagtttggtgtaatgccctcaagaagttcccaaatctccactcacaccagtgtgtgtgttcacgaagacagaagagctctctgatggcttggatccacacggtgagctgcagggagcccagaagactcctacctacactttctatgaggtcccacagggtcctagtcaacctttgtcaggctcttgcttctgtctttttccatgctttggcttctctccatggtttctctatgacgctcctgcaccctctcttaaatatttttcaagttatgatcatttacctgtaactttggttcttctttctgaggagaacttgtgtccaaactccttagtcagtcatcttgttttcaaaaagccccaattctggtctatatgcacttttcttttttaatatgagagagtaatttcatgttttgagtaaaaaaagtaatattaaatttcattaatgtcagtgattaaaactagattcattgtaaataagttgaatttacaaattaatttttagaacagatatatttcaataccataacatttataataaagttccatttcaatttagacagcatataaaacataatatgtagcattctttacagggaaaaggatttatctgatgcccctctgtatgacccaatatcaacctcactttattgtggcatatgtaaaattaactttggcaatgattaattatatattctcatgaaattattttacctttttcaagaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaaggtgaatgcttatcttacaattgctgaaataagaattagaactttgaataccaacttttttcttattaattttgtttgggctcccattgcctgtaatctaatgaattaagtcaaatatttgcctgtgaaggacatgtattgagtactgaatacctgagattcagtcacttaagttaatctccactgtttcttgaacgatgtgctggaagtattcccagacacacaggtgttgtcggtcttagtctactttaggtttatgtttctataaaggaataactgagtctggatgatttgtaaaaatgttttatttggctcactatactcatgactataaaattcaagatcgggcatctgcattcagtgagagccacagaatgctggtagaaagggaagaggagccactgtgtccagagaacacatgatgagagaggaagcaagagagagagcagggcagtgacaggctctttttaagaaccagctcttccaggagctaatagagtgagaactcaccctgagagggggcattcatctgttcatgagagatccatacccatgatccaaacatctcccattagaccccacctgaaacactggggatgaagtttcaacatggggttggaggtgacaaacatttaaaccatactagtggctgacaatggagggatttctttgttaattttcattttgcttgaaatgtcaacatccattctggacattttatatagtgtgggctgcaacttaagtttcaccgggtgtgtctaaacaatatttaagcagcttatattcaattcagttgcttgtattgattagtcaaactttatgttgatcaaatgcttgcctcagttatgatatttttccaaaatgttatgataaaatgtttccatgaaatgtaaaaattaacatgattttcataaccacatttgctaattggttttcttgcatctttaagatatctagaagtctgagcatattttaacattttaatataccttcaatatgacaatttagtataagtaatacaatatgaacaccattcttgattgtttaggatgctataataagttacataatgaagaatacatgaataaaagaagaaaatctttccattttactgaatttttatattgtaaaacagacaatttaaccattatttacatagtatttctactatagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattggtaatgtataaaatattaatatttaaacttgtcaaaacttttgtattttgtatctaaaacacatacatcatgttttcacaataaactttttttgtaaaatttacatagtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtgggtgagaatacccttcttaaatcaacatttaacaaagtttaatatttttattgtaacaacaataattgcaactatatttttgaaatttacagatatgcctcaacatttccagtcttcaatatgagaccaatcttttgcatattgcttataattcaatatgtgtctagaaagaaaaaataaagctagtaatataattttatgaatctttctgcgtctgataacagtattgtttatatttaaaagtgtgaagcaacattttacttacaaaaattgtcatgtgaggccagggtggttgctcacgcctataacctcaacacttcaggaggccaaggcaagaagattgcttgaggccaggaggtagacactagtgtgggcaatatagcaaaagcccatctctataaaaaaaattttgtaattagttaaggtgtggtggtgcatgcctgtaatccagctacttgggaggctgaggaggaatgattgcttaaggccaggaattcgagattgcagtgagctctattgtgcattccagcctgggcaacagagtaagactctttctttaaaaaacaaaaatattaaaaaattatcatatgattaaatatgagtactaattactgagaaattataacagttttatataaaatataaatattattgttattgtatggtattcctttttaggcactgagaagcaaagaaacaaagttgacaaaatacctacttactactctcccataggattcttttctctcttaaagcttccaaaagtgataatttttcagtttgttccatatcagccaaaataagtgaatgtgctgcagggttggtgggccacaggccctctacatcagtggtatagctgagtggcatgaggtagtcagggactgagtcaggacgtaaatctcattgacggacttcacactgtaaatctcatgtcttgatcagcaagaaggcaaggtgattcacttacagtgtgacttgagatgtacaatctttaaaatcattttgcctctttgatgactaaccgggaggatcttggggaccctcattcacttttctctaaactgagatttttcctaaagttttcctgggtcctgaattctaagagtcctaatgtccaatcatacttatttatccaatgaaatatccaatgatattttgtatttcccaaagaataaaatgtcttctgataggtatctctaacatttcagcgacagaatacagggcttatattttgacataatagcattttgatgcaatgtgatcaggaataacttggttggtgaaatttataatgattaagtcataattttaccatgctaatactatttactttataactatttttatgtaatagttggtttgattcctatcatttgaattttcataaaaatatatttattttatagcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaagtaagctcttattttgttttcagaaatgtattctatttctcatttggaaaagtaataggtatgtgtgtcttttaaaaactttagctatttattattacaaatgctactgaataaggcaggtaaactagaaactaatgaaaacactgttcctaatattaactgtgccctgtgaattagttacctttagtataaacacacacacacacacacgcacacacacacacacacacacacacataaaccaggcactacatgtcatcattactgttggaggaccagtgcttctcattccttttcttgtcaacaaatgttcctgtgcctatacctctgtctatgccaataactactatgtatctgtttgtatatgtctgtatgcatgtatgtatgtatctatatctatttctgttgattcatttatttaatctatctctctgtctattcatctacctgttcatctacctaatcatctatttatctattaatttattgttcatctatcttgaaaagttagtcatattgacacatacagtttcacttgaatagtgtaggttttattccagtcttctcatattttatatctgtattttgctatccaattgtgggtttccttgcctcactaacttcaatatttttaccaatgtctgccagtctaggatatacagaaagcattgacaaccaatacaaaaactaatctgctatcaacatttcaatatgtttagagtccttaaagaagcaaataatatatatatgcagtgaagtgtacatgttctacagttttttcttgaagttttatagttttagccattctatatagatttattaaaatgatcgtatagttatcgtcctttctgttaatgggatgcatcacctttactaatttgcctatgttaaacgacctttacatttcttggattaaacccatttgatcatagtgaatgatctttttaatgtgctgtaggatttgttttcctagtatagtgttgaggggttttgtacctatgttcatcaggggattttgcctgtagttttctttttgcgttgtgtccttgtctggttttggttccagagtaatgttgggccactagaatgagttagaaaaatgatctcctcatcaaatttttggagtcgttttagaagaattggtattagtcctttctaaaatgttgttataattcagcaatgaagccatcaggtcttggattttctttgatgggaaacattttattactgacttaatctgttgcctcatgattactctgttcagattttctatttcctctgaattaatcgtcgtaggctgtgtgtctagaaatttatccatttcttctaggttatccaatttgttggcatataattgctaataacggtctctcattatactttgtatttttttgatatcagttgtaatatcacccttttcatctccgatcttgtgtttctttaagccgtatctctcttttttagttattctggttaaagctttgtcaatttttgattatctaaaaaaaaactattttcattgatattttgtactgctttgggggctctattttacttacttttactctgatctttatgatttccatccttctactaattttggaattgactagtttgttcatgtttttctgcttctttgaggtgtactactagactgtttatttgagttctttccactttcttgatataggcaattattcctaaaaacatccatcttagaactacttttgctgcatcccataagttttgctacgttttgtttccattctcctttactgaaaatatttttaaatttatttaaaatggtttgaccctatgattgtttcagagcatattgtctaattttcacctaatttaaaattttccatagttcctcctattattgatttctcatttcatacctttgttgtcagaaaagtgacttgatatgatttcagtcttcttgaatttgataagacttgttttgtggcctaacatataacatattctggggaatattctgtgcgcatttgagaagaatatgtgtttttttgttatgtggaatgttctttatatgtctgtccaatctatttggtataaattattgtttaagtttaatgtttccttattgatattctgtctggatgatctgtctcaacgttgaaagtaaaatattgatatcccctactattactgtgttgcagtccacatctccattcagattcctaaatgtttcctttatatatttagttgctttgatgttgggtgcatatataggtttataatagttgtattatcttgacaaattgaccccactatcattatataataactttctttgtacctttatacaatttttcccttgtctattttgtctgaaatgagtataactacccctgttctcttttagtttttatttttataggtttttttccatgccttcactgcaatctgtgaatttacgttacagtgaagtaagtcaattgtaagcagtttataattggatattaatttttgatttatttagtcattctatgccttttgattatagaatatattccatttccatttaaagtaattttagataggtaaggatttatagtggtaatttgttaattgtgttctggttgtttttaaaattctttgtttctttcttgcttgctttattcatggtttgatgactttctgtagccatatgcttaggattttttcttttaatcttttgtgtatctattagatgttttgcttttggctatccttaggcttgcatagcataccttataaaaggctatttgaagttgtagttatccttaggcttgcataacatatcttataacaggtattttaagctgataggaactgaattttgattacatataaaatatctaaattttactctgctcctcccatgttttctatttgatcacatgctttgcatctttcaataattcgtatctcttaacaaagtttgtagcttcagctgttcttaccacttttgccttttaacctttatgctagctgtatttacccatcactattacagtattagagtgtttgaatttcatattgtgcttacttttactagtaagttttatactttaacatcttcatgttactaattagcatcctcttctttcaccttcaagaactccctttaacatttcttgtaaggcaggaaagtgtccttatgctctctcagctttttttcaatctcagaaagcctttatcactcctttgtttttaagacagaatagtggaatctagaattattccttggcagttgttttctttcagaattttgagtatatcattccacttccttatggcctgcaaggtttctgttgagtaatccactgatagtcttgtggaaattccattttatgtaaccattcacttttcattggcttttttcaatacttggtctataacttttgataatttgattgtgttatgtcttaaagtgactatctttcattaaacttatttgatttcctttgagatttctgggtgtgggtttctatttctttcccagttgttgaaagttttctgtcattatttttttgaatatattttctgtatcgttgtgtttctttctgtttttaacatggtgataatgcatacgttattccacatggtagtattccatctggatcttaagctatcttcacttttatttatttatgtgtttattttggttctcagatttggtgattttcagtaatttgacttcaagttcactaattccttcttctccttcatctagtctgctgatgaatacctctttaaaacttttccgttcagttatagtattctcaaatttgtgatttttgtttggtattttaaaaatactttctacctctttgttgaagtagttaatttgtttttgcattgctctcttggtctcagtgagtatctttatgaccattattttgaattctttcttgagtaaaacacctatatccacttccctcaggtcaatttctggagactcatcttgttcttttgtttggagttatgatatcttgtttctttattttctttaactcacagtgtttctatgcaatagataagacaatggcctttctcagtcttatcagactggcttcatataggagaaagacctcactaatttttccagccagagattttcatgtgcctctcaagtctttgtgcggactgctgtctcttattttttgtggccccctggaggttagaatgtgccacatcttttcaggacctgggaccaacaagttaggagccaggaggtctagatgtagctgaaaatattgaagacttggctgtgtatttacttacttctattttcatagtgaaagtgaatgtgcgtgtttatctcccactctctctctgtattacaccaagtaaagaatctgtggctaatacctgtactaatattcaggctgcatgctctgatcctgaagaggtatctgcttgaaatgagtccattgtattaccagctttttgtattctgtgatgtagggcctttcaggaatgcagatctctatcatctcccagtgtgagtttgttaaggagacgatctcttgagttggagctatagaagtgatgacctttgaatgcatggctaaacttggtccaggaagaatggataaatctgaatttatcattggggcgagactcatgaagtgccaaactttggctttggctgcgggaagattattttttgtttgcgtcattagataccctgtgcaagctcgatagaggccagttcattaagtagccagtggaagtatgtgccctaagccctttcgacagagaaatggaaattgaactttctctttccttttctgcactgctccaatttggcatagcgcctggagtttttacatagcattttaagaccatctatttgctttacgatctatggagactggtatttttctaatatctgctgtgacagttaagagttttaagaggagtccttttggaggtaactgtaaaggttgtagcacttgatggatgacacaaacctttttgaggataaacaggggagctgcattttaaaaaccttttctctgcactgctcttgggcaatgaagctcctggaagtgcttacacacccatataaaacgccatttcttttttcagtggtctagatagactctggatatattttgtgccctctactcccagaactaagagctttagaatacagtccctgaatgaaagttgtaaaagttagggcactcaagtttgtgtggacaaacttgttctaagagtgattaatgtacctggatgtatcactggggtgagccacgggaaccggctagagaagtgcctgatgcaagttcattagaatccagactgcaagttttttagaattcagacctctaagtagccacaggaagaatatatcataaaacttctcgggagaaacaggggactgttttttcagccccttctctgaactgctattaaggaatgaagtttctggaagctcttcagcacttgtatcataccaccatttttcctgtgatctagagagactctcatgtgtttaatctcctctgcttccaaaattagtgaattaaaggccaaaacacaggatgctttatgtgagatccaaaaacttctccacaaggagaaactgggtttttgagattccttttctaattgtgtggtgcagtgaacaaggctggggtccatgctccattgtgttgcaacttttcttacttgttcaatgtgaatgttgtctttgttgcctgttaagtaggagtccctttactggtctttcattttctttcaggaggagttcatttatgaatagatgtttttttaggacattcttgggtggaagaagagtcaggagcttccacttctgccattttgctgacatcactccctgcctagctctttattttacccccaggaaactagagtattgcaggtatcgttaagtgctcctacacaagcaagagagaaacctgtactttaggatgctcccccaaaagctaggatgatagatgcttagttcactcttatctttcctctctgagggagaagcagtcaaaatatattggtctctgtttactttagggggttgcaggaggctttgaactggtttcttgatttctcataaagggaattgtttccagtatcgtcattgaatcagtgtgcctgtggggggaagggagagtggtggcttcctatactggcatcgtgctgatgtcactgccctctttcatcctcaatattgatcattttttaaatcttgatcattgtttttactttgtcctcaattttattaatattttcaaaaaccaattgtaatgcctttaaattttctccatttgctctgtattttttagttttattatgttttactgattttagctttgctaattttctcccttctctgtgtttctttgtccgttttctcttcttcactgattttactgttttcttccttctgatgacttcagttttaatttcacttttctcaatcttagggtgaaaaatgaaaacatggtcataaactatcatactttgaaaatataaaactttaaagctctattcttttaagcactgctttagctgtgtcccagaatgttacacacgtgtgtgtgtgtatgttctatgtgtcgggagacagagagagagagttcatttttatttgatttgaaatattttctcatttgtcttgtggtttgtctgttgatgattaattatatggaagtttattgtttaatttcaaaatatttgtttttttctagataagtgatttttgctggtttctaatttaattctcttgtgaaagaatactgggaaaatttcaatattttgaaacactcagttttttaattgctcagcacatagtctaccttgctaacggttctatttacaaataaaaatatgcatacacactaaatgtagaattaggctatactgggtcacaatgttcttcaaatttatttgccatgtcacaaaatgttaaataatctctttcttaattgtttactatcagcaaatactttaaattaaataataatgattgtggtacacattaaaatcaatgggatacagctgaaacagagatgtatttagcattataacatgcatcagaaaaaacaaataaaaaaataaaagcaacaggtactacaatctagaaggtagacaggaatgtacacccaacaaaaatagaaggaaagaatcattcaagcataaatagttgaccattaatcttaagaaaaataaattgatgagaatgttaaaaacatgtcaaaatattgaaaaacagaaataagcaaaatacttttgataaatatgaaatactttatcataagcgaaaaaagaaaactcgacattatcaataacctttaatgaagttttgttcatccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaa

SEQ ID NO: 34 - DNA, 153084 bp, Homo sapiens
  source 1..153084: mol_type = genomic DNA
aggcggggccccggggcggagccaccggagcggcgcgggttctcaggtgagcgctacacggtcggggcgggcctagtaggcgcttcaggcttaggggcggaacagcgcgggccgcgcgggcgtaggcggggtatctggaggaggcgcagggaacctggagagggtccagccctcagtgccccggccagaggcgggaaggggctctagagcttcggtgagtggagctgcccgccccggactggggattgggggggcttgagataggggaccttggcccaggttcgagttccaggctccatccccattccgctgtgtgaccttggacaagtctctctccctctctgagcctcaacggcctcagctgtgaaacggagtcagggaaggtctgctgagagttcgcacagaccgaggtttggggaaggaacttctgccttcctcctctttgtggttgccttgctcaggacattggcagcaaaacgagaatggtgggagtgtctcttaagtctcgagtgaccttgagcaagtcccttgcccggagtcacactttcatcatctacaaaatgagtgggctaacctcttttaagatctctttactatttgggtgttattggtgtagatggagacaaggtgatgagcacccattcagcgcaatgcttcccctatgggggtgtgatagaatatcttctcctaggtttgactagcccctggcccgaattccccttagttcctggattctgtggttctatttgttctccatcgctccttgtaactggaggagtgacttcttccgagagtcacttggcaccacttcacagcagaggaacaccagtatcttcactggcctaaaatcaaagagtggttgcaaggaaaaatctgacattccaaccttttcgtttgtatttctgtggcagggaggcaagatgacttctctgccccaagcttggaacagctaaagggaaaaacagtgcaagatgagaacaacaaaggtctacaaactcgtcatccacaagaagggctttgggggcagtggtcagtatcgattggtctttagaggttttgtaagttggctgaggttctggtgtgtgcaatacctagaaattacacactgactcgtgtgacaattgaggctaaacaggcgactaaacagactaaagcagcaactgtcatacagtaacaataggaggatggcaggacccttctaatgcatttgcattcagacttttaaggaacattgtgaatgctgccggtttactacccttcatttgttgaattgcattattaattacaaatcttccgtgtatgttccataaaattccagcctgcactggtttggcagataagagaaactaaaatcgtttatcagtttttacattgagtgagagagaagtggcatagatgtgcatagagcaggtatgatcaaagcatgaacctttgcctggcttgtaggcatgggaagaaggagcaggatacagcatgttattctgcactgagctatagtctgagtatctactctgcttctaattttcctggtgaccttgggcaagctcctagtgtaccttatctgaaagttgaagggctttagaatagtttctcttaacatctattttttttcctttcttttcttttctttttttttttgggacacggtcccccatgttgcccaggctagtctggaactctagagctcaaaagatccttccacctcaacctcaacctccctaatagttgggattacaggcgtgagccactgtacccagctctccttagtgccttgaatccataaatctgaagaataaaagggcacttagtataatttttttttcttttgtaagggaataattttccattctgtcttaacagcattatttacttcagaaattggagttaacaatataatgaatctttttattttattttattatttattggcattttttttttgagacagagtctcgctctgtcaccaggctggagtgcagtggcgtgatctcagctcactgcaacctccacctcccaggttcaagcaattcttctgcctcagcctcccgagtagctgggactacaggtgcatgccgccacacctggctatttttttttttttttttttgtattttagtagagagggtttcaccatgtttcccaggctggtctcgaactcctgagctcaggcaatccgcccaccttagcctcccaaagtgctaggattacaggcaagagccaccgcgctggcatgagtctttttaacattgtattttagggtgtatttacttctacattatgtaggtataagcctccagaggggaaggactgccaaaaagggaaaacaatagtttctctatcatagagcattgtgaggcttaagtaaagtgatacatgtaatgcatttagcagagtgttagactctgtgctcaataaatgtagccattgtaattaccaggctacaggcattgctatatttaaactacaatttctgctaaaatgcacagtctattgttattactttgatgctgttgatgttgcctaaatatttgtggagtggaataaagcaaataacttttggcagagaaaagaatacaaggatacagtatatacaacgtatacaaatacatgtttttatgtataaaatacaaaggtagttagatgctgtatccagtcttctgcaagactataggtcaaaatacaactaacagctggacatggtagctcatgactgtaatcctggcattttggaaggtcaaggtgggcagatcacatgaggtcaggagttcaggaccagcctggccaacatagtgaaaccccatctctactaaaaatacaaaaattagccaggtgtggtggtgcgtgcctgtaatctcagctactagggaggctgaggcacgagaattgcttgaacccaggaggcagaggttgcagtgagccgagatcatgccactacactccagcctgggcaatagagcaagaccctgtctttaaaaaaataaaaaataataaaaaaaaaagaaacaaccaacagatatttattaggtgtatacctgtgccagacgtaatgattatgaatgccacaaggttctttgtccctaaagagttttcagtttggtaagatagacatgcaaaaaggaaatgataaaaccaagcagaaggggatatgttctcagggaccttaattcagactatgtaaattagggaggaagctccaaagagcatttgtcgtgaaactgtcagtggaaacatagcaaataaaattagggattgctgggtgcagtggtgtatgcctgtagtcacagctactcaagaggctgggacaggaggatcacttgggcccaggagttccagactatagtacattatgctgattgggtgtctgcactaagttctgcatcaatatagtgacctcccaggagtgggggaccaccagcttgccttaggaagtgtgaaccacctcaggttgggaacagagcaggtcaaaactcctgtgctgatcagcagtgggattgtccctgtaaatagccactgtacgccagcctaggcaacagcaagaccttatctctaaaagaaaacaaaaaaatttgggagtaagccaatgtttcattttactaggctaaatttttgttgggtctgattatatttgaaatctagataaacttaattgtcatgatattagcataattaaaggtgatgtctttccttgcaaattaaaacagcaaaacagtcattctgtctttatgcttctgagtttgcaatatttgatagagttctccccatccctagtagaggggcaggggtagataaacatgaaaccacatccctcttattttatttatttatttttttgagatgcagtctctttctgtcactcaggctggagtgcagtggtgtgatttcggctcactgtaacctctgcctcccgggttcaagtgattctcctgcctcaggctcccaagtagctgggattacaggctcccaccaccacacctggctaatttttgtatttttagtagagacggggtttcgccatgttcgccaggctggtcttgaactcctgacctcaggtgatctgtccatctcggcctctcaaagtattgggattacaggcatgagccactgctcctggactctctgaggttattttcttactcctgttagatctaaagatttattgtgacggtcacattaagacactgtttgggaaattctttgaacattgaataactgtaacgaattgtgctgtatctgtgggaaccagcctgttttgttcctgttatatgccagatacacaatatttgagggggtaaaaggctgtccagaagcctaattcccagatactaagggctgctctgcccctggaagcagtgcggtagtagaaagggcacagggtatggagacaaaggtacctgagcgccatcccactctgctgctgtgtagcttggtgttcctgtgtgaatccattagtcattgtaagcctcgtttcaaaatagaacctcatctgtcaatggggtggcaataccatcctgatggggttgtgaggaaccagtatgagaacatacagtgtacctaatgagtgtttttctacttgaagtggctgaattgtctttcagatgatgagctagttgtgaaccccaaagtgttccctcacatcaagcttggagacattgtagagattgcacaccccaacgatgaatacaggtgagtgtctcataggatccatggaactgggcaattcactgtttccaaatgatgtccaaggcagatagctctctttgcctttcaaaatgctcatgctgtgatggctcaatcctgtaattccagcactttgggaggctgaggtgggtaggtcatttgagcccgggagttcgagaccagcctgggcaacatagagggaccctgtcttaaaaaaaaatgatcatgccttctaggatttgatcaacaaataatttttcaaaagtggtccattccttcgtttttttttttttgagatggagtctagctctgtcacccaggctagagtgcagttgtgtaatctcagctcactgcaacctctgcctcccagccccaagtgattgtcctgcctcagcctcctgagtagctgagattacaggctcagcctcccgagtagctgagattacaggcatgcgccatcacgcccagctaattttgcatttttggtagagacagggtttcaccatgttgcccaggctggtcttgaactcctgacctcaggtaatccactggccttggcctcccaatgtgctgggattacaggtatgaggcaccgcacctggcctaatttttgtgttttttagtagagatggggtttcaccatattgtccaggcttgtctcaagtcatccatcctgctaggcctcccaaagtgctgagattacaggcatgagccaccataccgagccgttttttttgttttttttgtttttttttgttttttttgagatgaaatctcactctgtcacccaggctgaagtgcagtggtgggatcttggctcactgcaatctctgtcttccgggttcaagccattctcctgcctcagcctcctgagtagctgggattacaggcgcgtgccaccatgcttggctaatttttgtatttttagtagagacggggtttcaccatgttggtcaggctggtttcgaactcctgacctcgtgatccgcctgccttggcctcttaaagtgctaggattacaggcatgagctaccttgccgcgcccagccttttttttttttttttttttttaagagacagagtctcgctctgtcacccaggctggagtgcagtggtgccacctcggctcactgcaacctctgcctcctgggttcaagtgactcttctgcctcagcctgtcgagtagctggaactacaggtgtgggccaccacacctggctaatttttgtatttttaatagagacagggtttcgtcatgttggccaggctggtctcgaactcctgacctcaggtgatccacctgccttggcctcccaaagtgttgggattataggcatgagccaccgagcccagcctctttctggttttaaagctgagatgacaactgaaaggttctgtagcatttgtccatttcctttagtgcgtatggagtttctttgtttctttttttttttttgtgagacggagtcttgctctgtcgcccaggctggagtgcagtggcacaatcttggctcactgcaagctccacctcccgggttcacgccattctcctgcctcagcctcccaagtagctgggactacaggcgcccaccactatgcccggctaatttttttgtatttttaggagagacggggtttcactgtgttagccaggatggtctcgatctcctgacctcatgatccgcccgtctcggcctcccaaagtgctgggattacaggcatgagccaccacacccggcctaattttttctattttttagtagagaaggggtttcaccgtgttagccaggatggtctcgatctcctgacctcgtggtccacctgcctcggcctcccaaagtgctgggattacaggcgtgagccaccgcacctggccgagtttctttgtttctgagggagctttctcccgttgttgtgctgtaagtcacagaatggccagagtgacctatttgccttttgtcggggatgaaggttgctagggagttactgttcacggtatcccaactctcttgttgctttctttttcagccctctgcttttgcaggtcaagtctcttaaggaagatttacagaagggtaagaattatatcactcttcttagaattttttatttactgcctcagaaactgtaagaaatctctcttcataatttcaagggatgagggcaagtaattctcttcttttttaaacaaattttaatttaactttcaattcaggcagtacatgggaatgtttgttacatgggtatattgtgtactggtggggattgggcttctattgtatccattacacagtgaaccttgtatctgacagaacagatacagataaagaatgttgtatctgtgtcttaacattgtttttttttttttttctgagacagtgtcttgttctgtcacccaggttggagtgcagtggcgcgatctcggctcactgcaagctccgcctcctgggttcacaccattctcctccctcagcctcccaagtagctgggactacaggcacctgccaccacgcctggctaattttttgtatttttagtagacacgaggtttcaccgtgttagccaggatggtctcaatctcctgacttcatgatcctcctgccttggccccccaaagtgctgggattacaggcgtgagccaccacacccagcctgaacattgtatttttcaaccttcattctcttccctgtccttgtttttggagtcccaagtgtctattatttccatcccacttataggtaagaacatgcagtatttggttttctgtttgtgagttagttcacttaggataatggtggcctccaactccatccatgttgctgcagtggacatgattccatttttttatgactgtagttctcttcttatcaaactatgttgccactaaaaaaaaaattgtaaagtgacgcttatagtcctagctactctggaggctgaggtggaaggatcattgggtcccaagagtttgaggtttcaatgagctataacggtgccaccgcagtctagcctggtcaacagagcaagaccctatctcaaaaaaaaaaaaaaaaaaaaataggccaggcacggtggcttatgcctgtaatcctgggagtttgggcggctgaggcaggcggattgcctgagctcaggagtttgcgaccagcctgggcaaaacggtgaaaccctgtctctactaaaatacaaaatattagccgggtgtggtggcatgcacctataatcctagctaccctggaggccgaggtaggagaattacttgaacccgggaggcggaggttgcagtgagccgaggtcacgccactgcactccagcctgggcgacagagcgagactccggctcaaaaaaaaaaaaaaaaaaaaaatacacaacctgcctgttgcccaggttggtcttgaactcctggcctcaagtggagttcctgacaccttgacctcccaaagtgctaagattgcaggtgtgatccaccacatctgtcccattttttcacaaactatttgttaaatgcctactctgggtgagtagggattggggaggaagaaatatatattgatgatcgcccaccacattgtgcaaggtactatcctgggagctttgtgtaatctagcattatcttcccaacaactcttgagtgagtgaggaagtttattatctgccggactatacagtctaggcgtagccagaagcagtgattcctgcttacttattctggattcaaatcctttctttttccctctaatggctatgccatgctgttcaaggaaccaaaatgttaattgaaagtaaataagatactcttttaaatagttcttaagagaaaaaaacaaaattctgggttgctctaaagggctttgatggctgggtgcagtggctgacgcctgtaatcccaacactttgggaggctgaagtaggtggatcacctgaggtcaggagtttgagaccagcctgaccaacatggtaaaaccccgtctctactaaaaatataaaattagccaggcattgtggcgcatgcctgtaatctcagctactcgggaagctgaggcaggagaattgcttgaatctgggaggcagaagttgtggtgagctgagatcacgccattgcactccagcctgggcaacaagaacaaaactctgtctctaaataaataaataaataaaataaagggctttgatgtcacccactctttctttttttttaaagagatggcgtctcactctgttgcccaggctggagtctggagtgcagtctcacaatcttggctgactgcaacctgcgcctcctgggttcaagtgattctcctgcctcagcctcccaggtagttaggactacaggcgtgcaccaccatgcctggctaatttttatatttatatttttatttttttgagatggagtctcactctgtcacccaggctggaacgcaatgacatggtctcagctcactgcaacctccgcctcctggattcaagggattctcctgcctcagcctcctcagtagctgggattacaggtgcacgccaccacacctggctaatttttgtatttttagtggagacagggtttcactatgttgtccaggctagtctcgaactgctgacctcgtgatccgccctcctcggcctcccaaagtgctgggattacagacatgagccaccatgcccggcctaatttttatatatttagtagagatggggtttcaccatgttggccaggctggtctcaaattcctcaccccaggtgatctgcctgcctcaacctcccaaagtcctgggattacaggcgtgagccactgcaccattgcccctgccttttttttttttctttttccctttcagacagggcctctctctgttgtccagactggagtgcagtggtgcagtcacggctcactgcagcctcaacctccctgggtgcaaatgattctccatctcccacctccgcctcccgagtagctaagaccccagacgcccagcccacaggatcatgcctggctaatttttttttttttaatttttgctcaggctggtcttgaactcctgggcccaagcagtcctcatgccttggcctcctaaagtgctaggattacaggcatgagtcaccatgcctggctatccactcatatttaacaattcaatatttcaatttgaggagaaaacattctataaaacctggctactctggttacgctgcctatgggttatccctgctctgcaaggagcagtaaaaaaaaaatttaaagttttcatttttattgttatgttgtgtggtgttatgttttttatgttatgttatgttatgtttgttatgttatgttatgttattttgagatggagtatccctctgtcgcccaggctggagtgcagtggtgtgattttggctcactgcaacttccacctcctaggttcaagcaattctcctgcctctgcctcctgagtagctgggactacaggtgcgcaccacgacacctggctaaattttttttgtatttttagtagaggcggggtttcaccatgttggtcaggctggtcttgaactcctgacctcatgatctgctgagccaccacatgcagccaatttaaagattttaaaagaattctataaaaccttaatcctaagaatggccttcataccttccccttatctcctgccccatgttacgtttcttaccagacttaagggctcattgaaaaatttgtttcttctttaccactgataacttcattccaaagagaagatctcctttctcttctggagttttacaggtctttgaactttcttatcttccttcttatttaatttatttatttattgagacagagtctcattctgtcacccaggttggagtgcagtggtacgatctcagctcgctacaacctctgtctctggggttcaagcgatttgtatgcctcagcctcccaagtagcttggattacaggcgcccaccatcatgcctggctaatttttgtgtttttagtagagacagggtttcaccatgttggccaggctggtctcgaactgctgacctcaggtgatcttcctgcctagacctcccaaagtgctgagattacaggtgttagccaccatacccagcctcttccttcttaaattctttattttccctcccttctccctttttctctccatttttgttgattgcttaggctctggtcttatttcacctaaaaagcagagaattgtttaaattctaagctcctgaaaggaagagactgtgtgttgcccgtgtcagatgatcaattgtgttgcttactgagttgagtgtttatagattagaatatatggatctgctttttcaaaatatgttatctgagccagatattgtttctgttttagaaactatcagtgtggaccagactgtgactcaagtgttccggctgagaccttatcaggatgtctatgttaatgtcgtagaccctaaggtatgtctttgttttgtacttgaatatctttttggaataagcacccttcctcaaggttagattactaaggaaacaatgggttacttaagtgtagtgttagcctattaaatgtgtggcctgctaggtgtggtaatttcagtacatcaggaggctgagacaggaggatcacttgaggccaggagttcaagaccagcctgagcagcatagttagaccttgtctttattaaaactttcctttttcttttttttgaaatggagtatcactgttgcccaggctggagtgcagtggcgtgatctcggctcactgcaactggtgcctcccaggttcaagccattctcctgcctcagcctcctgagtagctaggattacaggcctgcaccaccgcacccagctaatttttgtatttttgtagagacagggtttcaccatattggccaggctgttcttgaactcctgacctcaggtgatccacctgccttggcctcccagagtgctgggattccaggtaggagctaccgcgtcctgcctactaaaacttttctaaaagattagctgggtgtgttgtatatgcctgtagttccaactacgtgaaaggctgcaacaggaggattgcttgtgcgctattgcacttcagcctgggcaacagaacaagaccttgtcttgtaaaactaaacatgtagaccatgggtggtggcccatgcctgtaatcccagcactttgggaggccaaggcaggcggatgacttgaggtcaggagtttgagaccagcctgggaaacatggtgaaaccctgtctctactaaaaatacagaacttagctgggtgtggtggcgcacccctgaagtcccatctactcgggaggctgaggcatgagagtcacttgagcccaggaggcggaggctgcagtgagtgagctgagatcgtgccactgcactccaacctgggcaacagcaatatcctgtctcaaaaaataataataactaaataaatatgtagcctacatgtcatttagaatgtaggcagtatgtaggttgcatttaaaacccaccaccacttttcttgaagcttgtcctaaccattttctgtatgtgaaactatatgtaaaactttctattaaaatactaacattttaaaatgtattctcatttttcttcaagaagtgatgttataatagataaaaattattgtccagaaagtactattgacattaatagggaaataaagtacataggtaagtgtcatgtttgtgtgccagaatccagactaaaatacagaatgagtcccccactacccatcacactcaatgtgctacagcagctataggatcagttgtagatttaccaactatactgaaaagtgtgcttttgcaggatataattctgttcatcagagttctgctactgaatggtcttccagtagttttcttttttgcaataagtttttttccatggtaagtgggcattaccttctgactataaagtgtggcaaagtaatgtcagagatatcatttgattattccttttaggatgtgacccttgacctagtggaattaacttttaaggatcagtatattggccgtggggatatgtggcgactaaagaaaagtttggtaagatgtgattttttttgaaagtctgttactttttccattatgtgaataatccctgtttattatgggagaagaatataaaatcgtttctgattttatatcagcatctacagacaattattgtcaacgtcttctgtgttcttccattctcttttcactgttcttttgatcttttgtttactgttacagatttttactcagcatttttggtttagataggaagttatactgtattttacattggaatagaaccgtacttttcaggttttcactttatcccatttgctcctcacatctcctcatggacaggtatttattatccctaatttatagaggtagaaactgagattgagaagttaggtaattgcccaaggctagatagtaagttgactcttggccaaaacccagatcctgtggcttccagatcacactgctttttgctataccctcttcccgttttccacatgtattcattgtttttttttttttctgagatggagtttcgctctttccccaagctggagtgaaatggtgggatcttggcttactgtaacctctgtcgtctgggttcaagcgattctcctgcctcagcctcccaagtagctggaattacaggcacccaccaccatgcccggctaatttttttttgagacggagtttcttgttgcccaggctggagtgcaatggcgtgatctcggctcaccacaacctcggccttcctggttcaagcgattctcctgcctcagcctccgcagtagctgggattacgggcatgcaccaccgcacctggctaattttgtgtttttagtagagatggggtttctccatgttggtcaggttggtctcgaactccagacctcaggcaatctgcccgcctcggcctcccaaagtgctgggattacaggcgtgagccaccgctcccagctttttttttgtatttttagtagaggtgggggtttcaccatgttggccaggctggtcttgaactcctgacctcaggtgatctgcccaccttggcctcccaaagtgctaggattataggtgtgaggcatcgtgcccggcccattttttaattattcatttgtttattttttttgagacagagtctcgctctgtcacccaggctggagtgcagtggtgcgatttctgctcactgcaagctctgcctcccgggttcacccattcttctgcctcagcctcccgagtagctgggattacaggcgcccgccaccacacccggctaattttttgtatttttagtagagacagggtttcaccacgttagccaggatggtctcgatctcctgacctcgtgatcgtcccatctcggcctcccaaagtgctgggattacaggtgtgagccagtgcacccggccccattttttaaaaaaaaatatttttattatattttaattgtttttttttttaatttttttttatttccgtgttactggggaacaggtggtgtttggttatatgagtaagttctttaatggtgattcgtgagattttgatgcacccattacccaaacagtacaccacacccacatttattaattttttaatgaacatttcaacttgaaaagattagttcatcagaattatgaactggttctgaaaattctcatttgaggtttttttttccattttgacactaatcaaaagaaatgaagtttttgtatactatgtaaccacaaattataggtagaatttccatacagggtatattttcaggaaaaatctgcttaattttaatttgttgagggttccattttctaaagtgagagataaaatgagaaacaacacaatatttaaatgagtatgtaaatgcagatatgtatgtaaacatatgtgaagatgaggatatttgtaaagctggtcatttatcatccacctggtctttgctattatctatacttgccaaactctttaagcacctactgtcatacctaccctaacaggttttcctgtgggtaaatctattactcacaagctagttcaactttgggttggtagaagagattagaaagctaggagttcttgtttgtgatttttcatggccttaatatgttaatcaatctctctctctttctcaccctctctccctccctccctctctctacccctctctccccctcctcttaggtcagcacatgtgcctatatcacccagaaggtggagtttgctggcatcaggtagatattacatcactcttgccttatctgtgcagtaactgggctacataaagcagtggaggcgtatggatgtccatataataaaatgtgtaaaagtataaaatgttagattgttggctggccacagtggctcacgcctgtaatcctagcactttgggaggccaaggtgggcggatcacgaggtcaggagatcaggaccatactggctaacacggtgaaaccccgtctctactaaaaatacaaaaaattagctgggcgtggtggcgggcgcctgtagtcgcagctacttgggagactgaggcaggagaatggcgtgaacccgggaggcggagcttgcagtgagccgagatcacgccactgccctccagcctggacgacagagcaaaactccgtctcaaaaaaaaaaaaaaaaaagttagattgttgtagctcaaacaaaccacaaaatgcactatagtagtttgaggcttattaatggaaaaagttgatgaagccccctggcattctgtaaaaaaggaagtagaaaaaaaaaaggagatagagactcgtaattttacaactggaaaaaccctagatgcacgtattgaatcatactttctcattttacaaattaggaaacaggtttagaaacataaaatgactggcacattggctcctgatttgttacctttttaactatattgctgtactcttgatttattaaaactatttctatattttagtttgtgaagaaaaaagagactttgtgaaatcccctttaaattcaaaaagtggctgggtgtggtggctcacacttgtaatcccaacactttgggatgctgaggtgggtagattgttgcttgagcccaggagttgaagaccagcctgggcaacatagtgagaccccatttctacaaaaaaatacaaaaattagctgggtgtggtgacacacgcctgtagtccagctacccgggaggctgagaggtgggaggatcgcttgagcctgggaggtagaggctgcagtgagctgggatcacaccactacactccagcctggatgacagagcaagaccctgcctcaaaaaaaaaattcagaaagtatttcaggtgcggtggctcacacctgtaatctcagcactttgagaggccaaggtgggctgagtgtgcttgagccccaggagttcaagaccagcttgggccacgtgacaaatagtctctaaaaaaaagagaaaaaaaaaaaaaacagccaggcatggtggtgtgcgactgtagtcccagctactcaggaggctgaggtgggaggatcgcctgagccctgggaggttggggctgcagtgagacattatcatgccactgcactgcagcctgggtgacagagtgagactgtctcaaaaaaaaaaaaagtacaacatgcacataattaagcattcaaataattcagaaaggtatctcatgaaatatacattcctctccccagaaacaacttgtttctttcctgaaatttactgtgtacacacaatcatatttatgtcttgtttttttgtttttttttttctgagacagagtcttgctctgtcacccaggctggagtgcagtggtgggaccttggctgactgcagcctctacctcctgatttcaagcaattatcctgcctcagcctcgtgagttgctggaattacagttacccaccaccacacgtagctaattttttttttttttttttgtatttttagtagagacggagtttcaccatgttggtcaggctggtctcgaactcctgacctcgtgatctgcccaccttcgactcccaaagtgctgggattacaggtgtgagctacctcacccggcatatttgtcttgttaactgacttgtggtgatcctaagcttgttcagtggggtcacagggtgcagtgtagtccctcgttataaagatccccatctacttttcttttttttttttttttttgagacaaagtctcactctgtcgcccaggctggagtgcagtggtgtgatcttgtctcactgcaacctctgcctcccaggttcaagcaattattctgcctgggcctcctgaactacaggcacgtgccaccatgcccggctaatttttgtattttcagtggagatggggtttcaccatgttggccaggctggtctcaaactcctgatctcaggtgatcccgcctcctcagcctcccaaagcactgggattataggcgttgagccaccgcacgcggcccccatcaacttttcacctaatggtttcatccattgaggattgttgtaagatggtgattttctttcctttttttggtgattttttaattaagtcatcccttctacatttattagccagaatccttctgtaaataatttttcatcatcaactaggtctatttgaccagaatgaaatactgatcctaaaaagaaagaaaggatagaggcttcattttttctcccaaaaagggtattttgaaacttgttgtggggagccaggtaaaatggctatggcgtgaggatcacttgaggccaggagttcaaaccagcctggacaacatagtaagacctcatctctacagaaatagtaatttttaaaaaattgctggttggctcacacctgtaatcccagcactttgggagactgaggcaggcagatcacgagatcaggagatcgagaccatcctgggtaacatggtgaaaccccatctctactaaaaatacaaaaatcagctgggtgtggtggcctgtgcctgtagtcccagctactcgggaggctgaggcaggagaatcgcttgaaccagggagtcagaggttgcagtgagccgagatcacaccactgcactctagcctggtgacagagcaagactccgtcacacacacacacacacacacacacacacacacacacacacacacacacacacacacacacacacagttaggactaggtgcagtggctcatgcctctaatcccagcactttggaaggctgaggtgggtagtttgcttgagcctgggagttcaagaccaacctggcaatatgctgaaaccccatccctacaaaaaaatacaaaaattagctggtcatggtggcgcttgtagtcccagttacttgggaggctgaggtggaaggatcacctaaatccagggaggttcaaggctgtagtgagccttgatcattctgctgccttctagcctgggtgacagagtcagactctggctaaaataacaataaaaaaaagaacgggggttggtgtcagggctcctctagtttgaggtacttgggaaacaggttggaggagcactgaagcacaggtcgatgctgcagtgagctattattgcattattgtactccagcctgggcaacagagtgagatcccatctttgaaaacaaacaaaaatttgttagcgggtcagtgttctttaaaacatccaagcaactaaagcacaacccaagaagtgactaaatctcaagcagcacaaaaaatgtaaccaaggtttatgcctccagtatcagcagatctctactggatgggtatccagggtcaggaagcctggatctgtatctgcagagccagtgtttagccatcactgtgattagtggttcgagtgatgttgggtaacttcggtaaacccttagtcttcacatctgcaaaatggagtagttggtttagaatattcttctgtcaaggaccagttaataaatattttagactttgtgagtagcaatagatctcaggtctattgcatattctgtgtgtttcgaccatttaaaaatgtaacagccattcttagctatgggccatatgaaaacaggagataggcgagaattggcttgaaggctgtatgtagtttgccagcctcggtttggaaacctattcagatctctctcatttttttttctattgcttcctcttttatttttaaattatatatatattatatatattatttctgagacagagtctttctctgttgcctaggctggagtgtagtagcatgatatctccccactgcaacctctgcctcctggtttcaagtgattctcctacctcagcctcctgaatagctgggactacaggaatgcaccactatgcccagctaatttttgtttttttagtagacacggggtcttgccatgttggccaggctggtgtcgaactcctggcctcaagtgatctgcacacgttggcctccaaaagtgatgagattacagatgtaagtcaccacgcctggctgatctctttcttttttaagttctttgtttctctatgtaaataccctcatacacacagttctagatggagaaaagaaaaccctgacagattgtcactttttaactttatttttatatatttatttctgagatgggcttcctctatcgcccaggctggaatgcagttgtgccatcatgcctcactacagcctcaacctcctaggcccaagcaatactcccacctcagcctcctgagtagctaggactacaagtgcgtgccagcatgcctggctctttttttgtttttgtttttgtttcattatggtagagacagggtctcactatgttcctcaggctggtttccaactcctgggctcaaacgatcctcttggctcagccccctagagtgctgggattacaggtatgagccaccgcagctggcctcttttagacttttaaagatctgtcctgatattttgctcaggcttggttaaatgtaaactacagtcttctatcttttctccagaagacttacagtatttctacactggatcaaaggttactttcttttgctgacttcgtgaatgcctgagaaaaaagatgctgtgggcctcctgtgagaaaaataaagtatagtcatttgtatagttaaagtcattacaaatggtcaaataatttccctgcaatttaactttcaatctggtaatagttacatagttaagaacacatgagccgggtgtggtggctcacgcctataatcccagcactttgggaggccaaggtgggtggattacctgaggtcaggggttcatgaccagcctggcgaacatggtgaaaccctgtctctactaaaaatacaaaattagctgagcatgatggcaggctcctgtaatcccagctactcgggaggctgaggcaggagaattgcttgaacctgggaggcagaggttgtggtgagccgagatcgtgccattgcactccaccctgggcaacaagaacgaaaccctgtctcaaaaaaacaaaacaaaacaacaacaacaacaaaaaatatatatatagtagcaaaatcttgtctcctgttgactaacattttgcttttaaaaaataatgaccttaaaccctagcctgttggatcacattgtaacttttttttttttttttgagacgagtctcactctgtcacctaggctgcagtgcagtggcgtgatcttggctctgcaacctctgcctcccaggctcaagcaattctcctgcctcagcctctcaagtagctgggatcacaggcacccgccaccatgcctggctaattttgtgtttttagtagagatggggtttcaccatgtttttcaggctggtcttgaactcccgacctcaggtaatctgcctgcctcggcctcccaaagtgatgggattacaggcgtgagccaccacctccagccacaccaagcttgttttagaggtcctgtgaatgtggggttctgacgattataagcagagctggctgggtgcggtggctcatgcctgtaatcccagcactttgagaggcttaagtgggcagattgcttgagtctgggagttcaagaccagcctagacaacatggtgaaaccccgtctttactgaaaatacaaaaaaattagctgggtgtggctgcttgtgcctgtagtttcacctacttgggagtctgaggtgggagaatcgctcaagcccaagaatttgaggccaccctgggcaacatagcaagatagtagatacggggttttaccacgttggccaggatggtctcgatctcttgacctcgtgatccacccacctcggcctcccaaggtgctaggattacaggcatgagccaccgtgcctgacctccttattacaatattaaagaaatacaagtctcttctgaggtcaggcttgtgacacttgttcattcacagacgtaactgggcaaaggagtatgaaaaagcatcccacttggtataagccatgggcctggtccagccttcttcattttggcatggggtagacccagagggattgattgattgtccagcatttcctaggtagcctgaactatgactcatggtacacagcattttcctggcttttatctgattttgtcttccttccttttttttttttgagacagagttttactcttgttgcccaggctggagtgcaatggtgcgatctgagctcattgcaacctctgcctcccaggttcaagcaattctcctgcctcagcctcccgagtagctgggattacaggcacctgccaccacgcctggctaatttttgtgtttttagtaaagacagggtttcaccatgttggccaggctggtgtcaaactcctgacttcatgatccacccacctcggcctcccaaagtgttgggattacagatgtgagccactgcacctggcctttgtcttccttttttatgaggactgattgcttaggtgaggcaggttgggagaaagagtgaaattggtagaagataagggcttgaggtggttggttgagggatgattgattacacggtgctcagctaatagctaccactttctctccaggatagcattttgtgttaatacctgctgtagttctagttcttgctagtaaactaattgagcacgccctatcctcacactgtcctgaacagtttccccacattatctggtttaatttgaaaacagctctgtagaaggctgggcacagtggctcacacctgtaaacccagcagtttgggaggccaaggcgggcggatcacaaggtcaggagttcgagaccagcctggccaacatggtgaaacctcatctctactaaaaatataaaaaattagctgggcatggtggcacgtgcctgtaatcccagctactcgggaggctgaggcaggagaatcgcttgaaccagggagtcagaggttgcagtgagctgagatcgcaccactgcactccagactgggcgacagagcgagactacatctcaaaaaaaaaaaaaaaaaaaagtgaaagcagctctgtaaggcgtaggcttcattgtctcttttgttttgtttgtttttttgttttgttttttgcaatagtctcactctgttgcccagactggagtgcagtggtgcgatcacagctcactacagccttgacctgtgaggcccaagcgatcctcctacctcagcctcctaggtagctgggactacagcatgtgccaccatacctgcctaattttttgtattttttatagcgacagggtctcactatgctacctaggctggtctcaagctcctgggctcaagcaatctgccaaccttggccttccaaagtgttgtgattataggtgtgagtcaccgtgcccggcccattgtctcatttttaaagataatgccactgaacctcatgaatttactatggccattcacgtagtaagtgtcactcagctgggattcttgcctagaccagtttctcttcaggccagtcaagtctgaaagccatgctttactttttctactgtactattcactttttttttttttttttttttgaggctgagttgtgctcttgttgcccaggctggagtgcaataacacgatcttggcttactgcaatctctgcctccggggttcaagtgattctgcctcagcttcctgagaagctgagattataggtacccaccaccatgcccatttaattttttgtatttttagtagagagggggtttcaccatattggccaggctggtcttgaactcctgacctcaggtgatccacctgccttggcctcccaaagtgctgggattacaggcatgagccactgcacccattctcgtactatctacttcttgccctcaaaaatgcatggaggaaaaaacatcattcccaaaaatgtaataccaagttgctattagttaattattattatttttttttttgagacagagtctcgctctgttgcccaggctggagtgcagtggtgcgatctcggctcactgaaacctccgcctcctgggttcaaacggttctcctgcctaagcctccctaagtagctgggtctataggtgccaccatgcccagctaatttttgtatttttagtagggatggggtttcgctgtgttggccagggtggtctcgaactcctgacctcaggtgattcacccgcctcagcctctcaacgtgttgggattataggcatgaaccactgcacctggccctaagttttttttttttttttgagacagtctcgctctgtcgcccaggctggagtgcagtggcacgatctcagctcactgcaacttccacctcctgggttcaagtgattctcctgcctcagcgtcctgagtagctgagattacaggcgcatgccaccacgcccagctaattttttttttttttagtagagacatcatttcaccatgttggtcaggctgatctcgaactcctgacctcgtgatctgccctccgtggcctcccaaagtgctgggattacaggcgtgagccaccatgcctggccaagaagcccttctttagacctatatgtggactcccagattaagagcccctgttcatattcagtatagtatgagagttctttatattggataatctgttcacggagttctctggaaatctgtaaccagttaggtcatttgagtataagtagcagagccacctgaagttgcccctatttctttttggtttgttttatttttattttttgagacggaatctcactctgttgcctaggatggagtgcagtggcatgatgttggctcactacaacctctgcctcgtgacttcaagcagttctcctgccttagcctcctgagtagctgggactacaggcatgtgtcaccatgcccggctaaattttggatttttagtatagatggggtttcaccatgttgtccaggctggtctcgaagtcctgacctcaggtaattcgcccgccttggcttcccaaagtgctgggattacaggcgtgagctattgcaccaggcatgtattggtttcatgtaagacttgtaataacttgtgtgtgtattctttcagagcacaggctggtgaactgtgggttaagaatgagaaggtcatgtgtggctacatcagtgaagataccagggtaagatttataaaatgcttttttggttttatctctccatactattatggctaagtcctaaaatcaaaaataaaacaagggcggggcaggacaccaaggtgggcagattgctttatcccaggagttcaagacaagcctgggcaacatggagagacccacctgtacaaaaattagccaggcatggtgatgggtacctctggtcccagctattcaggaagctgaggtggaagaattaccgggatcctaggagttcgaagctgcagtgggtcatgattgcatcactgcactccagcctgggcaacagagcaagaccccatctcaaaaacaaacaaaaaacacaaacaaacaaaaatctgctaagctcttgacagctactctttgcccacatgtaatatcaagttctcctgaaactgttttacagttggatttctccagtttggagttgatcttcattttcttctgaaggggtctgtttaatgtcaaacagagagctagagtatctggcctgcattatgccatgcccactcatacatagcaaaagttaagccccatggaagatcatgtcataaacatgaagagagacctttgccaatgaacgttacccatgctggtaaaactgtatgtctaccttttctcgttcccatctccatgccttctctgagagcagtggttttcaaccaggggtgattttgctcccttcaggggtcttttgacaatgtctaaagacatatttggttgtcacaactgaggggttgtgccattggcatctagtgagaatcctgctaaacatgctacacgtccagagcaggcctccagagcaaagagttatctggcccaaaatgttaatatgttgtgggggttgtcttgtgcattgtgggatggttagcagcatccctggcctctactcactagatgccagtatcacctaccacccttcaccctacaaatctacaagttatgacagccagaaatttctccagacatgccaaatgtcctctgaaaggtaaaatcacccttggttgagacccagtgtatccttagagggaaccactccatgaacttcatttttgtaatttcctattgtttacattggatgtatttacattgtttgtaaatacatgtatgtttgtgcgtgtgtgtatacacatgacccaattaattgccagagtgctcaccataatcgtgcctttgctttcctgcaaaggtgtctgaaaagtgagacttagctagtttataaatgctggggtgaagagtattccaggcaaaggaaacaattttcagaagtcagtgtggtggaagtattgcagacaggtagggagaatgatgttggtgaggagataggcaggttccagccagttcatgcagggccttcaaggtggttagaaccagtttagagtgtttctaaggagaattagaatccattgatgggttttaagtgggagagtgatacttgaattatgcttttaagagatcactactcattcagttgtgttttgttgaataaaaccctccaaatcaccggctctaatggccaaaggtcaacttttctctgtcatgtaaaagaaatcatggatatgtaattcatggttggtacaatagtgtcactattattggcgtccttgtgtcttattgttctgctatcctcagggtaggaattccatgatccaccaagagctgatataatcacctccatattccaggcagaggagagaggaagggaagagagacaagagaggtgtaccttcccaccaagtcaacttcctttatggacacaacacttccatttaaatcatgatggccagattttagtcacttgtagctgctgaggaggctgggaagttttgtctttcagttgggtctcttgccttccagaacagaatcagaagaagggaagaatggataggcatttagcattaagtgctgcagcccttctggctctggtatagagagttatttccagggtcaagagtaaaagcagataagtgagttaggaggcccgctatagtctagcaagaaaatggtggtgtggactaaggtgagagctataacaatggaaggatgtgggcaggtatgagacacatttctggatagggtccacagaacttgctcatagattggatgtgaggagtgaaggaaagagaagtactgaagagctaggtagatggtggtgccatttatgagatggggaagacagggaagaagcaggttggggagattaggaagctctgtttgggaaaagtcttttggatgcctgagtggaggaatcactggaggcagttgagtctggagttctcgtaatcacttctcccatgtgttgttccccactgccccccagtgtcctcgccacgcaaaccactcattgttccccaacatgccaccttctctcttgccaccatgtcttcgcacatgctgccctctgtatcctagggtgcctagaccctgcctttccccttcccaagccactcatccaggtctcagctctagtctcaggattccctgcttctggagagccttcctggtccaccaggctggaagtacctccatggcaccctggatctgtgcactcattagcagttcccacactgcagtaggtgcgcttgcttgtgtgccatgtcactggactgtgtgcgccctcagagcaaggactgcatctttaacctttatatgccactgttctctggcatgtctactggcacctagtagtctctcaaatgttggtggagtgaaatattagataggctcccctgcctcaagaattcatcatctgggccgggcgcggtggctcacgcctgtaatcccagcacttgggaggccgaggcaggtggttcacctgatgtcgggagtttgagaccaacctgaccaatatggagaaaccccgtctctactaaacatacaaaattaactgggcttggtggtgcatgcctgtaatcccagctacttgggaggctgaggcaagagaatctcttgaacccgggaggcagaggttgcggtgaaccaagatcgcgccattgcactccagcctgggcaacaagagcgaaactcggtctcaaaaacaaacaaacaaacaaaaaaaaaaaaacaaagaatttattatctgattagagaaacaagactttcaggttttccattaaattaattatttttgagattggggtcttgtgttattcaggggtccttcctgggctccagcagtccttttcagtatctgggattataggcacatgccaccacaccaatcagaaaaacatgagtttatttatttatttattattattttttattgagatggagtctcactgtgttgcctaggctggagtgcagtggcgtgatctcggctcactacaacctccgcccccggggttcaagcgattctcttgcctcagcctcctgagtagctgggactacaggcatttgccaccacacctggctttttatatttttagtagagatggggtttcaccatgttgcccaggctggtctcgaactcctgacttcaagtgatctgcccacatcagcctcccaaaatgttgggattacaggcatgagccaccacacctggccaaaaaaatattaaataagatggagctgaacatggtggctcacgcctgtaatcccaggactttgagaggccgaggtgggggggattgcttgagcccaggagattgagaccagccagggcaacagagggagaccccatctctaaaaagaaaaatttagccaggggtagtggcccacacctataatctcagctacttgggaggctaaggcaggatgatcacttgagcccaggagtttgatgttgcagtgagctatgatggtgccactgcactcctacctgggagacagagtgagaccttgtctctatgaacagacagacaaaaacaactttaattattaagaaccttgcatatttattatgataacatttagacaatatagcctatatttctgttcatttctctgaaaaaaatttttttttttttttttgaggtggagtctcactctgttgcccaggctggagtgcagtggtatgatcttggctcactgcatcctcagcctcccggattcaagcgattgtcctgcctcagcctccccagtagctgggattataggcgctcaccaccatgcctggctaatttttgtattttagtagagatggggtttcaccatgttggccaggctggtctccagttcctgacctcaggtgatccacctgcctcagcctcccaaagtgctgggattatgggtgtcagccatcgtgcccggccaggagcttcagtctttaaggagcaggtctctgatgaactaaaggagtgttaagagatttacattttacgttccctctaaacttctttagagccttgtggagcaaaggctctgtggtatagcacacagggctagaaaaccacttttgcttttccttgaggcagtctgagtgtagtggaagtacaatgtgaattataatttattagactggcaactcatcacctggcacatcttagcccaagttctgtctccgtaatgagatttccataactttcctaggtagattcactgccctttctcctgcatttcatgtgtaaatcttcatagaacctttgtatatgttgcagtgttctgcatgtttttatcttgtactgtaagctcctggagggcagggaccagatcttattttcactgtctctgaaacagggctcagagttaagagctcagtaactatttaaatgaaacaaagaatgctcggatgaagtttgcttttagaagtcccaagtcatggccccgagctgtggctcatgcttattcccaacacttcaggaggcaaaggtggtgagaggtgaagccagctggacttcctgggtcgagtggggacttggagaacttttctgtctagctagaggattgtaaatgcaccaatcagcgctctgtgtctagctaaaggattgtaaatgcaccaatcagcactctgtaaaatggaacaatcagcgctctgtaaaatggaccaatcagcaggacatgggtgtggacaaataagggaataaaagctggccaccccagccagcagcggcagcccaggtccccttccacatggaagccttgttcttttgctcttcacaatatatcttgctgctgctcactgttggtgagcaaaggtggtccgtgccacctttaacagctgttaacactcaccatgaaggtccgcagcttcattcttgaagtcagtgagaccaagaacccacctgaaggaaccacctccggacacggtgtgaggattgcttgagcccaggagtttgaaaccactctgggcaacgtagggagaccccctctctacaaaaaaatacaaaaattttgtggcctggtggtgcactcccatagttccagctactcgagaggctgaagtgggaagatcgtttcatcctggagcctgggagtttgaggctgcagtgagctgtgattgtgtcactgcactccagccttgggtggcaagagtgagatcctgtctcaaaacaaaggaaaaaaagaagtccaacattgcaagattcttttatcattgctttaaaaaaaattgtggttaaaaagcctatcataaaatttaccatcttaaccatttttaagtgtatagttcaatagtgttaagaacatttacactgttgtgaagcagatcttcagaactttttcatcttatagaactgaaactgtatatggcattgctttttaatacaattgtgtttttatttcaggtggtgtttcgttctacgtcggctatggtttacatatttattcagatgagctgtgaaatgtgggattttgatatttatggtactgtgtctatgtgctgattgtaactgctaaggggagaattttctggaactgcaaatgctaattcatgaatgcccagggtcccccacatcatcttctaacaaactttaaatatcattgtgagaataatcatatttggaggttagagtgttttctcgttctaaagatacactacttttttcaataatcaaatttttttcaaactgcattgtatgttgaagtcatagcctcttagtagtgaggcagatattaaatttggcttcaaaaaataaagaaataaataaacttggcttcttagtttgagaatgaaaccactttgtacatctggcttttatgatcttgttttaagatgtacaaaacaggccgggcacagcggttcatgcctgtaatcctagcactttgggaggctgaggtgggcggatcacctgaggtcaggagttggagaccagcctgaccaacatcgggaaaccccatacctactaaaaatacaaaaattagctgggcttggtggtgggcgcctgtaatcccagctactcaggatgctgaggcaggagaatcgcttgaacctgggcggcagtgagccagtatcatgccactgcattccagcctgggagacaaagtgagactcccatctcaaaaaaaaaaaaaaaagatgtacaaaatacaccttctttttggtcccctttcttatagaagaagttgcaagcagtttacttagggaattgcttagagaagaatttacttagagaagaaattagagaagaaattgcaagcaagaaataaagattgttctcatgttctcatccttttttcattgtttcttttcaggggatttgtattttgagaaagctgtgaatggtttccttgctgatctatttaccaagtggaaggtacatttcttcttacacactaagtctcattatgtaaacattactcaatcagatttttaaaatgcactgtttttattaaattgccctaaattgagctattttaggtaaaacccggactccagatttaaattaccctaataatctcaatttatgagaatttatgaaaaacacaaagctaacatcacactcaatggtaaaagactgaaaactttcccccaagatcagtaacaaggtaagtatgcttgcttttgccactgatattcaacattatactaactagaagttctagacagaccacctaggcaagcaaaagaaataaaaggcatccaaatcgaaaaagaagtacaactatttctattcacagataatatgatcctatatgtagaaaatcctcaaactccacaaagtaagtattagagctaatgcattcagcaaagtttcaggatacccaatcaacacacaaaatcaattgtatttctatataccagcaataaacaatctgaaagaataaaatacttagaatactttaccctaggagctgtaagactggtccactagaatctataaaacactgtgaaaggagttaatgaagacctaagtaaatagtaagataacctgtgttcacaggttgaaagacttaatattgtgaatttggcaatactacccaaagcagtttacaggttaatgcagttcctatcaaaataccagtgccttttttttttttttctgatcctaaaatttatgtggaattgcaagggatcctgaatagctaaaacaatcttgtaaaaggggaacgaagttggaggactctcacttcctaatttcaaaacttactaaaaccctcagtcatcagaatagtgtgatattggcataaggatagatatatagatcaatggaattgaattgaaaccaacccgtacatctatggtcagttgattttagacaagggcatcaagttcatttaatgagagaaagaatattctcttcaacaaattattctggaacaactgaatgtccatatggaaaagaacgaatttggaccctcacctcaaatcatatatgaaatgtaaccaaagtgaatcaaagacttaaatataagagctaaagtcatctgggtgcggtggctcatacctgtaatctcagcactttgggaggccgaggtgggcggatcaggagtttgagaccagtctggccaacgtcatgaaaccctgtctctactaaaaatacaaaaattagccaggcgtggtggttggtgcctgtaatcccactactcaggaggctgagacaggagaatcgcttgaacctgggaggcggaggttgcagtgagccaagattatgccaccgtactccagcctgggcaacagagtgagactccatctcataaataaataaataaagagctaaaattataaaactgagccaggtgtggtggctcatgggaggcggaggtgggcagattgcatgagccctggaattgcagaccagccccagcaatatggaaaactttgtctccacaaaaaatacaaaaagttagctggatgtggtagctaaaaaaaaaaaaaaaaaaaaagggaaaaaattttccttatgtttaaaagttttatttttattttatttatttattctttttgagatggagtctcactctgttgcccaggctggagtgcagtggtgcaatctcagctcactgcaacctccgcctcccaggttcaaacaacctaaaaaaaagaactgaatttttttttaagagacagggttttgctctgtcctgtcacccaggttggagtgcagtggtacaatcatactgtaacctgaaattcctgtgctcaagggatcctcttgcctcagcttcttgagtggttgggactataggcatttgccaacacagccagctaaaatttttgtttttatttttgtagagacagggtctcgttttgttgcccgggctactctttaacttttgttttcaagtgattctcccacctgcctcaattctccacctgttcagttctcctgcctcaccctcctgagtagctgggattacaggtgcccgctaccatgcccagctaattttttgtatttttactagagacagggttttaccatgttggccaggctggtcttgaactcctaacctcaggtgatccgcctgcctcggcctcccaaagtgttgggattacagatgtgagccaccgtgcctagcctaaaaagttttataatttttttttttgagacagggtctcactgtcacccaggctggagtgcagtggagcgatcatggctcactacagctttgacctcctgagctcaagtgattctcctgccttagccttagtagctgagactacaggcatttgctaccacacctagctaattttttgtgtttttttatagagatggggttttgccatgttgcccaggctggtctcaaacccctgagctcaagcggtcacccaccttggcctcccaaattgctaggattacagatagaaccaccatgcctggctgggaaattcatataaccttgaatttggcagtggtttcttagatataacaccaaaagcacggcatccaaattaaaagcagttgaatcagacttcaaaattaaaaacttttgtgcatcaacggacattgtcaagaaagtaaagaggccagacctgctggctcacacctttaatcccagcactttgggaggctgaggtgggagaatcgtgtgaagccaaaagttcgagtaacccagacaacaaaacgagaccctgtctctacaaaaataaaaatagaaaaaaattagctggctgcattggcaaatgcctctagtctcagctactcaagaggctgaggcaagaggatcccttgatcacaggaatttgaggttacagtatgattgtaccactgcactccaacctgggtgataggacagagcaagaccctgtctctttaaaaaaaaaaaaaaaagaagaagaaaaaagaagacaacccacagaatgggagaaaatattatttgcaaattattttctgataaaagtctgttatccagaaaatatgtagaacttctgtaactcaagaacgaaaagaaaaaaccctaattgacaaatgggcaaaggctgccccattcaccatgatgtgattatttcacattacatgcctgtatcaaaacatctcatgtaccccacagatattaaacacctactatgtacccataaaaattaaaaaataattaaaataattaaaaaaacaaatgggcaaaggacttgaatcaacatttctctaaagaatatacatgaatgtccaacaagtacatgaaaagatgctcaagatcattagtcattaggaaaatgcaacctaataccacaatgaaatgccacttcacacccactaggatgactgtatttttttttttttttttttttttttttgagacagagtctcgccatgttgcccaggctagagtgcagtggcgcaatcatagctcactgcagccttgatcgcctgggctcaagccatcctccctcctcagcctcctatagtagctaggactacaggcatgtgccactatgcccgggcaattttttttttttttttggtggaaactaggtctcactatgttatccaggctgatctcgaactcctgagcttaagtgatcttcccaccttggcctcccaatgtgctgagattacagacgtgagctacagtgcctagcccatatttttttttgagacagagttttgctcttgttgcccaggctggagtacaatggtgtgatctcggcccactgcaacctctgcctcccgggttcaagcagttctcctgcttcagcctcccgaatagctgagattacaggcgcccaccaccacgcccatctaatttttttgtgtttttagtagagacggggtttcaccatgttggccagggtggtctcgaacttctgacctcaggtgatccgcccgccttggcctcccaaagtgctgggattacagacgtgagcctccgcgactgggcccatattctttattttatttatttatgtatttttagagacagtctcgctctgtcgcccagactggagtgcagtgctgcgatctcgaacatggctcactgcaacttccacctcccaggtacaagcgattctcgtccctcagcctgccaagtagctgggattataggtgtgcgccaccttaccctgctaatttttgtatttttagtagtgatgtggtttcaccatgttggccaggctggtctcgaactcctggccttaagtgatctccccaccttggcctcccaaagtgccggattatgggcctagcccgtattcttgacagcattattcatattagctaaaaagtaggataacacaaataacaaatgtctgtcagctaaagcatagataaataaaatgtatatccatacaatgtagtattattctgctataaagaagaatgaagtactaacacatgctacagcatagatgaatcttgaacacatgttaagtgagagaagccagacatagtggatcaaatacaaatcataagatcttatttatatgaaatgtccagaataggtaaatatataatatagagattagtggttgccagggactgagggtggggagtgactgtttcatcagtttgggatttcctgttggggtgatgaaaatgttttggatccaaataatggtgatagttatacaacattgtgaatgtattaaatgtcacgatggcaatatttatatgtattttgccacaattaaaaaattatttcattcgattatctcaccttgatttcacatgaaaacattttgatgaaaaagtatttgaagtcacattatgtagtgtaaaagagtagagtttggattaaggcagactgggttttaaatgatctcatcagcttgcttttttttttttcttttttgattaagagacagagtcttgctatgctgcttaggctggtcttgaactcctgggctccagggatcttgtcacttcatcctcctcagtagttgggactacaggcgcaggccaccatgcctggctgattagctttttggtctccaaggattagtctctgaggctccatttcttcagctgcaaaatggagataataatagaccctctcaccacatcacttatgagttgagacactccatgcccatatcagcccattgtgagcccgttgtgttttcctgtatatcacttgcactaaaattagataagggtgctgattttggagctcttggactcccgtgaattaattggcagtcagtgaaggtctgctgtttcctagcactctgctctgggtactgtggcttgtatttaggaatttctgtccacttgagatacatccatgaaatgtacattatattatgtgccttatatagtgagtgttgaattctgtagtcactaagcatacttaagataaagatggggttggtcagtataggctgttgtcttcagagacccaggaggaactgaaactgcgcttgctagctaactgttgcaagccacttttgatgttcatctgtaaacaccctacttctaggatattgatctccagactccatggaaatgtttattctcattagtccctgtccctgtccaaaggtagttctttgccttggcttataccgctgagtccagagcaaaccccaccctcatcctatgagactagtagggtgtgggagtgcctttgattcttaaatccaccaccatgggtgctgttcttgttccctagaccacaattctgcagaaattaaaaaacactgtaggcctggcattgtggctcacgcctgtaatcccagcactttgccaaggcaagtggatcacttgagcccagcctggggattatgatgaaaccctatctctctttttttttttctttttttttttttttttgagacggagtctcgctccgtcgcccaggctggagtgcaatggcacagtcttggctcactgcagtctccaccccctgggttcaagtgattatcctacctcagcctcctgagtagctgcaatttcaggcgcgtgccacattgcctgggtaattttcctacttttagtagagatggagtttcgccatgttggccaggctggtctcgaactcctgacctcaggtgatccacccgcctcagcctcccaaagcaccgggattgcaggtttgagccaccacgcccagccgaaaccctgtctttataaaaaatgcaaaaattatctgggcctggtgacgcgtgtctgtagtccagctactcgggaactgggagacagtcaccattacttaatgctgatttgcagttttccaatcactttccacattcctggcactttagataactttcctaaagtcacatagtggcaagtttcaggttcaggactccatctagggcttctgactcccagcagtgctctgtcccctgcactgcagcctataattacctgaagctattcaatactgtgcactgctgctgagccacctggattaagaatattatgtgcagctgggcctcacacctgtaatcccagcactttgggaggccgaggcaagcagatcacttgaggccatgagttcgagaccagcctggccaacatggtgaaaccctgtctctactaaaaatacaaaaattacccaggtggcccacctgtaatcctagctactctggaggctgaggcaggagaattgcttgaacctgggaggtggaggctgcaatgagccgagattgtgccactgcactccagcctgggcaactgaatgagactgcctcaaaaaaaaaaaaaaaaaagggctgggcacagtggctcacacctgtaatcccagcactttgggaggccaaggcaggcggatcacgaggtcaggagatcgagaccatcttggccaacatggtgaaaccgcatctctactaaaaatacaaaaattagctgggcatggtggcgtgcgtctgtagtcccagctacttgggaggctgaggcaggagaattgcttgaacccaggaggcggaggttgcagtgagccaagatagcgccactgcactccagcctggtggcagagtaagactccgtctcaaaaaaaaaaaaaaaaaaaaaaaaaagaatattatatgcatgcagtctgcttcatagtgaagtaaatgaaacaaacttcaaccctgttgttctctactcatgcttaggagaagaactgtagtcatgaagtgacagtggtcctgttttctagaactttctatgatgcaaaatctgttggtgagtaactatttctctcctacagttatgtttttgttaagcttcccccaaccccaccccagccatttcctttcatttttttcctcgttgcacttttccacccttcccatcttttctgttatggggacagtgtaaaagggaaagtagcacagtccgttagtggatgcaagaggtctgtgggctgtgattcatcttaaaaccaacttaatagatagacagttggctgggtgcagtggctcacgcctgtaatcccacgactttgggaggctgaggtgggcggatcacctgaggtcaggagttgaaaaccagcctggccaacatggtgaaaccccatctctactaaaaatacaaaaattagccaggtgtggtggcatgcacctgtagtcccagctacccaggaggctgagaaaggagagtcgcttgaattcaggaggtagaggttgcagtgagctgagatcttaccactgcactccagtctgggtgacagagtgagaccttgtctcaaaaaaaaaaaaaaaaaaaaaaaaaaagacagttatctttatttttttgtgatgcaaatctttaacccagaagaggaagctgacaaaactgaatttctcttctcagcctgaactacatactccgttttctctatttcagatgaatttcctgaaataaaccgagcctcaattcgacaggatcacaaggggagattctatgaagacttttacaagtatgtttgggtgctttgctatactttttatttatttattagttgtttctttcctaacttaaaaataagtcagcctgggcaacatggcgaaaccctgtctctaccaaaaatacaaaaaattcgcctcttgtggtcccagctacttgggaggctgaggtgggaggatcacttgagcctgggaggtggaggttgcagtgagctgagatcacaccactgcacaccaacctgggagagagtgagaccctgtctccaaaataaataaataaataaataaataaataaaccttttaattttgtaattgtaatgattttagatttacagagaagtttcaaagataacacagttcctgcatggtctttgctctgtttcctctaatattaacatttcataaccaagttacatttgtcaaaactaggttaacattggtacattactattaaggaaattcagatgttttttagattttagcactcgtacttgccgtctccaagatatcatgttgcatttagaccttctaaatgttttattgtgaaaaatttcaacattcagagaagaagagcaaataatataatgagcccgtatacccaatacctgaatttaacagttattattttgtcatatttgattcatctgtttttttcagtgccattgactaagtaaattatcaatattgtaatattttatttctatacatattcaaaaaaggcatttttatatctgaccacaatatcatgatcatgtttaacgttattattattattattattttttgagacacaatttcactctctcgcccaggctggagtgcagtggtcatgtaagctgactgcaaactccgcctcccaggttcaagggattctcgtttctcagcctcccgagtagctgggactacaggcgcccgtgaccacgcctggctaatttttttgtatttttagtagagatggggttcgccatgttggccagcctggtctcaaatcctgacctcagctgatccacccacctcggcctcccaaaatgctgggattacaggcgggagccaccatgcctggctgacaccactatctaattgagatgattatcagatagtaatagttactgtttttacgggacttagcatgaatgggttactcttctaagcactttacatgacttgatttatttaaatatcacagcatccctgtgggatagatactgttaccccattttacagatgtggaaatttggacacagagtttcagtaacttatccaaagtccacacaatattaagtggtggagcatggacctgacacagtcaatctagttcagagtcgatgctttttgaccactgtattcctcaacctcatacagattatactttaaattatttgttgatcttttgttggatcctgtacccctaggagaattttatgagagtgatgggccatctgctgtactgacacctccactcatccccttatgcagatgaattctgcattcctctaattcagtgaattccaggaaccatgagagctcttctgacttaacagtatatgcagttttatctgtataatgaatatgaattaatttgagcatgatcagttatacaaaatactatataaagcatgaatatgaatatatgaattatgaatgtagatttataggtgtatatgactatatatttttaatatatgaaagtttatgtcattaaaaagtcatcctcaacgttttttagattgagagaaactggttatctttttcttactgcaaaaacaatacaggttcattttaggaaaatcacaaaataggccaggcgtggtggctgatacctataatcccagcactttgagaggccaagccaggcacattgcctgagctcaggagtttgaaaccagccagtgcaccatggaaaaccctgtctctacaaaaaaataccataacttagctgggtgcagtggtgcgcgcctgtagtttcagctatttgggaggctgaggtgggaggatcacttgagcctgggaagttgaggctgcagtgagccaagatcatgccactgcactttagcctgggtgacatagtgagaccctgtctcaaaaaaaacaaaacaacaacaacaaaagcacaccagtatagtttagtagagaggaattcaaagcacactcaattccatctaccaaatatagtcttcattactttggtgaatcaacccctattatctgtatttaggagaaaaattagttttcatagagatgtgatcacacattccatgtgatttttttttttttttttttttttgagatggagtatcactctgttgcccaggctggagtgcactagcgtgatctcagctcactgcaacttccgcctccctagtacaagcaattccctgcctcagcctccggagtagctgggattgcaggcatctgccatcacacctggctaatttttttatttttagtagagacggggtttcaccatcttggccaggctggtcttgaactcctgacctcaggtgatccaccgccctcagccacctaaagtgctgggattacaggcatgagccactgcgctgggcctccatgtgatttttttacatgttttattgtttttatttctttttgagacagtgtctcactgtcacccaggctggagtgcagtggtgcaatctcaactcactgcaaactccgccttccaggttcaagcaattctcctgcctcagcctcctgagtagctggtgtgacaggcacccgccaccatgcctggttaatttttgtatttttagtagagacagggtttcaccatgttggccaggctggtctcgaactcctgacctcaggtgatccgcctgccttggcctcccaaaatgctggcatgagccaccacgcctgacccatatggttctctttttatatgttttaaaccttcattttctttcatttcctttttttttttttgagtcggagtttcgctcttgttgcccagtctggagtgcaatgacacgatctcagctcactgcaacctccgcctcccggatgcaagcgattctcttgcctcagcctctcgagtagctgggattacaggcatgtgccaccacacctggctgattttgtatttttagtagagatggggtttctccatattggtcagtctgatctcaaactcccgacctcaggtgatccccccaccttggcctctccaagtgctgggattacaggcgtgagccactgtgcccggccataaaccttcattttctatttactgtatcacaaatgccaatccatgttaaacacactgctccacagtatctttttttttttttttttttgaggcgaagtctcgctctgtcgcccaggctggagtgcagtggtgggatcttggctcactgcaagctctgcctcccaggttcacgccattctcctgcctcagcctcctgagtatctgggactacaggtgcctgccaccacacccggctaattttttttgtattttttagtggagacagggtttcaccgtgttagccagaatggtctctatctcctgacctcatgatctgcctgcttaggcctcccagagtgctgggattacaggcgttagccactgcctggcccactgtatcattttttatttctacatagaaattacattgggttactattgttgaaaattgaggtgacttccagcttttcactattctcaacagtattgccagtgaacatttttacagataggtttttaagcatatccttagtttttatgataaattgccagaaatggagccattaggtcaaaggatagtctgtgttttcaaggctttctatttgtacagccagtgtatgctccaaaaccattaaagtagaagatcttgttttcctagcagcaatttctgtgttctcaccaacagtgagtgctctttttttttttgagatggagtctcgctctttctcccaggctggagtgcagtggctcgatctcggctcactgaaacctccgcctcctgggttcaagcaattctcctgcctcagccttccaagtagctgggattacaggtgcctgccaccacacccagctaatttttgtatttttagtagagatggggtttcaccgtgttggccaggctggtcttgaactcctgaccaccttatccacctgcctgggcctcccaaagtactggaattacaagtatgagctaccatgcccagcctcttttttttttttttttaatgcttctttcccaattggattggaagaaaaacaagctcactgaatcttttttttttttgagacagagtcttgctctgtcaccaaggctggagtgcagtggggttatctcagctcactgtactccaattacactctttttgaaaccttgtaaagaacctgatgttctgtatgtaaagttgctgtattagtccattttctcactgctgtaaagacatacccaagactgggtaatttataaagaaaaaaggtttaattgactcatggttctgcatggctcaggaggcctctggaaacttacaatcctggtggaaggcgaaggggaagcaaggcatgtcttaccatggtgaagcaggagaaagagcgagctcaggggaaactgccccttttaaaccatcagatatcgtgagaactccctcactatcacaagaacagcatggaggaaaccacccccatgatccagtcacctcccaccaggttcctccctcgacacatgggtattacaatttgagatgaaatttgggaggggacacagagccaaaccatatcagctgctcaatatccattttatgataatactcttttcagagtggtggtgcagaatgagagaagagaagaatggacttcacttctcgtaaccattaaaaaactcttcatccagtatccagtgttggtgcgactggaacaggcaggtactgcattcatgtaatagatggtgcggcggggaaaggaagtgtaggaggggtctgggagacagagaagagatgtgtgcttgtttctctcccattgccgtgtgtagtttctgcttttggtcagggttctgtttccagttggatccaattgtacatttcgtatgccgtaagttcaacagtgtccctaatacagggagtgaggccttgtggagccagatgccttccttttttttttttttgagacagagtctcactctgtcacccaggctggactggagtggagcaattatactgtaactttaaaccactggggctcaagcaatcctcctgcctcagcctcccgggtagctaggacgacaggcatgcactaccatgcccagataattttttcatttttttgtagagacaagagtctcgctgtgttgaccaggcttgtttcaaactcctcgtcttaagcgatcttcctgcctccaccttccaaagtgctgggattacaggcatgagccaccatgctcagctgccacttatttaagagttcatctttcagccaggtgtgatgtctcatgcctgtaatcccagcacaaggcaggcggatcacgaggtcaggagttcaagaccagcctgaccaatatggtgaaaccctgtctctactaaaaatacaaaaattagccttgtgtggtggcgtgcgcctgtagtcccagctactcgggaggctgaggcaggagaatcacttgaacctgggaggtggaggttgcagtgagccaagattgtgctgctccactccagcctgggtgacacagcaaggcttcgtttaaaattaaaaaaaaaagttcatgtttcatgagatgtttttctttctcttgcatattttgcttcagagggctttcctcaaggagataattctacctcagcacaaggaaactacctggaggccatcaatctgtcattcaatggtgagtaaggatgccggccatgagccagcatcttgcctaccacatggctatgttaccggaaaggtgtcctgatccagaccctaagagaaggttcttggatcttgcagaagaaagaattcaggaccagtccacagaataaagtgaaagcaagtatattaagaaagtaaaggaataaaagaatagctactccatagaaagagcagggcattcccgaaagcaagaggaggaacacgtccaccttaggtacagtggttgtttatatataacaaagcaaaaagtcatgggggagagatgctctgccgcaagcactcatgacaaaggattgttcatctttgtgtaactgctgtctttctcaagaatctatattattatctttaaagcaaacttactttttttttttttttttgagatggagtcttgctctgtcgccaggctggagtgcagtgatgcgatcttggctcactgaaacctcccactcctgggttcaggcgattctcctgcctcagcctcctgagtatctgggattacaggtgcgcatcaccacgcccagctaattttgtatatttttaggagacacggggtttcaccatgttggccagcatggtctcgatctcctgacctcatgatccacctgcctcagcctcccaaagtgttgggattataggcatgagccacagcacctggccttttttttttttaaatatactttaaattctgggatacacgtgcagaatgtgcaggtttgttacatagatatacgtgtgccatggtggtttgctgcacctatcaacccatcatctgcattaggtatttctcttaatgctatttttttttttttttttctgggatggagtgtcgctttgtcatccaggctggaatgtagtggtgcaatcttgactcactgcaacctccgcctcccaggttcaagtgattctcctgcctcagcctcctgagtagccctcagcctcctgagcagctgggactacaggtgtgcaccaccatgcccggctaatttttgtgtttttagtagagatgaggtttcaccgtattggccaggctggtctcgagctcctgacctcgtgatccacctaccttggcctcccaaagtgttgggattacaggcatgagccaccatgcccggcctttttttttttttttttttttttttttgagacagagtcttactctgtcgctaggctagagtgcaatggcatgatctccctgctcagtgcaactcccaggttcaagcgattctcctgcctcagcctcccaagtagctgggatcacaggcacgtgccaccacacccagctaatttttgtgtttttagtagagacagggttgtaccatgttggtcaggatggtctcgatctcctgacctcgtgatccgcccaccttggcctcccaaagtgctgggatttctggtgtgagccactgcacctggctgcaaaacttactcctaaactaagaatgcttttgtttttaagatattgggacatcagggcatttcctgggtctattaagtcctgagtctgttggagaaacattattatcctgttcccttaactgtaaacaccctgtgactaagaatgtctaacctcctaggaatgcagactagcaggtgtgagcctcattttacccagcccctattcaagatggagttgctctggttcaaaggcctctgacagctatgcatgtctctttatgaatgcctgcagacccagacctaggtgatgatgcccccactcacctacccccaaaattaatttaaagcaatagcttctcattggatggttgtaatgaccaacatttagctcttgggtcttctgttggccagttaatttggtagtcatttgcttctcatggtcaggaactggaaggatcttccttgggttctttgacttactcgaactgtgttattattttccaccccatccctcaactgcttctaggtaatattttaaaaatctacttaaaaaataagaattaaaataaaaattttaaaaaattaaaatctactttaaaaaaaattacaaaaatagccaggtatggtggctcacacccataatcccagcactttgggaggttgaggcggacagatcacttgaggtcaggagttcaagaccagcctgggcaacatggtgaaaccctgtctctactaaaaatacaaaaattagccagcatggtggcgcacacctgtaatctcagctactcaggaggctgagacaggagaatcacttgaacctgggaggtggaggttgtggcgagcagagatcacgccgctgcactccaacctggttgatagaaaaagacactatctcaaaaaaaaattcttttttttttttttaaataaataggctggctgcagtggctgacacctgtaataccagcactttcggaggcttaggcagcgggatcacctgaggtcaggagctcaagagcagcctggccaacatggcgaaaccccatctttactaaaaatacataaaaaacttgccaggcatggtggtgcatgcctgtcataccagctacttgggaggctgaggcaggaaaatcacttaaacctgggaggtggaggttgcagtgagctgagattgtgccactgcattccagcctgggtgatggagttagactgtctcaaataaatgaataaataaataataaataaaattgtaaaagtaaccatgttactagaatttgaatatggagaggtatatcaagtaaaaaatgatacccttctcctgctccccagtgtgagtccttttttaaggggaaccattgttagcagtgtggtatgattatcccggcatttatgtgttagccgaaatatattgtttgcaaataacagagatgtactgatttagtttaaacaaaaagcgaaatttactgtaaggatacagaggcttaaatggagcagccaggaaaggctcaaacaccatgtcgaagaaccttagtggctctgggaaccatagcagcaggaattatgagagccatatttcagcttccagcaaccctgtctctgctctctgttcagaatttacattcctggtagagagggtctgatctgttcagctccagttaggtgtccatctgccactggccagaggtggaagtgatgatacgcgtacacatcactatgtatatcatcttcccacatgtctgtacccaggtgctcagggaattctagagcataatgtcttctattagtaaatcttcttgtcatattggaatatcactgatttttcatagtaagaatcatagaggctagaaataaaaagtgacttgccagatttacaaagtcatcccaagattttggtctactcttttaaatagtgtcttaaattaatactaatataatctaattatatcattaatatatataatattaaaataatatataatatataaaataatataatcaaagttttactacagattcatttatggaaggtttaaattaacagcatgaattttttttttttttttttttttttagacaggttcttgctctgttgcccaggctggaatgcagtggcacgatcttggctcactgcgcctctgcctcctgggttcaagtgattctcccatctcagcctcccacatagctgggattacaggtgcacatcaccatgcctggctaatttttgtattttttggtagagatggagtttcaccatgttggccaggctggtctcaaactcctgatttcaagtgatccgcctgctttggcctcccaaagtgctgggatttcaggcatgagccaccatacccagccctcacagcatgaaatttgagcatttaaggctgcacagggcaagtatgaggtgtcaatgaggggtattaacaaaggtgacagcgacttattcctgtggtcaagtagttcttaatatggaagagaaaagacagatgcgtatacatttaactagaatgtggcagttgctataataaaaatatgggcagaatgctctgagagtgtagagatgcttgtctgtgacagggttctgaaaagctgtaacatcattattgtggaatttttgttttatttctagtgtttgataagcactacatcaaccgcaactttgaccgaactgggcagatgtcagtggtgatcacgcccggggtgggtgtctttgaagtggaccgcctactcatgatcctgaccaagcagcggatgatagataatggtaatgctctctggtttgtgccctgtctccacatgttcctagcctgatttccccttagaactgtgagcttcactgacttcttagagtgtgaggagctctacatagtgttctgtgtgtcacaacgtctgtggatgtcaataggtgtcaggtgctaaaatttcatggtcaaatcagtttgggaaatgctgggtcatgcaaagataagcaggttccataatgacaggtcttcctcagtttttaatatgttagtgtaggttgtttttctctaaaggttgtgtcagggtactctgagttccccaaacatatttggcactagagaagccttcctggagggatgatttcaagggacccatgtgctgtcagccgattttctttctttctttttttttttagacggagtctcgctctgtctcccaggctggagtgcagtggtgtgatcttggctcactgcaagctccgcctcctgggttcacactattctcctgcctcagcctcccaagtagctgggactacaggcatccgccaccatgcccggctaattttttttgtatttttagtagaggtggagcttctccgtgttagccaggatggtctcgatctcctgaccttgtgatccgcccgtcttggcctcccaaagttctaggattgcaggcatgagccaccacacccagccgctgtcagcccattttcagatgcactatcaggtcatctagtccagtccttcctccatgatgtgcctcgtatccccaactcagccccacaccccccaatttgatttgtttcatcaacaagatggagttgggacgctgaggcagtagaattgcttgaacccagaaggtggaggttgcagtgagccgtgatctcacgccactgcatgtcagcctgggcagcagagcaagactgtcaaaaaaaaaaaggagtttggaaagtaaatcctgatgccactaaagaagctctgttaagtgatgtggattgttttactttttactgagatattacaaagttactgttcctttctggccttaaaaatttaaacatggaagtttggttgtctttttttaaacaagtcatgacctgtaggacagtcaaaggctaattgtcaagcaccgaataatgatacgttagtagggcacttggaaaagaggaaacagacaaaatgaatgtatttacttctttgttggataggcagcactatgaggttataaatcatacaatggtaagttagctttgcctactacccatttaaataacatgatttatagatagggacacttgtctctgccattccctccccacaattctttttgtcttttctttttttaggaattggtgtggatttggtgtgcatgggagagcaaccgttacatgctgtcccattgttcaaggtaattagatttcggatttgtttactaaaggccagttggagtatagttagaaagagaaaaattccaggcgctgtggcatgcacttatagtcccacttactcgagaggctgaagtgggaagatcccttaagcctaggagtttcggtatagtttgctatgaacatgcctatgaataaccactgcactccagcctgggcagcaaagcaagactctatctctaaaaaaattatttttgagacgatgtcttgttcttgtcctccaggctggagtgcaatggtgcgatgttggctcactgcaacctctgcctcccgggttcaatcagttctcctgcctcagcctcccgagtagctatgattacaggcgcctgccaccatgccaggctaatttttgtatttttagtagagacggggtttcaccatgttggccaggctggtcttgaacacctgattgcaggtggtccgcccgccttggcctcccaaattgctgggattacaggcatgacccacagcgcccagccctaaaaaattttttttaaaaacctgaaaaacagaaaagttagagcagttccaaaacctacttgttctgtagcttatctgtgctctcatttttctccttgcagctccataatcggagtgctccccgtgattctcgtctgggcgatgactataatatccctcactggataaaccacaggtgggtgcgatctcgatcaatagtaggtgataagcgttttgaacagcttccttgccatttttctttaaatctgttaagttcttattatggcactaaaccttttgttaagaaaatgtggaaaccaagttctaacatttgctcaaagctctgtacacacaaagcagtagcagtatcataggaacagtctatggtgaaaaagaataaaaacaaaatttgaaggacttacttcctctgcagttcccatgtccttctattcccaactcccacagactgtagaagaccaacatttgtacctgacctccttcagctctagagaagtccccgcgcctctttacatggaatcctgctgattccagctcagggatggcttttctcatccctctgccagtgccagtgcctcatctttttgaactatgacactaatcttattccacctacccttctcctgaaaatgcctattttcttccaagatccaactccagcatctctcttttatgaattcctcctgtgctgccctgatagctaacagccactttttcttcagtgcttccagagcattctatccttctctgggttgtctttctttctttcttttttttttttaagacggagtttcactctgtcacccaggctggagtgcagtgacatgatcttggctcactgcaacctccaccacccgggttcaagtgattctcttgcctcagcctcctgcgtagttgggattacaggtgcctgccgccacgcccggctaatttttgtatttttagtagaaacgagatttcactgtgttggccaacctggtcttgaatagcaagttcatggcaaagctgcagctattagtttatactatttgatatcatgatattagactgtttttgacctacaaaagtagcaatttcaggccggtcacagtggctcatgcctgtaatcccagcactttgggatgctgaggtgggaggaatgcttgaggccaggagtttgaaaccattttggtcagtgtagccagactctgtctctaccaaaaaacaaaacataactaatgttttgtagtgaattcttgtaaaagaagttaaaattgggaagattagtgaagctgagaacaaagcccatgtcaggagggctgatccatgcctagtattttaactgtgttttgagttttaaaataaagggaatttagattaatgactctgtttgtttcttttacagtttctacacatccaaaagccagctcttttgtaatagtttcaccccacgaataaaactggcaggaaagaaggtaggtttttatttttgttaagacggggtcttattatgtggtccagtcttatcttgagctcctggactcaatcagtcctcctgtttcagcctcccaaagtgttgggattacagacatgagccattctgcccagccaagaaggtagatttcattaatcagcagagagcctttgtggactatcacgcattgatagggttattttagtcctgaggtaccctcatctttcccaatggccatgaacagggttaagaaattcatccccaaactttataactttatacattagataaataaataacaaggccaaggccagactgcgtgaaatacctttgagaaaaatatgaccaagaccaagagttcattttttgtttgtttgtttaagagttcgttttattgtgacctgactgttttattcagatgttgaagccactcagataccagtggggataaagacaaagatgcagatatgcattgcagcaaaggggaaatatgataaaaaggtcagatcttagtataaagaaatgaaaattctggctgtgtgcagtggctcttgcctgtaaccccagtgctttgggtggctgaggaaggaggattgtttgaagccaggagtttgagaccgatctgggcaacaaatatagtgagaccccatttctgtaaaaactaaaaaagaattagccaggtgtattggcacatacctgtagtcccagctacttgggaggctaaaacgggaagattgcccaagcccaggaatccattgctgtggtgagctataattgcgccattgcacgctaacctgggtggctaagtgagatcttgtctctggaaacaaacaaaccaagaaaataaatgaaaattgtaacaagagtgggaattcttgttttcttctttccaaagaggtttaaaatatattaataattatatcacatgctacaaaaagtgtggtgaaattgacacttgagtacctggttggtgtaccatacttttgcaaagcatttcagccatgtgtattgagagcaaatgtttatgctatttgaaccaggcacttccattttggggcatgcgatgtaaggaaataattgaagtgataatatgcaaatacatctgggtttagttttatttataattgtgagaagttgaaaacaatagatcaatggctgaaatatgaaatatccacttgatggaatatatttgcaactgataaaaatgcaagttttaagaattttaacaagtgtttgttgttgtcgttgtttgtttttttgagatggaatcttgctctgtctcccaagctggagtgcagtggcgtgatcttggcttactgcaacttctgcctcccaggttcaagcaattcctgtgccctagcctcctgagtagctgggattacaggcacccgccaccacacccagcctaatttttgtatttttagtggagacagggtttcacatgttggccagggttgtctcaaactcttgatttcaagtgacccacccgcctcagcctcccaaagtgctgggattataggcgtgagccactgcacccggccagaactcgaaaaagtggttttgatgtactgtgagaagaaaagcaggctgttatgtttgcaggccccacacccgagtgctctcacccctctgccctttcctagtagagctgaattcactgagggttgctccatttgtggctgtgtgtcagggcctcttattcccttttctttttttaggggggagggctgttaatgttactcttctaataagggaaatactaatttggagcaatctgaggactcctgacataagccatgtcagatagtgaagtgctaggagatgggattctgtatagaaagggcctctcttgccttcaccacaagcattctcagcaaagtagaacatggaaaaacttctctgcaccatgattattttattttttttttgagacagagtctcgctctgtcatgcccagtgtagtggtgggatctcggctcactgcaacctctgccttctgggttcaatcagttttcgtgccccagcctccccaatagctaggactacaggcacatgccaccatgcctaattttttttttttttttttgagatggagtctctctctctgtggcccaggctggagtgcagtggtgcgatcttggctcactgtaacctctgcctccagggttcaagtgattctcctctctcagcctcccaagtagctgggattacaggtgtgcgccaccatgtccagctaatttttgtattattttttatttttttgagatagagtttcactctgtctcccaggctggagtgcaatggcacaatctcggctcactgcaacctccatctcctgggttcacgtgattctcctgcctcagcctccagagaagctgggattacaggtgcctgccaccacgcccagctaattttttgtgtttttagtagagacgaggtttcaccatgttggccaggctggtcttgaactcctgacctcaggtgatccatcttggcctcccaaagtgctgggattacaggtgtgagccaccatgcccagctaatttttgtatttttagtagagatggggtttcaccatgttggccaggctggtactcctgacaacctcaggtgatctacctgtctcggcttcccaaagtgctgggattacaggcatgagcctttgtactcggctaccatgatcattttaaagaagcaagagttagtattgttgtgaaagttttcagggtcctgaaagattaaatatatatatataaaaatagagatggggtcttactgtgttgctcaggctagtctcaaactcctgggcccaagcaatcctcctgccttgggctcccaaggtgctgggattacaggcgtgaaccactgtgcctggcctttatttatttatttaatctgaaaaagatctttaagaaaatgtaaaaagtgatagctctattagttttttttcctctacccttgtacttcatttcagcaaattgggtgatatacagagtgctcagctctggtaggtgtaggcagacaggtgacagcaccgtagtgaagggggaggcatgcagcatttgggtcaggtgggacaaacacaacagtggattgaccaagaatctaaagatctggtcttgaattttggctctgccacctgctgaatgtgtggctttgggtaaagtcccttattctctctgcaattgaatatccccacttgtaaggggcagtccattcccccagtggacaggtttgtgagaggcaacaagatgtgatacgggaataaaggaccgtggtaggtaggtgtcagatgttagctcctgcctttctgtcagttacaggctgtcttccctgggagcagcacatatatactgtgccttgtgataagttcttttctagcgaaggaaggagtgattaattatctatttaatttttcagcccgcctctgagaaagcaaaaaatggccgtgatacatgtgagtattttttgagattttttttcttgcttttaaaaagagagtcagctggctgggtgcagtggctcacgcctataatcccagcactttgggaggccaaggttggtggatcacctgaggtcaggagttcaagaccagccttgccaacatggtgaaaccctgtctctacaaaaatacaaaaaaaattagctgggtgtgatggtgggtgcctgtaatcccagctactcgggaggctgaggcaggagaatcacttgaacccgggaggcagaggttgcagtgagccgagatcatgccattgcactccaggctgggtgacagagcaagactctgtctcaaaaaaaaagagcatcagctaacccatgacaacaaaactatgtgaagtgccataaaaagtttatggaaaagtcaggagacctgagttccctttgtgtcatgtatgcaggatcccttaattaccttgtattttttcccgccatctgcaaattgaaaaaaccttgtttttcttttccataggccatttgtagggatcacgtagaaagttttaaactactaaacatattaagatgatttattttaagaagggtcacaaaaggatgaaatgctacccacagcttgcctttatttagtgctatactatttctatgttgctttgacatatacgtcatttagtctctacttgatgaataggtcgttatcccattttttcaaggggagagggtgatcacctgtgccttgcagattttggtgaagattatctgaaggcctctgtttgaaatgtatttggatgacaatttatattatttgtgtatttcagctctcaggcatgtgtttgaaatgtatttgatgacaatttatattatttgtgtatttcagctctcgggagtccaaaagaatctgagaacgcccttcccatccaagtagattatgacgcctatgacgctcaagtgttcaggctgcccggcccatcccgggcccagtgcctcaccacctgcaggttttctgccagattcacttgggggtgcatataaaaattgtgtaggaaaacctgaagttcagtagtgacctctaagagagcaaccttgaaaatcttgttttgttttgttttgtttcgttttggttttttgtttgttttgttttgtttttttgagatggagtttcgctcttgttgcccaggcttgagtgcaatggtgtgatctcggctcactgcaaccttgacctcctgggttcaagcggttctcctgcctcagcctcacaagttgctgggattacaggcatgcgccatcacgcctggctaattttgtatttttagtagagatggggtttttccatgttggtcaggctggtctcgaactcccgacctcaggtgatctgcccgcctcgacctcccaaaatgctaggattagaggcgtgagccactgtgcctggcttgttttgttttttgagacggagtctcactctgtcacccaggctggagtgcaatgacacaatctctgctcactgcaacttccgcctcctgggttcaagcgattctcctgcctcagcctcctgagtagctgggattaaaggcacgtgccaccacgtccagctaatatttgtgttttttgtagagatggggtttcgccatggtggccaggctggtcttgaacttctggccccaagtgatcctcctgcctcggcctccctaagtgctgggattacaggtgtgagccaccatgcctggctggttcttatgcttttctgagccaagggaaacaattcacaaattccagaatcttcctctcactgggctggctctatccttggacacagcgtttaagtttattattctgagtgggcatgaacttttctttctttaagtcctgcttttaaaaatttgctctgtggtgttttggtcatatggtagttgttttttttttttttgagacaggatctccttctgtcacccaggctgtagtgcagtgtcacgttgacagctcactgtaacctctgcctcctgggctcaagtgatcctcttgcctctgcctcccaagtagctgagactacaggcatgcaccatcatgtccagctagtttttaattttttgtagagatgaggtctcacatattgccaggctggtctcaaactcctggctgaagccatcctcccgccttagtctccaaaagtgctgagattataggcatgagccactgcactcagccatgtagtagtttttaattgtgatgtagttagatctactcatctattcatttgtgggtcttgtgtaagaaagcactctctaccccagagttacagatgtgtatttcatattttcttcaaatactttatagtcttggcggaattttttttttctttttttttcgagatggcgtcttgccctgtctcctaggctggagtgcagtgctgcaatctcggctcactgcagcctctgcctcctgggttcaagcaattctcatgcctcagcctcccaagtaactgggactacaggcatgcaccaccacactcggctaatttttatattttttagtagagacagggtttcactgtgttggccaggctggtctcaaactcctgacttcaagtggcccacacccgccttggcctcccaaagtgctggggttacagaatgagccaccgcacccggcctcatcttggattttatgcttatgtttatattatttatgttgactttctttttttgtgaatgtgtgaaacagctctagcttatatttttttccctgtgtaccaaatactgtgaatcaattttccatatttcttttttttttttttttttttttgagacagagtctcgctctgttgcccaggctggagtgtagtggcgcgatctcggctcactgcaagctctgcctcccagcttcgcaccattcttctgcctcagcctcccgagtagctgggactacaggcgcccaccaccacgcccagctaattttttgtatttttagtagagacggggtttcaccgtgttagccaggatggtctcgatctcctgatctcgtgatacgcacacctcagcctcccaaagtggtgggattacaggcgtgagccaccgcgcccggccaattttccagatttctttctttttttttttttttgagttggagttttgctcttgttgcccaggctggagtgcaatggtgtaatctcagctcaccacaacctccgcctcccaggttcaagcaagtcttgtgcctcagcctcccgagtagctgggattacaaacatgcgcctccacgcctggctaattttgtatttttagtagagacggggtttctcagtgttggtcaggctggtctcgaactcccgaccccaggtgatccacccaccttggcctccaaaagtgctaggattataggtgtgagccactgcccccgccagatttcttaactctgtagctttaagcgcaactgagtggaagaatattatgtctcttaattttgtggcaaatgaacttagagtgaccacatgattgttttctgcccttttctctcatccagtcctacctgagaaggcttagagctcagaattaagtgctgtcagcagcctctctcctatgtgtggatgctgcttaggggctcagtaagagctacttaggggcttttctttgtagtctttaaaaatgctctcatagttcaagattgattttctttttctaattaaagatgacaagacctggtggtacccaggttgtgtggtctctgaaggcacaaattgtgtcttaattggtgctaccttcacacatggctaagcgtatactggtgtttaaatatttactgtggaaagaacaaacatgtagtcagcacttggaatctgttttcaggctccgtttaagctcttactaaaaaaatccttccaggaggaaagggagcagctctgatgccagaagggcagccccgttggtgggcttgctttttcgttctgagcttttgcttctctatagggcttctttctttttgatccttcttcctgttgcttttagaggttttccccttagggaattttatgttttaataaggctatatatatatatatatatatgcatatataaacttttattaggaaatgttcagacgtgctcaaatagagaatagtatcatgaacagttatcaccatgttgtcagccttgtttcatgacctctcccacgtttaaattttggatggaatattttaaaaacaaatcccaggattggccgggcacagtggctcacacctgtaatcccagcactttgggaggccaaggcaggtggatcacttgagttcaggagtttgagaccaggctgaccaacgtggtgaaaccccgtctctactaaaaatacgaaaaaagtacccaggcgtggtggtgggcgtctgtaatctcagctacttgggaggctgaggcaggaaaatcacttgaacccaggatgtggaggctgcagtgagctgagatcatgccactgcactccagtctgggtgacagagtgagactccgtctcacaaaaacaaacaaacaaaacaaaccccaggcagcctctattttttttcaataatacatacttcagcgtaagtttctttctttttttacatgttatttatttatttagtgtcacccagcctggcacaaagctgattagtatatgtttcaacaaataagaactaaaagaaaacccatcacggtaccattatcattggtaacaaaattaacactaatccctaaatgccctctaatagccagtgcatagtcagttttttgaattgcctcaaaaatgtgcttttgcagttagtttgaaatgggacctaaacaagatccactttttgcatttggttataatgccttttgtgtgtgtgtgtgacagtagaatgtcttgctttctacatttggctgattgttgccttgtagtgtttcagttttcctctattctgcagattccctgtaaactggcaattatctctggaagcttgattagatttagattcaaatttgagggcaagtagacttcttgggcactatgttctttctcccacatcacatcatacctctcttctcattctgtttttagtgatgagagattaatcagtgggattaggtggggtcagcctggagcagtcctttctttacaactatgatcctaggactttggctgcataatgtctgtcatttcccccctctcttatataacatctcaagctgttaagggtgaagtaccgcatacaggtttcccacttgtagatcacactggggatttttgttattgggttccatgtggcttgggctggtgatgggttttagttttaactcaaggtaggacagcatccctcgcttgatggtaactttttgtctcttgcctggcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgaggtaagagtgctgaagcacagacagagccagggacatctttcttaatatagtgggtgactggaggtgggaggattggtcagaggtggggtgtaaatcccacatcttaatgatttctttgccagtgcagtaggtacaaatcactttagctgttagctatgtatatattatacttcttttttttttttttttttttttggtgacagagcacctaggataaagtgcagtgatgcaatcacagctcacctcagtgcggccttgaactcctggactcaatcgatcctcccacctctgcctcccaagtaactgggactatagcatgccaccacacccagctgattatcatatttttttttgtagaggtggggaagtgcagtgatgcaatcacagctcacctcagtgcggccttgaactcctggactcaattgatcctcccacttctgcctcccaagtaactgggactatagcatgccaccacacccagctgattatcatatttttttttgtagaggtggggttttaccattcccaggctggtcttgaactcctggactcgagggatccacccattggcctccaaaagtgctgagattacaggcatgaaccaatgttaccgcaccctgcctctattatactattttttgtttagcctttcttcatccatcatttaactgtatgcctttccatatgttaatggaaagcttttcttaggcctagggtcaaaagggtttatttccttatgatttccatttgtgccatatataaaacaacctctgtcttaatgttgcattttagtttctcatttaccggtcgggcgcagtggctcacacctgtaattccagcactttgggaggccaaggcgggtggatcacttgaggccagaagtttgagaccagcctggtcaacatggtgaaacgccgtctctactcaaaatacaaaaattagctaggtgtggtggcgggtgcctgtaatcccagctactcaggaggctgaggcaggagaatcacttgaacctggcaggcgtagttgcagtgagccgagattccaccactgcactccagcctgggtgacagagggagactccacctcaaaaaaaaaaaaacaaaaaactttttttttcacttacctgtttttttttaacttttatttgcattgattttgtaccgaatttattcccatactatcagtttttgtttcttcagtttctttcttttctttttttttcttttctttttttctgagacagagtcttgctctgttgcccgggctagggtacagtggcatgatctcagctcactgcaacctctgcctcctgggttcaagtgattctcttgccttagcctcccaagtagctgggattacaggcacacaccaccacaccagctaatttttgtttttttagtagagatggggttttgccgtgttggccaggctggtctcaaactcctggcctccaatgatccacccacctcggcctcccaaagtgctgggattacaggcgtgagccaccatgcctggccttgggatatctttttcttctgtgcaatgtcctcttctggtttaggaataatttattccttttccatgaggatcatcttggtttcgcagggggagctcatgtatgggttaatctgaccatgagctctttacatcaggcagcacatcttgggtgctttgttcacctggacatgctcaatgaccagaggatctgcacctgaacccttaagttcggcatgactgtgcatttttaagcatatgtagcaataattcagtactcttttttggccactgaccccgtgtgcagccgtgctgtgtggcctgggaccacctactatctccatcattgtaatgtggaaatggtacacattgtttctgtaaagtgacatatttctttctttctttctttcttttttttttgtgatggagtttcactcttgtcccccaggctggagtgcaatggcgtgatcttggctcactgcaacctctgcctcccgggttcaagcaattctcttgcctcagcctcccgagtagctgtgatcacaggtgcctgccaccatgcctggctaatttttgtatttttagtagagatggggtttcaccatgttggtcaggctggtctcgaactcctgacctcaggtgatctgcccacctcagcctcccaaagtgctgggattacgggcgtgagccaccttgcctggccaaagtgacatctttcatatacttggtggctttttatatatgcatacccttgatggcctgagcagtttcatgggtggtttcttttatttgtttgttttgagacaggttctcactctgttgcccaggctgtagtgcagtggtacaatattggctcactacagcctcaacctcctgggctcacgtgatcctcccacttcagcctcccaaatagctgggactacaggtgtgcaccaccacacccggctagtttttaaagtttttgtagggacggtctcaatctgttgcccaggctggtctcgaactcctgggctcaagtgatccttccaccttggtctcccaaagtgctgggattacaggaataagctactgtacctggcctgtactcatctttttttttttactaggtttttctcttttatttccttaataactaactagactatgttcttttttattttgtaagttagagcatcaattcattaatttacaatgaacagtaaaactttcacagaaatctgaacattctcttctttcctgcaaagcaacttgaggaatgaaatacagtattacagtgtatgaggttctgtgctaggcattgggtagataatgatggccaagacaaattccttggagtttgcatctgctggacccactttttcatctgggtggttgcttaatgaacatggaatacacacaagaagagttggttgtggatttcagttctttgatccactcaggcatgctgtctctgtctccataatgggacctgtctaccattgcgccagacaggtggtgtctaaatatcataccatctccttgcctggtcaaggctggaggcatccatttcttcgttatttttttctcagtaatttttttagcataataacattttattgcttactcatgtcccagcccactaagtcagtggaggggctactgatccactcagtccattcaggaactcaggttccttccatcctgggatgccatgattatcaacattggtctcctgggttgccacaaagggaaaaagaatgcagatcatttgtggagatcattgtggtccaggcctggatttgaagcatataatttctacctggccagaactaagtcatttggctttattgcaaagggtctgggaactatagtcttgtgtccagtaggaaaatcaaatgggtttatagtgaagacattgactagctctgccaagatctgcccttctggtgaccacatagctatttttattgttcctccctcttagagaatatactcgttcctttcccaagggagacaactcaagtcccatcattcagtcattgcttccagctcaaagttcaggatcttcaggcagtgtccttcccatcagatttggttgtgacttcattttgccagtaatttagaaccaaaactcccttctcccaagtatttaaaagcaaacaaatgcaaacatatttcatttctttatagtttgacagttttgctcatttctctcactccctgacatttataatgcccaagattcttgtcagccttggtttatcattctacctagctctggtttcactgtggttctgtggtttttctttgtgactcaactccatgataactggcagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtaagttggttgcttaagagagagccttggactaggagctcctagccctggtcctcagtgtcggtcacccatgtgtccttggtcaggtgcctctgttgctccacctgtaagatgggataaccatgcccactttggccatcccaggggttcttgtaaagatccttgaagatgcacttgggaataggctttgtaactaattagctgtataaacctgagggcttttttgtttgtttctgcccttttttttttttttttcttttgagacagggtctcactctagttgcctaggctggagtgcagtggtgcagtctcagctcactgcagcctcaaccttcagggctcaggtgattctcccacctcagcctcccaagtagctgggactgtaggtacgtgccaccaggcctggctagttttttgtatttttagtagagacagggtttcaccatgttgcctaggctggtcttgaactcctggacacaagcaatctgcccaccttaacctcccagagtgctgggattatagatgtgagccaccgcatccggccctttgtttctatttgagaggaactatgcattgccacctgctttctttcctaagtcagatgtccctcattcttgttcattccttcttctcttagatctcttggatattgatatcctgtcttggttacaaggagttatgttgttttgttttctgttaggtctctctgacaactgaaaaaaaattttcccctgaattcactttttcctagtccattcttttttatctatattctgttctcaagaagatgacagtaagattgtctcaagctgtggctaaaattaaactttagcttaatgggctcttattgagctggaaaggaacaaatgcattaaactccaggattttgtgtgtgtgtgtgtgtgagacagtgtctcactctgttacgtaggctggagtacagtggcgtgatctcagataactgcaacctctgccttttgggttcaaacaattcttctgcctcagcctcccaagtagctgggattacaggcatacatcaccacacctggctaatttttgtatttctagtagagacggggtttcaccatgttggtcaggctggtctcaaactcctgatctcaagcagtccacccaccccggcttcccagtgtgctggcattacaggcgtgagtcaccgtgcctggccaaatttttattttatttttttcatggaaaccatcctgctgaatacctggaaatgcctattttcttttgtacttgcctttaatatttaaaagttaaataagtgagaaatagatctgaatcatttggctgtaactggggggtcatgcctaaaccccgttctgcccccttatctctgctataatcagtcacactacttgtttctttctgtgtcctttcccctccattattgtctccactggttcccttccaggtcacttagaactcttggtgtttcttcagtgaccttcatcttttcatgcttctgtgcttctcctcctcccactcttcatgtacactttattggaaccatattctgcaaacagtttgcttcgcttcttcctcctgtttagctggcctttcagtagccaaggccctccttcatcagggttccctgtcttcctcattcctatcctcagaggctctcttccttcttggctaatcttgtggtctcctgcacgttttgcctctttcaggtttgggatttcacaggtatcatttcatctacccagatgccctcttccttcaatcgctgttaactttgttgaacacttagctctacaagttctcctttcccaggaagcctcattttgtagacttgactaattgtaatttgtttcctactctgccttttttgcacttaaacatcttctgcttcttagagtcacagttgttactctcctaggtattaacagaatcatttggtgtttcacttgtatttccctcttactgagtttgtgttagccctcctggcaaggggccatgcctcctatacttgtatatttcactgtggctattcagttgacacacctgaggcagaatatcctaaaatattcttaacagattagacaggatgataaaggtgaggctccttagtaggatgggtcctgcttggaagagcagatgtcctttgggagccaccctctgtggtgtgttcttctttcaatctcaccaacatctgtatcccagtagctggaaagaagggagagtatagttaagtgcacagcactagctatcaggtgggaatgatgctcagtggttctttatctgggtagggccatccggagaagccatccagatccaccaccagacccgacagaatatggcggagctacaaggcagcgggcagagggatccaactcactcctctgcagagctgctggagttagcatatcatgaagctgctggaaggtgaggatgtgcacagggctctggaaggtaacctgagaacactctccagcacccaggacaatgtgcagaacagactattgacaaaatgttgtttagaagacttgaaaagacagtatgaggtcagggccttcctttgttggccagtggcattcccttcagttggtgaagggcaaagcaaacatcctgacatttttgcctgagatgttacctaggccctgttttaggtttattttgaatccagaacacactttgtaaacctcaaacgtgggtttttctaaacctcagtcaaaggtgaatccaagagaggaaattctttggatttggaatgctgagacaggagattcatgctgtgtgttttgggcaacctctctgacttttgtgattttggtcattcagaaataaatcccactgttgagtttagaataagttaatgctaagggcaatggaaatgaaggcttatgtttatagaaacaactctttttgaaccaatgctctgaatgtgttacgaacatccagtgagagtcagtgtaggaggaaagtcatttaagccttgacaggcgtgagcccgggttacacctggactcaatattcctgttgctttagaaaacactttgcaaaatgcagtctttggcccctctttcagtcaccttgacaccctaggggatagataagggatatggggagggcgtgaccttcttaaccagatgaactcaggtccatatattcaagcacctcacacccatccttgtttgtaaaagggaggcatagggcatagggaggcatagggaggcatagggcagacagggcgggtggtctagcttggtggtgggaaagcagcaggggtgccagggtcacaaggagccggcactgacacacaaactaagcactgtggcctggtggcttaagataaggattccagtggctgccagcttgagttggctgaatattcaggcctgatttttatgaacctacctcccacccccgggatataggtgagcaggaaaaagaggtgatgatctacattaagccaggtggctgggctctgttctctgcaggcacagcaattcccgccagcctggtgacggcatgtccttcttgaacttcagtggaacagaggagctttctgtcggcctgcttagcaacagtggtgcaggtaaccaatccaagaggtaatagagttgggatgtttagatcaggctcacatctggaaatgacacaagggccagaaaagcagggccatgtctattttgagatcatttcagccacacttttgggtgacctatttagaaacagtgctctataatgcatggaattaaaaatgggctgcacgttaacatttttagctcagaacatgttggtcaagccacatttatcatcattctgtcacagagttgtgattgagggcagcttaggagcatagtattgagggcaacaccatggacagagctggagtggtctgtgctctagagggacttttggttgtcaggggcaatggggagcaaacccacctccataacaggagagacccagaggggagaagtatgtgtccagttttaagaccagaaaagagaaggattacatagttgcctagagaagtgagcatgcaccagggctgggcgcagtggctcatgtctgtaatcctagcactttgggagcctgaggtgggtggatcacttgaggtcaggagttcgagaccagcctggccaacatggtaaaacccccatctctaccaaaaacacaaaaagattagccaggcatggtgatgcacacctgtagtcccagctactgggaaggctgaagcaggagaatctcatgaacctgggaggcggaggttgcagtgagctgaggttgtgccattgtactccagcctgggctgcacagccagactccatctcaaaaaaaaaaaaaaaaaaaaaagagaagtgagcacgcaccaaagacttgaagggtagaatttggttaggtagacagttagaaggtgaagtttcagtgcgggtgggggaagcagtatgaatttggtttggtatgatactttggttttatgctttttggaaatacttttatatctattgtcttatcaccccagtgggtgatcaaaatatatttaagttattaaatatattttatacatgggcaacttaacgtccagagaggtagaaatattaaagtaacctctcaaaccaatagccaggtatcctgactcaggctgctgtcctcttttcgtgacattgttcagagtacctttaagggatagagtaacatgagcttggatcagtaggggcagcatttgtggagcctcagaggacagagatattgtacaaaatgagtgtggaaaacattaaaactttaaaaaaattgggctactacgttgtgctttagtgttctataagctaacttgaatttctaaaacctagcttaagaaaggtgtcattgctgggcacagtggctcacgcctgtaatgctcaccctttgggaggccaggtggatcacctgaggtcagaagttcgagaccagcctggccaacgtggtgaaaccccatctctactaaaaatacaaaaattagccaggtgtggtggcatatgcctgtaatccaagctactcgggaggttgaggcaggagaattgcttgaacctgggaggcggaggttgcagtgagctgagattgcgccactgcattccagcctgggcgacagagcgagactttgtctcaaaaagaaaaaaaaaaagaaaggtgtcatgaaaatgaagttatatcaaattggttgatgatattttcctttattcattggtaggttcatccagcaatattcctagaggcctatgtctaaggctaggaatctgggttggcagtaagagaatccctaaatggttattatttcatttattaattcattcacttattttttggttaacctacttaccagcattcatttattttagatgagaaaacacattgaatacaaatgtagggatagaaagacactgtgcccctctgtactcagagggctgaaaatgttacctctggctgccagattatttgtaaatacctagccgggcactgtggctcacacctgtaatcccagcacgttgggagaccaaggcgggtggatcacgaggtcaggagattgagaccatcctggctaacacagtgaaacctgtctctaccaaaaaaatacaaaaaaaaaataaaataactgggcgtggtggcgggcacctgtagtcccagctacttgggaggctgaggcaggagaatggtgtgaacctgggaggtggagcttgcagtgagccgagatcgtgccactgcactccagcctgggcgacagagcaagactccgtctcaaaaaaaaaaaaaaaaaggaagaaaagaaagtacctttagaggggctattgctttgctatgccaaggagccatttttaggaacccagagtttgagcctctcaggctgtttggggtagagttgcgccgaggagggctactctgggactcatttgactatacttgaactagtttcactggttaactgaagcagggggaattacaggttctgatggtagcagcaccagaatgtacccaggtagtcttggaagttgtttggggcctgggatagctcaggtggaccagttgatttcccataaaatttgttttagaattttaaaatcattttagggaaaagaagtttcaaagaatctttatttggggtggttgtggaagattttaacatgacaccattgtggagtcctctgagctaagggttccctggcagactcaaattggaaaagcatttgctgcaacctgaagctctggctcagccttctctttggcttctgagctgtaggtgtgtccacctgatggacctctctgctcagatggcccccaagtacctcatccttaatgcattgacagccaaactcatgtctccctgttcctcagcccatgcttcctcttccactccttcttctgattggctcctcacctccgttctcactgcattgttcagactcctgtcatttgtggccaggattattgcagtagccttcaaaatgatcttcctgctctgttctcatcccttctgattcatagtccatactgtcactgatgtttccagatgcagatctgatcagccactccttcccacatgtaaccctttcatggctcttcatggctatagtgctgatcatcacccagctcctccctgtggttgtatcttcacctgcctcctcttccacatggtactgcaggtggaaagagcgcaggctccaggatcttaggacatgaggcctgactccacctcatgagcagtgaagccctcaggccagttactacactaatttctgggtatctcagtgtctttatcatgaagagattgaattttttttttttcttttttgaggaagagactcactctgtctcccaggctggagtgcagtggtgcgatctcagctctctgcaacctctgcctcccgggttcaagcaattcccctgcctcagcctcccaagtagctgggattacaggtgtgtactaccacccccagctaatttttgtatttttagtagagatggagtcttgccatgttgggcagtctggtctcaaactactggcctcctgtgatctgcccatctcagcctcccaaagtgctgggattacaggcatgagccaccacacctggctggagattgactattaaatgtgataatccacataaattcttaggacagtgctggacatccatggtgagcactcaacaaataggagctgttgttgtcattacaataacatattttgtattccaggcatttcttgtgctcctcaaaagaactgtgtcctcgtgttcctttgcatagataggttcctctctatagaatatgcttcttccctgtctttaacccctgattctgactggcaggcatgaacttagtttattattcagctgcaacaatacctcttctttgaagcctgccccggtggttccccctccttcccatgccctcccggggtgtgttaggcatgtttccgcacagctccgtatgcataacccaattgtacaacttggcatgttgtgatctcactgcttgttttccatgtctgtctcctcactagactgaaagagcttatctttattcattttctccactcaatgtttaacacatttatggacaaatgaatttatatttccaagaccaagttgccgtatgtgagaagaatttgaataacacacaatattattatttaattggtatgcaagtatttaattatacatagtttttttttttttttttaagagacaggatcttcctctgttgtccaggatagagtacagtggcttgatctcactgcagcctcaaccttttgggatgatgtgatcctttcacctcagcatcccaaatagttgggactacaggcacataccaccacacctggcttaattatatacgtatgctctgaatgcttggcttctcatagatggtgtgggatcctggggttgtttttctagtcagggtgatattgttaagtggggtcatcttttccctttcccagtccctttatgtaacctatagcatgtgttttcaaaggggttagtggccatcaagaggtgatctatagccacatgggaactgaactcccatctttgaccttaagctacctgatcaattatgttaatgagccactgaaagaaattagataaaattattcaaatttttataaccatatatcggacattaatttgttataaccatatgcaaaaccaattaatgtcagatcttcaggatatatccatagtcttacttccatcagtcttagcctggcctaaggtgccatcatcttttgcctggatgcagtagcgagttacctggtcttgggctcctcccttgcccttccatatcgtttattttcaacacaacaaatcagagtgacctttataaaatagaatttggattatgaacttctctgcacaaaattttccaagggcttcccagctcacttggagtaaaagccaaggcattatggtggcagatagacccctcatgtcatgtggctgcttgttacgctcagtcctcgtctcctgctttctccctctcatttcactctggaggttccccagatagatcaggctcactctgaattgcaggtccttcctcttgttcgcccctctgctgtgcctttactccagagagcatcatggctaagatccagatgtctgcatttgcccaagacagtcctggtttgaatttgtgaacccatatgactattaatagtgtccccttccagtctcagaggtgtcctgtattggatgataaatgacatggccacccttcccacagctcgctctctcgcttccttcaggtcttgcctgaattgccatattttacttcagcactcccctcctatcctctctacctaatatttctccattgtgccacctggcatgctagatttttaaattttgtactttttttattgtaagttccatgactgtcaggatttttgttttgctcatgactgtattcccagagcttaaaacagttcctggtggctgggcacagtggctcacgcctgtaatcccagcactttgggaggccaaggcgggcggatcacctgaggtcgggagttcgagaccagcctgaccaacatggagaaaccgccatctctgctaaaaatacaaaattagccaggcgtggtggcgcatgcctgtaatcccagctacttgggaggctgaggcaggagaatcgctttgaacccgggaggcggaggttgcagtgagccaaggtcacgccattgcactccagcctaggcaacaagagcaaaactccgtctcaaaaaaaaaaaaaaaaaaaaaacagttcctggcacataatagatagttgaatgaatgctaaaaatcttctgaagttagctttctctctactgaagcatgatttaatttttctctaatgcttttctttcttataaccttcttaaacaattaactagattcctttttttcaaagacttgggtagtctttttctccttgcttggtttttaagtgactttcctttcaagccatcctcagttttcatggaacatgttttgccttcttcaaactcactaaactcttacccattcgagaaaagtgtattgaactctaggcactgtgctaaggcctgagaagaaacaaaaactactaagacactgactctcccgacctcaaggagctctgcttcctcatgcacttgggattctctttcaagcaattcccatgtggggtaatgacgatgaaaggaaagccgtcttgtgggggattgaactgtgaatggtttcagtgtggtttgaacatgtgatctctgctaaatgaggatgtgctagatgagggagtgtgctgtgatgaaaacaaccaggatcagaattccccctgcccctcactggactttcaagctgaggctcaggttcttcatctgtgtaatgggcataaagatcctccccttcctgactgcctgtcccacagagcggttgtctggatcaaaagtaggttgggtacattatgggctagattaccacatagagtccttgttttgggacaaggtggggtctgaattcacaactggttaacatttcattcattaaaaaatcagagaagactggcgcggtgtctgacgcctgtaatcccagcactttgggaggccaaggcgggtggatcacttgaagtcaggagttcgagaccagcctgaccaacatgttgaaaccccgcctctactgaaaatacaaatattagctgggcgtggtggcgggcgcctgtaatcccagcgacttgggaggctgaggcaggagaatcgcttgaacccgggaggtggaggttgcagtgagccaagatcatgccattgcactccagccagggtgataagagtgaaactccatcccaggggaaaaaaaaaatcagagaaaaatccaaacagagaaaccttatctgtgaccctaccttcacctctttgcaccatctgcaggcactcaagcgtgactcagtctttctcctgcatttggacatgattcatatgtgaatcatgattcacaggagtatcatctctgtgggtttccctcccagccccacagaatttcatttggagtgttgttggtggggacctggtagctgcagtcttcacttgtttttcaccctgctgcccagcagagacagggcagttggtgtgactgggcagatagtttttatccctctgtatctttaactgggcaccattttagaagacttgctagtaaatgtcttcctttattggagttaaatcattttgaaaaagaaaataagtggatgccatgttttctttctctttagtgttgaggcttagaatctgcaacttgatatttgtgttgaatattaggtgcatgcagtatatttggcctgagagccaaagtaaaagtaactcatagcatactgagactggatggaaggacctccgtcatttctccaggccaggtcagttttttttatgggtaagtgctgcctctgtagcccagagaagagaaaccacttgccccaggcacaggcttctagatatgggcttggaactagccctagaggctccacactgagtaacctttttgaccttgaggttttcagccagagaacacattcacaattctgaacagatgtcaaaagagacagagctgagatgactcttaccagcattggcttccgaagtctatgtctggctttgaactttgagtgtgagacttcattcccaaatgttgggttggagcagagctggctgaccatgaggtttcacctccatcattgcaggctggtgggactcttcatatgccaacagcaagtctttatgactgaaaataagacctcagagagccagtgggaaaggcagtgtgttgggcttgaattacaaggaaactgtgtgtgagtagcttcctggaagtccttaaaatatttgcttaaaagcataatagcttcctggaagtcctgaaaatatttgctttttcggggtatgcgtgtacgtgtgtgtgtgtgtgtgtgtgtgtgtgtgtgtgtgtgtgtaggtaggtgtgtccactagagatggcacagatctacttttggcctaggattcaaagctgctctgttaagttgaactatttcttttctttttttttttctttttttgaactctttattagtgtaagaatttgagttgtcttgcagaccaagtctagaacaggttttctttaaaaacaaaaacaggtgatcaaatgagcaaacttggcagccaaacctgggaggtgatatggtaacaattctgttattgctcagagtgttttgcaaatgccagtttgccttcataccagttctcaagctaaataagaaaatccacctcgttgcttctttataatcatgctttatatttgtatgaaaatgaaagttgtcagccaaggtttttttttttttttccagaaaatttagctccaagtggcttttggctattgacaaagaacagataacatttcaacagctaaaaattggtgccccagatggatagtcaagaaatagagcatctgtaaagttgagcagaaagaatctaaattcaggttcctcctacttactgtgagatcttcagtaagttgcttaacttctctgagcctcagtttctttatctgtggaaaaggatcatacctacctcatatctactggtgtgggtttgaattaaatgaaatactgtatttgtctgacttaatacatgtatcttctagtataacgaatattagtttttaaaaatctgctccaagcagttccaaaagaaaagtcctaaaattgttttggccaggtgatgtcatctttatttttatttttactgatttatttttttcagacagagtcttgctctgtggcccaggctggagtgcagtggtgtgatctcagctcactgcaacctcagcctcccgggttcaagtgctgcttcttctgcctcaacctcccgagtagctgggattataggtgcccaccaccatgccaggctaatttttgtatttttagtagagacgaggtttcaccatgttggccaggctggtctcgaacttctgaccttcagtgatccccccgcctcggcctcccaaagggttgagattacaggcgtgagcccatctttttaaataaaaaaattagttatttaaaaatttatgtccagtaaaatgtgctatatttagtgtacagttctgtgagttttgacaaatgcatagagttgtatacccacaaacaaacacatcaagataagaaaatttccatcaccacccaaaattcccttgtgctgttgctttgtcctcagtccgtccatgtgttctctggcaaccactcatctgttctctgtccctctggttttacctttcccagcatgtaacatacatggaatcatacagtatgtaattttttgagtctggcttatttcactcaccatattgcatttgagagattcatccacgttgccacgtgtcaatagttgcctcctttttattgctgagtagtattccattgtatggatgaactacaatttgtttatccttcccccagttgaaagataattgggctgtttccaggttttggcaactatgaataagacttctataaatgtttacatgattttatatgaacaaagttttcgtacgaacttaagttttcatttttcttgtataaatttctatgagtagattgctgggtcaaatggtaaatctgttttccaaagtggtgtgccattttgcattgttatcaacaatgtgtaaggcttcctgttgttccatatccttgtcaacacttggtatatccagtcattttcattatttcatcattcaaatcaaataagcatgtagtggtatcttactgcacttttttttttttttcttttgagacggggtcttgctctttcagaaacccaggcaggagtgcagtggcacagtcatagctcactgcaaccttggacttctgggcacaagcagtcctcctgccttagcctcctgagtggctgtgaacacaggtgcatgccaccatgcctggcaaatcactgtgcttttaatttgctatttccttaatgactactgatgttaagcatcttttaatatacttatgttccttttgcatatgttgtttgtccttttctcattgggttgttcgttttcttgcttttgaatttgagagttccctatatcttctggatgcaagtcctttgccaggtgcatgatttgcaagtgctttctgtcatgttgtagattgttttttcaaagctttcacaagaaatttataaatacttgttcttgttataaaatattcaaatgacccagaagtatttagagtaaaaagtacaaattctcttttacctcctatcccttcctccagctttcttctcagagttagccaccgttgaatgtttagtgagcatctttccagtcctttttaaaaaaatatttttatgtgtatttacatagagatggtgtctcactctatcacccaggctggggagcagtggagtgattatagcttgccacagccttgaactcctggccttgtgagctaccatgctcaacctcaattctttttatggcatcagaattttctgataaatatatgttttgaaagggacatttaagtactgataggtgtgctttaaaattaattgtattactcgacagtcaataaattgcatttcaaagaatcttccggtttttcctttcagcccagttataggtaaaatcattgtttttatgttaaagtagtgagttttgatgtcctgtgtcatattgtagaaagccatgatttggggaagaaaattccagaagataaggatggctgatgagtggattaaatttaaataggtcattttgttttattttatatattttttagagataaggtctctctcactctgtcgtcgcccaggttggagtgcagtggcacgatcaaagctcactgtcaaaaataggccatttatattcactaaagattgctctaattagttgaaatgactttgaaatgtgtccgttttcttaaaataagtggcaggttgctcgtgtttgtgtgatctcttttagcaaagaatgataccagtaacctcagagtaaagttctggctcattcccaattttagattgatcatttttctttgatcgattcttttgtactgtttgaaatactcagcacagaatttgcacttggtttacatttttatttttagctccagtttgcctttttcaaccataactggtcagaactcttttgcagagtgagccttcttaagacaagctgtttttatctttccataggtatgaatcctaggacccagaataaggattctctagaggacagtgtttctacctctccagacccaagtaagagggggcagctgactggggaaaggggtagacagggagtgtggggtggtcagagcatgaggaaacaagaggaagccctgtgggaagtgagtggtcctgaggtacacatacctctggggtatgggaaggcgatgtggtgagggaggactctctggactctgtgatggaaagtgagggggtgtgtgactgaatgacctgttttggaaggtgattcaggggcacctgggaaaggtagcagattccctataaggcccccatgctggtccagagctggccttcacccttaactgcctaatgatatctccatgaaaaagttggaaagacataataggctgttaactggaatcatttacctgcctgtagttgaaatatttggctgaattgcattccttttgattgtctttttgaatagctatgcagtaagagaatgtctaaatatctgtaataataaaatagcagagaaaatcctaccatttgataaactttacttagctgtgaccaatggatgtatatcactgagtctttttgtccccacttttttttttttttttgagacagtgtcttgctctgtcacccaggctggagtgcagtgacgtgatctcggctcactgccacctctgcctcccaggttcaagtgattcttctgcctcagcctcttgagtagctgggattataggcgcgcgccaccacgcctggctaatttttgtatttttagtagagacggggtttcaccatgttggttaggctggtctcaaactcctaacctcgtgatcctgacctcgtgatccgcccgccttggcctcccaaagtgctgtgattacagccgtgagccacctcgcccagcctttgtccccacttaataatccttttactatttgttcaggtccctcctagcagtcatttgtaatggcaacattaagcatattactgtatcttggtttgagtagtcatttcttattcatgaccatttggatggctttctgctttttagccatagcatataatgcagctatgataatacctggtgggctgagcatggtggctcatgccagtaatcacagaactttgggaggctgaggtgggtgcttcacttgagcccaggagtttgagaccagcccgggcaatatagtgagaccctgtctctattaaattagaagttaataataatacataatacatggtgcagcaggtgtattttttcttttggttaatgtctttggattacactccccaaagtatggttggcagattgactattttccagaaagctaccagcagtgaatagatgattctatttctctacaaccctgtcaccggagtttgttacctttgctcatcattgttattttagtggttctgaggtgtagaacttcctcagagtccctcttttcagaaccagaagatactggggttagaaaagaggctgcactcttttcctagagacagaacacccttaaacttacaatcaggatcctttctcatcatgagatctcgaactaagcatttgaacagtctgtgtcttgttgtgtgcccagcagaaagcatttctacaagatttttgtaatcctgagggtcagaaggctgatgatggccaggatgatctaagaggacataaagatagatttgtcttctgtttctggcttccccactggggctttgatcaggtcctcatcttctgttttagccaggaagtaaaaacaagctcaccttctcggctgccatatagaaaaatggagatgattaattaggctattcgggcctatgttttggattcctgaattattaatgagtttataaggcctgtgtagagcatgaattagatctgttgcaggctaaatcatcttccccaagtcagtggtgccacgtggggcatctttctgctgtgacttagcacacaaattttgttcttcattgacgggagggctgatgaggcagcaggggctacaacacattataagctgttagcatggtacaaaaataaagtgagtatcccattcagaacttagagacaaacgctcagagtttttcggcttcgtattgctcccttctttggaaagttaaaagatagtcttcacttaaattacttaaagaggtaactgccctattattttaactcagtgaagctcaaccagggaggattttcctaaccagggaggatttccctcccccaggggaacatgtcaatgcctgcagacatttctggttttcacagctaggggatgccactggcatctagtgagtagagtccaaggatgctgctgcggtacccaggacagcccccacaacaaagaattatctggttcaaagtctctgttgttgccgaggctgagaaactctgctttaactgaggagcaggcaattcgggacagacccatgtggtcaggactgctctgctaactgcagccttcatttttggattgttaaaactctgtctcttaaagttccagcctcctaactttcccagatatccttacttgatttttcctcccacccttttgaatctgttacttatttttgcagtgctagaagtattccttatttctgctactgtatgctgtttgctcccaaacgaggctgagctcccctcctttccccacctagccactctgcagtccttgggagaggctcgtgcttgggcctccctgctcttggaacgttgatgtgcttcgacatgtaattctgcctgccctgccgtaatctcacctgcattgcggctgcagctcacagtcagcagaaaatgaaaaatatcagctgtgaatcccatttgcatgatgggattggataagcatgtgcactgcattgtctaacaaactctgtttctctctctttctccctcccctaccctgtttcttcccaatcctggcaattttaccatctttcaccctgaacttttttccccactcttccctccccttccctcccctggccccccatcccacacttgccatggtgaccacatgtaccttttccccctgttacgtgaggcagttctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggtcagtgtcagagaaaaaggcacttggcttggttggtgagggtttcggatatatcccacacatgcatcagaacactggatttgtgctggcttcagcaacacatatattaaaattggaacgatatagaggagattagcatggccgttaaataaaaaattttaaaaaaacattgaattgtattttatctttttttttccttttttttttttaactgagagagggtctcactctgtcgctcgggttggagtacagtggtatgatcacaactcactgcagcctctacctcctgagtacaaacagtctttccacctcagcctcctaagtagctaggagtagctgggagtggcagcaccacatctagctaatttttgtgtattttataaagacgctattttgccatattgcccaggttggtctcaaactcctgggctcaagtcatctgcccatctgttgcgtcccaaagtgctgggattactaccttgagccactgtgtctggctgaacactgaattttcaagcctgtgtcctctttttatatttgggtaacttttttttttatttttttgagacagagtctcactctgtcccccaggctggagtgcagtggtgcagtctcatctcactgcaacctctacctcccaggttcaagcgattctcacgtctcagcctcctgagtagctgggactacaggcgtgtgccaccacacatggctaattttttgtatttttagtagagatagggtttcaccatgttggccaggctggtctcgaactcatgacctcaggtgatccacccacctcggcctcccaaagtgctgggattataggtgtgagctgctgcactggctgtgggtaattttatgatgtaagaactgttcgtttctccagagttctattgacatcaactatttctcctcgttgattgatttatttttaactccagttggttctggctttgatgtttattctcatattttctaatgcaattattttgggcacactaaatctgatcttcttttctaaaattactcatttgggcattgagttacctgcctcttttcacctctttgaactgttaattttccccaaaacactgatttacaaattgttagtagttttttttcatattttctattatattttcttttctctatctcttttatatactgtcatccaggctgaagtgcagtgatgcaatcttggctcactgcaacctctgctgggactacaagcgcgtgccaccatacttggttaatttttgtatattttttggtagagacagggttttgccatgttgcccaggctggtcttgaattcctgggcttatgcatatgcaatctgcccatctcagccttccagagtgctaggattacagacatgagccaccatgcccagctcaaactgttagttttatgaaccaccatagaatggttataaggggatgaagcaaaggagatgatgagactgtgcactcttaagtgtcactgtctcgggccaagcatctgtatgagcaatcatctgttgttttcaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggtgagtttttctccttggatttctatttttttctcttctactgtgtatgtggaagtgggttttcaagatggtaggtagtagataaatttagtagtaatcgttttcgacatagaagttttctttataaattctacttaagtgaggaataaagtctcctttaggtatggatttattttaaatgctctctttaatttacaactctccctttaaggcagtggatgtggccaagttcaggaatgggacagcctggcttggacagacacctgggaatagtaggcagctgagtcactactgagctgtcaacgtttctaaacctatatttaattgtttctagtacagtacctggcacacagcagattgtcagatgttacctaaacctgaagtttacatttgttcttattttcttattctggattcatctgtctcttctttatcactgaagcttggtggcttgaagcaagaatgggtcatctatgagtggcagattaggctagtaagtaacagagaatcggtgttgctaattgaatcagagccaggcaatggagagctcctctaaaataagtctaacagagggaattaagtgcaggtgcctggaatcagaaagcagtaatcacttcctggaacaatcaatgagctgtcttagtctcctgtctcttcattattgctaacaagaccccccctcccctgatcacctagtgataaccttggatcatctttgtccccatgaaagcttcttgggccagaggatcagagaactgtggccctgttggagcatgcggtcatccagtccaggccctgttgtttatgtgtgaagctttggactccccctggattttctttgaaagccccttgtgacatttatcacatgttgccttgtattcatcttccagaccctactgaatgttaacctttttgagtgccaagactatttctgttcatctttttgtcctccacaatggaaactacatgcctggcatacagtaatatgcaacagtatgggttaataagtatatgaatttggctgggcgtaatcctagcacgttgggaggctgaggcaggaggatcccttgagcccaggagttcaagactggcctaggcaatgtagggagaccctgtctctaaaaagaaaagaaaagaaaaataaatatatgaatccatttattcacacattgattctacagtatctttgaagcacttactctgcctggctggggagaggatttatagcccagtcagggaaaataacattagtcaaactatgaaatataattatatgttgtgataaaggctgagggagaagtcatggggctgtcagaacatttaatatggggccctatctaatctggtgggtcatggacagcttccctgaggagatgaggtttgagattagacccaaagtacatgtaggagttaccaggagcggcaggttggaaatggagggcaggagtagaagggaagggcataacaggcagaggccagtttgtgcaaaggctctgtggcagaaagcattgagatactttctggacaccaaaaagaaggctgatatgatggagcacaaggaataagccggaggtgcagccagagatgtcaggagacccaagcctgtctgaaggattttgtcctttatcccaagagtaataagatgaattcacctttcatgtcactggcaccttccaggctgcccacctgttgttctctggaatagctggtggatgtccctcagtggtctgagttcctctgtgtccagttctgttcctggctgatccatgagcctcatgtgatggttagttggccagaggctgcttgcctgactgtatcctttctggttatttttttgctgtgataaatttaatctctctaatttctatagtaacagaaagggtaccattgttatcctaattactggaaaagttgccatcacaaccaggcctgtgctgcttattcatcagagatttattgaatactaagtgtgagccaggccctattccagcagggaacagaacagcatcagccctcccctcagagtctacagtctatggcagagtcagatgttaaactaataaaccacaagtatatatttgatcacagattgtgaagaataaataccatgcaggataaacacagaaataactggggtgcacctaatttagaatgggggtgtcaggtacgatgtcagatgctcatgaaccttgtcccatggcattgtcttcccaacagccagcagagtgtttgttgcatgaatgaagaaggaatgcttggatgagggcttgccctctttcttgctgtagaaagtgagatttggtgcccaagatcacacaagctggcaagtgaaagtgctggggttggacctggggtcccctgagtagcttctgttttgtatgcagctggcctgctactcccttggcaccatcggggaaatttccacattcacagtgaatattatttcagcctctgctgtcctcctctctcctcttgaccgctcacatgctgcctgtcactgtgtgactgtctcagagctgaatgagtgttaccagtggaaggtgtccaggttcttggcacctcaaagagttggacaaaatgcacaaacaaagcaaggaaagaatgaagcagcaaaaggagagatttattgaaaatgaaagtacactccacagtgtgggagtgagctggagcataggggctcaagggctcctttacagaattttttagggtttaaataccttctagaagtgtcccgttggttacttggtgtacacgctatgtaaatgaagtggtggctcgcaatcagtctgattggttgctgaagtgaagttacaaagttacacttctatgcaaacgtctgtttggttgtaaaaatcaaaccaatcagagacactttcagttttccatctgcctcacagaaaaagcggagagtggtttgtgaagggagtaacctccggtccttttgttacttaggtgtggaaagttggggttttccttttgatttagttctaggaagtcagcctgaattagtcttaggttccctgcctccagaccctgttctcctgcctcaagaggactgcctttcatttctagatcaaaggaatcttggcttggcttggttgttctttgaggcatgatttttactctcttgaacacttgtcattttcttgattcctgattattttcctctttcctgcgttcagttcagttcagctaatactggacatggcactttatcaggtgcttctaaaaatgtaaggaggaacaacgtttgagccctggcctcctggaagttttaatttgtaaggggtgacagatatacgcacaaggaactatatacaaggtaggattcagactgctgatggggcctgatggctttctggaagaagtagcatttgatggtgacttcagatgatctgggatttcagtggtggcccaggaagagaatgcaaaagaaacaacatgagcaggctgagcacggtggctcacgcctgtaatcccagcacttcgggaggccgaggcgagtggatcatctgaggttgggagttcaagaccagcctgaccaacatggagaaaccccgtctccactaaaaatacgaaattagcctggggtggtggagcgtgcctgtaatcccagctactcgggaggctgagacaggagaattgcttgaacccaggaggtggaggttgcagtgagccgagatcgggccattgcactccagcttgggcaacaagagcgaaactccatctcaaaaaaaaaaaaaaaaaaagaaacaacatgagcaaatatttgcagcaaatcaataaatggtccttttagactgaaacttggtatagcagtttaggattagtgagagctaggaccagaaagctaggttggctgccaccttggagtgagaacctcgaatgccaaggtgggcagcttatgctggtgtagtagagttccattttagtaacacagtcatctcttacagaactttcctctccagaggatgaggtatcaggttgttcagctttgagtgtgccatctaggtgctatcagctagcaccttcaggctctaatctgctcctggttggtttaataacagaaaaatctgccaacctcaggagttttttgtttgttttttttaaccaagaataactttcttccatgaaactgcccctaagagaaagtgttacattgttttctgaatctatatggatgagaaacaattgtctgttataggaatgagcttcaaacagatggaggaaattattatttttctgttaggccttgtgtcccgaaaccgccctgaggaggaggaccagtattggctgagtatgggcagaacgttccacaaagtgacgctgaaggataagatgatcacagtgacgcgataccttcccaagtgagtatttggatatttaaagtcttcagttattgtcctgaattatggccacatactaaattgtgtgtatagtacatcattcaaactgaggaagttcagtggttggtttttcttttggagttttgtttgtttgtttctagggttattttagggttatagcttacctacttccaaaagggatttgattcatcttataatgtttagcatgattcatgacaagcctatttcaaataaagattgtgaggagagaagaaggaaagagtttaagaagatctgagaaatttctagtaccgttccctgggataagttggttactacagttgaggggtaaatgtcaaggatggttctaagtgtatagagatagaaaataagaattggcaggaatttgtctctaactcttttgaatttggggacctgccctttattttgcaggtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcaggtcagagagtgggctttggatttccatctttgcatccttgggcaaggatgtgtatgtgtattttaacactttctgccctttctctctctctccctttttctttttttttttctttgtaaagagacagggttgactgggcgcggtggctcatgcctgtaatcccagcaatttgggaggccgaggttggcagatcacctgaggtcaggagttcgagaccagcctggccagcatggcaaaatcctgtctctactaaaaatacaaaaattagctgggtgtggtggtgcgtgcctgtaatcccaactacttgggagactgaggctggagaatcgcttgaacccaggaggtggaggttgcagtgagccaagatcaagccattgcactccagcctgggcaacaagagtgaaactgtctcaaaaaataaataaataaaaaaaaataaaattaactgggcatggtgacatacccctatagtcctagctactcaggaggccgaagtgcttgagcccaggaggtcgtggctacagtgagccttgatagtgccactgcaccctagcctgggcaacacagcaagaccttgtctcaaaaaaataaaataggttaatgtgataaattttttgttatgtgtattttgccacagttgaaaaaacaaaccccatgaagctcagggatgacgtgcccttgatgcaagtggcagtgcagattgccttcttaacgttctctccactagttggctggtagctttgtgacgcctgatttttaatttttgatttctatgcatgatttgtgattgtgatgatagccacaaattcactgggcctgggtgtgcagaagcattctgatatctctggaatcaaagcaaaaactgcctttgtggtcttccttcagagctcttttttttttttttttttttttttttgagacaaggtggagatggggtctcgccatgttccccaagctggtctcaactcctgagttcaagcaatcctcctgcctcggcctcccaaagtgctgggattataggtgtgagccaccatgcccattctcagaacttgtattttcaacaaagccatgagctgtagcatcaaatgagcacatactcatggggagatggaccttcacacaccaactccacagagagtttactgagagtgctttcattatctcctttctctcaccaccaccctgtgttttccttgcccccttagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcgggtaagggctccttagactcagggagtgcgcctggtgtgagatgcagggcctgccacctcctctattaggggcctctcatcatcagcctacttatttactcctcagctgcccagtgtttaccttaaatccaaaacagtgttttctcctccaccgcggggtaaaggaggaagggatagagtgcaggcagtgactgggtggtgttctgtggcatagagccattcccttccacctgaggacatggtgccttgaggtgctccccaagtgggaccctatgttgagcacagctgcttgtgtgactgggtgctgaacctctgagtagaaactctcaggaggtgaacagcagcagtccttcctcactcttcttgctccagagttcccagcaccctgtgccttatttcagtcacacaccacccagtgcggagactcaggcttctgggggttatggaatatgccagctataaggggcagaactgggattcagcattttttttaaacatatagtataattgacgtgtgtgtgtgtgtgtgtatgtgtgtgtgtgtgtacacaggtctgtgaattttaacaaatatatagattcatgcaaccatcaccatcacttcaaaaaaattctctcatgctagtcttttttttttttttcgagacaaggtctcactttgttgcccaagcaggagtgtggtggcatgatcatggctcactgcagccttgacctcccaccttaggcttccaagtagctgggactaaaggtgtgcatcatgtccagctaattttttgtattttttgtagagatggagtttccccattttgcccaggttgttttcaaattcctggactaaagtgctgggattacaggcatgagccaccatgcctggacttatgctagtcttgatagtcatgttctcccccatctctaatccctggcaaccactggtgtgttccttatcactgtacttttgtcttttccaaacatcacagaaaagagaatcacataatatgtgaccttttgaggctgccttctttcacttagcataatgccttctgattcatccaagttgtgtgtgtaagtagttcactctttttaatcaccagggaatgttccatcatcagccatgttttttttgtttttaacctcaagttcagtattcttcctctcacaccagctgccttatgtacacaacatcacttacgattagaaacgtgtctgggagagcttggatagtgggaagaactttggttttgaagtgaggtcactggagtttggattccagctccagtaggatgtgggataagttccttaacctctctgagcttcagtttcttcttctgtaaaatagggctaacattatttacatcatagatctgtggtgagggtgaaatgaggatgtgcaaataaaggggcagtttatttttagctgaccaggcatttgaatgaaaggcggttttctgtcacttactgaacactgagaacctgtgttccttgaccctgtccatgggattcccggggcctgggaatgctgcagcatgccctggggcatgagtggcttccactgagagcccacttggctgatggccttgtctcctcttctctgctttagaaagggaccgccatgaaaggcttgcagatgactgggcccatttccacgcattctctggagtcaactgcacccccagtggggaagaagggaacctcagctctctctgccctgttggagatggaggccagtcagaagtaagtgcttggtggaagactgacttgtccccaccttgacagccctgagggttttcagtgccctgttcccttgagggggtgaaatatttcctttacaaggagcttgtaattagggagaaggcatttatgtgaaaaggaaggctaatacctggtaggtgttggataacatgaaataggccagaagttataaacttttagattgggacttaattttaattacagactcatttaatttagcccacaaagtatttcaacatatttgagccggggccaggtgtggtggctcaggcctataatcccaccactttggaaggccaaggtgggcagatcacttgaggccaggagtttgagaccagcctggccaacatggcaaaaccccatctttactggggaaaaaaaaaaaaaagccaggtatattagtccattctcacactgctaataaagacatacctgggactgagtaatttatgaaggaaagaagtttaatcaactcacagttctgcagggctggggaggcctcaggaaacttacaatcatggcagaaagggaagcaaacacatccttcttcacatggcagcagcaaaaagtgcagagtgaaggtaggggaaaagccccttataaaaccatcacatctcgtgagaactcactatcatgagaacagcctggaggtaactgcccccatgattaatttacctcccacctggaccatcccatgacacgtggggattatgggaaccataactcaagataagatttgggtggggacacagccaaaccatatcatttcacccctggcccctcccagttctcatgtccttgcatttcaaaacacagtcatgccttctcaacagtcccccaaagtcttaattcattccagcattaactcaagtccaatgtctcatctgagacaaggcaaatcccttttgcctatgagcttgtaaagtcaaaagcaagttagttacttccttgatacaatggggtatgggcattgagtaaatacacccattccaaatgggagaaattggccaaaacaaaggggctacaggccccatgcaagtctgaaatccaatagggcaaccattaaactttaaagttccaaaatgatctcctttgattccaagtctcacattcagggcatgctgatacaagaggtaggctcccaggcccttgggtagctccagccctgtggctctgcagggtaccaccccacttcgggctgcttttacggcctggtgttgagtgtctgccacttttccagatgcatgatgcaagccgtcggtggatctgccattctggggtctggtggatggtggccctcttctcacagctccactaggcagtgccccagtggagactttttccttccgcactgccctagcagaggttctccatgagggccctgcccctgaagcaaacttctgcctcccctgaaatctaggcagagattcccaaacctcagttcttgacttctgtgtacctgcaggctcaacaccacatagaagttgccaaggcttggggcttacaccttctgaagccatgcctgagctgtacattggccccttttagccatggctggagtggttgggatgcagtgcacggagtccctaggcagcacacagcaggaggccaggcccaggaaaccaatttttccttctaggcctccagccctgtagtgggaggggctgcatgaaggtctctgacatgccctggagacattttccccattgtcttggtgattaacattaagctcctccttacttatgcaaatttctgcagtaggcttgaatttcctcccagaaaatgggtttttcttttctgtcacatcatcaggctgccaagtttccaaacttttatgctctgcttcctcttgaacactttgccacttagaaatttcttccgccagataccctaaatcatcttctcaagttcagagcttcatagatctctagggcaggggcaaaatgccaccagtctctttgcatagcaagagagacctttactccagttcccaacaagttgcccatctccatctgagaccacttcagcctagacttcattgttcatatcactatcagcattttggtcaaagccattcaacaagtctctaggaagtgccaaactttcccacatcttcctgtcttttgagccctccaagtcactgggaagttccaaactttcccacattttcctgtcttcttctgagcacccccagactgttccaacctttgcctgttacccaattccaaagtcgcttccacattttcgggtatctttacagcagtgcctcactccccagtacaaatttactgtattagtccattcttatgctactaataaagacataccagagactgggtaatttataaaggaaagaggtttaattgactcacagttcagcatggctggggaggcctcaggaaacttaaaatcatggtggaaggggaagcaaacacgtgcttcttcacgtggcagcagcaaggagaagtgcagagtggaggggaagggaagccccttgtaaaatcatcagatcttggtgggcatagtggctcacacctgtaatcccagcactttgggaggcctaggtgggtgaatcacctgagaccaggagttcaagaccagcctagccaacatggtgaaatcccgtctctactaataatacaaaaattagccgggcatggtggcacacacctgtaatcccagtgactcaagaggctgaggcaggagtattgctggaacctgggaggcggaggttgcaatgagctaaaattgcaccactgcactccagcctgggtgacagagcaagactccgtctaaaaaaaaaaaataagtaaataaaataaaaccatcagatctcatgagaactcactcactatcacaagaatagcttggaggagactgcccccattattcagttacctcccactgggtccctcccaagacacatggggattacaggaactacaatttgagatgagatttgggtagggacacagccaaaccgtatcactgggcatggtggcgcatgcctgtaatcaaagctgctttggaggctgaggcacgagaatagcttgaactcaggaggcggaggttgcagtgagccgagattgtgccactaaactccagcctgggtgatagagtgagactctgtctcaacaacaacaacaacaaaatttgagccgggttttaaatttgaagattccatataaaaatctggattgtatagattgtatatgaatttttatattaaaaatataatatacattatatatatgacatgatacatgatgttatataatatgtaaaacaatatattgtggataatatactgtagtactctcaatgctcaatttcagttacccaaggtcaactgtggtccaaaaatagacgagtacagtgcaataagatattttgagaaagaaaaagagtccacattcacgtaacttttcttacagtatatggtataattgttcatttattattagttattgttgataatctattactgtgcctaatttataaatgaaactttagcataagtatgtatttataggaaaaaaacatagtacatacagggcttggtactatcctaggtttcagacatccactggggatcttggaacatatacccctcagataagttaggactattgtaatgcaaagttggccaggtgcagtggcccatgcctataatcctagcactttgagaggccaagttgggcagatggcttgagctcaggagttcgagaccagcctgggcaacatagtgagaccctatctcaaaaaaaaattatagttaatatataaaacccagttttgcttgaggccgggcgcagtggctcatgcctgtaatcccagcactttgggaggctgaggcgggtggaacacaaggtcaagagattgagaccatcctggccaacatggcaaaacctcatttctactaaaaatacaaaaattagctggcatggtggcacgtacctgtagtcccagctacgcgggaggctgaggcaggagaattgcttgaacctgggaggcggaggttgcagtgagccgagattgcgccactgcactccagcttggttacagagcgagactccgtctcaaaaaaaaaaaaaaaaaaatccagttttactggatttacacagggtccacatctgcacccagccacagtgagctggcacttcagaaggggcatatgccttggtttcacactctggtcttaaacttgtctcacacactcagtcatgctagctggctggcttttctaggcctttgggtatgtggcctctttataaacagtaagtgttaacagttgataagacactgttgggaccacacttggttgggaaggcaggaagagtgtggtgtcatgggaggtgggattcaaactggcattgtaggaagcaaagcgtttacatgggggtgggtgagacttgaggaagagaaaacattgccttgggctgccttccctgcccctctccacctcacagctagatcaggttcctccctgtgcttgccagcatcctgggcctacgtccatcagagcacttaccagtattctgctgggagccagttgtcagttgacttctccctgacttgactgtgtgctctgaggccagaggctgtgtgccatgcctggcacatagtaggtgtgtaatggatatttattgaatgatgggttgggggatgctgagggtctccctgtagagatgtgaggtgagcatgttaggggaggctagaccttgactgtatggtatgagggtctgtcatgcccgcaggaacctgcacacattaggctttccagaagtaacattgaacaagcaaacgtgaggtatggtggggacatggaattggaaagacagtgtgggaatttggatgctaggctgtccttacacattctcatggcaagaggaatcctttgaaagttttaaaaattctattacaggccaggcgtggtggctcacgcctgtaatcccagcacgttgggagactgagaggtcagggttacttgagcccaggagttcaagatcagggtaggtaacatagtgagaccccatctctacaaaaaattagcctagagtggtggtgaatgctgaggtgggaggattgcttgagcctgggaggttgaggctaggctgtaattagcctcagttgcgccactgcattccagtctgggcgacagcaagaccctgtctcaataaaaaatgaaaataaaaattttattagaaaatttcaaagggatacgaataatagactggtataataaattcctgcttacccatcatcacgcggcttcagtgagaatcatctcatggctgaccttatttcatttctatccaacttatgttttccttttatttatttatttattactattttttttttttttttttgagatggagtttcgctcttgttgcctaggctggagtgcaatggcacgatcttggctcaccgcagcctccatcttctgggttcaagtgattctcctgcctcagcctcccgagaagctgggattacaggcatgcgccaccaccccagctaattttgtatctttagtagagatgggttttctccgtggtggtcaggctgatcttgaactcccgacctcaggtgttccacctgccttggcctcccaaagtattgggattataggcgtgagccaccgagcctggcttcttttatttttttaaatcaaattcctgatgtcatttcccttcatctgtaatatttcagaatgtacctcggaaagacaagtactcttttttaaaaaaacaaaaccatggtattataatttacctttaaaattacaacaattccttaatatcatgaaatagccagttggtgtctttggcagaagtggttttttcggagatgagctccctgtgtgggaaggcttggtgggcgggggccaggaggcagagtcctatcaggaggctcccgctagtccaggcaagaggcagctgaagctggatggagggtgatgatgagatgaaaaggaagggatgaagaacacggcagggtgcctacggtgaggggacagatgagagaaagataactgggataggttgggtttgttactgagggcactgggtcttcttttgaacatatctttatcagaccaaaggaagatgccaggactctgtgtggcaatttctccctgcaactaatcacagacttttcccactggaaaagagaacaaggaacatatgttgctgggaggggtgtcaagctgggggtgaggtgaagggatcttattttgtcagtgagtcattgtttagtatgcaccaaggagcctgtttctgctcacactgaagaagcatatcttgggggtagtggtacccccagtgtgaagggtgagattctcagccaaccccaaggcaggaggcaggacaaagagacccaagacttcctccttgccacggatgactgctcccgggagacgtgctacattttctgaatagaggtagagtagagggaaccagacatttatataacatttgtataacatttgcttgcacagaattttttatttatgtgtttttctttttctttcactgccccagattccattttattatgcaaaacaacatacagcagacaacatacagcagcatgaaagcgcttacagaatttcacctgtagtcccaccatcttaactgtgtatatttcttccagttttcttcccatctttatctgtaggcatatacatttagtcgggctcttgtgaaagacagaaaccctggaatcttagctttgtgctgattaatagcagtgggaccagtctgggcagcaggtgctggccagtgggcttttctgttcctattagatgaggatgacagccaagtcagggcagagagagagagaccccaccaaagcagatggacattcatgttctgtccaaggtggctctagtatgtgcgtcttactcaggcctttctggggaaagcctgccagcaatgagccacagtgtgccatctgcctgcagaggcacgtgaagggcgtctgcgtgcttttacccttcctgcttctgtgtaggctgtgtcttcctcctgcccaccctttaaggcccacccggtgcatatgtgtcactacctccatggaggtgtggctagtgaccccctcctggctgaacatacctgagcatgccctcatgtatgttctcatgtatgttctcatgtatacacatatgcattgtacctggtggttttgtggcagtcccctcttcctgagccattagaagaagagcttctaagggcaaggacagggtcagtcttcttctcagaatccctgactcctagtcagtgcatcagcatatagcaggtgactcagtacatgtggactgtcgtgtgcatcagatgacaaatccaagtggtcactggggatgcaagaatctcacagcatgcatttgtggatgaggcttggaggaaaacacactgcattgtgatagaaagagagactgtggtgtcagtggacaaggaaaataatctagcacctagttttttgtcctgtgaattacaccttagagcatccaagtaattggtgtggggaagtttctctttttaaaatatcccagctaataaatacagaaggaatgatggactgtcactgtgtatagtctctgatgaatgaatggatctagcaaagattatcagtggcagctcacatcataagagagaggcagccattctgggcctccaggcagaagtgcacggtaccacttaggaagaatagtggcccaaaatttgaccaaaatctgcccaaatcccttgatgtaacttctgcttctcaggaagtacagggcacagaagaacatgttatataataaagggatgtaatcagcacatccagactgtgtaagtttacagggctaaagagctactttctttaacaaataaattgcaaggataaggagagatgaagaggagcttataccttaaaaaggacttaagagatataatgtatgacaatgtaaggacttaattgagtcttgctggttttttttttttttttctttttttaagacagagtcttgttgtgtcgcccaggctgcagtgctgtggcacaatctcggctcactgcaacctctgcctcccaggttcaagcgattctcctgcctcagcctccagagtagctgggactacagacgtgcgccaccacgcctggctaatttttgtatttttagtagagacagagtttcaccatgttggccaggatggtctcaatcttctgacctcgtgatccacccaccttggcctcccaaagtcctgggataacaggtgtgagccactgtgcccagctaaaaaaatttttttgagacaattgaggaaatatttgacattagaaaaattgttatcttttagagatactgaaatgtttaaggatgaaacaatgtgtgagttttgcttcaaaatatttcttttttttttttttgcgacggagtctcgctctgtcgcccaggctggagtgcagtggcgcgatatcggctcattgcaagtgccgcttcccaggttcacgccattctcctgcctcagcctcccaagtagttgggactacaggcgcccgccacaacgcccggctaattttttttgtatttttagtagagacggggtttcactgtgttagccaggatggtctcgatctcttgacctcgtgatccgcctgcctcggcctcccaaagtgctgggattacaggcgtgagccactgcgcctggccaacttcaaaatatttcatgtgggtaggcagggtgtatggatgaaaccggaatggctctaatgatataattttggtaagggatatgtaggggttcattatattgtcctctttacttttgtatatgtttgtattttttcagaatgtaaaaaaaaaaatttaagggagagtgcaacaggttactatggaaacatatttttgcatccctggtatgtgattacttctcattgagtaacaaaagtgtcagaatttaagataagaaaagtgttgcaaattgggttctcagggaagcggactgagatggggtgtagcatataggatgcttattaaggagagcccttgggcacaacacctgtgggagagatggggaagaaaccggagtgggtgccaagagaagctggactacagcccagacccagtgacagcctcaggagatcccactggaacagccctcagagatgtgctgagttgggccaacgcgcacacacacacacacacacacacacacacacacacttcattgcctatgacacacacacacacacttcattgcctatgacacacacacacacacacacacttcattgcctatggcagcccatgcagctggggctgtccctgaaggggccaacaactgagacagagcctcctagacagccctctcagtgctgggacaacaacaaggccatggtggagggggctgggacctgcctcgcactgtccatcacaagaagtaatatatattatagtaataatgaagcacttaagacttcagtgtgagccttctgaaacctaacaataaaacagtgatatattaaagcaacataatttaatctaaaataaagtgtagttaattttagaacagaaaaaaattaggaaaataaacatgaaaatattcattcatgtacatcagaaccgagatggggtgagatgtcgtaaggatactgtatttgtcttgcgttatgagataatgtctgttagtttggtttggagggtgatgtagctatgtacatttgaaagattaacctataaatcccttcaaaatgtatagagaattaacacatcttctcctgttttatgctgcatgttaatgcagttttttgtttgtttgtttgtttgtttgtttgttttgtcgcacaggctggagtgcagtggcaccatctcagctcactgcgacctctgcctcctgagttcaagtgattctcgtgccttagcctcccgagtagctgcgactgtaggcgtgcactgccacaccgggctaattttttgtatttttagtagagatggggtttcaccatgttgaccaggctggtctcaaacccctgacctcagatgatccacccaccttggcttaccaaagtgcggggtttacaggcatgagccaccacacagtcttaacattcagaatgtgcttttgctggtatattaaataaaaattgagaaaaaagtacttttacaagaattttaaaaatggtgttcacagacagtcactcaaaccatgtcagtcccctttttaaggtcatatataagcaccagatgctgccagaatgcttttaaagttgggctattttctgatttactgtggaggactggtgattgttcagcacaatgaatgaaattaagggtatcatgaaggtctggaaagggaaacaaggcagaagtgtgtgtttcaaagatgacagcaacagagctgtctgcatcttggccgacatggatccttcaccagggagctctgagcaagctgctgtcatgtgcttttcctcctttcaggtgcctgggagaacagcaggcagctgtgcatggtgggaagagctccgcccagtcagccgagagcagcagcgttgccatgactcccacctacatggacagcccacgaaaggtaaaggaagccgcggtagcagggagctgttctgtgctctcagagactcagtgtggagggtaaaacagatcgcccttcagatccgggattgcatgtgcagaggctttggatgaattctaccctgaaccctttaaaggttctattactgttactacttttatatagggactttcttattcacagttgtaaggaagctaacttctagttaaatccggatataaaacggtcagtcatgcttgtaatcccagcactttgggaggccgaggctggaggatcacttgagcccaggagtttgagaccagcatacgcaacataaggagacaccatttcttaaaaaaattaaaaataaaattagctagatgtggtggtgtgtacctgtagtctcagctactcagaaggctgaggtgaggggatccctagagcccaggaggttgaggttgaagtgagccatgatcacacgactgcgctccagccttgggtgacgcagtgagaccctgcctcaaaaaaataaaatacaacagttaagctaaacctctttggttcaatgcccaagatctggcctgagctttgtatttggccgtctggttttccttcaccctcatctttagctttcccagaggggaatagaaagctactgaagtagcttccaccagagctcgctcttctttgataatgaaattcccatcagttttctcagactgctgagaaatacagtcaaatgggagtatcctggggtggggggaaaatacagaaaacctgagactttaggcctctatcaggaacaagtacaataaagaagccaaaaactccatgggtcttttaagaccaatagacttggctctgtcagctccttctgggaaattcagattcagatcattctgttgtgataggacaagctgactgtacttacctctctcttgtccctatcactgggagatgaaggagattcaatacatatatgttatttttcaaaattgtggtcaaatggtatatctgtgtttattttacctccatatcatgaaaatttctcatgtcattaaatgttttacaaaagcatgatttttaaaaataattatatacttttttctttcgttttttttcccctaagcaaccccaaagaaaaaaatagctatatatcattttatcatatgaatatgccttaatttataacttcttttggttaaaattgtagatggtgatttttaaatgatttttggtatttttctataaactttaagaattattctacagtataccacagttataatgttgcagtgaatatgcttggaataatcatttgaccacaccactgataattccttagcataaatactgtaattacactacatgggtagagggataaaaatctgagaagaagtatcagccaaggctgtgggcaacttgtaaaccaaacgttggcaaacctaaatacatattttagactttgtggccaagaggcaaagcaaagctattgtgtaagtatagtatttccataactatttaaagttgtaaaaaccattcctttgtttttttttttttttttttttttttttttgagacggagtctcactctgttgcccaggctggagtgcagtggcgcgatctcggctcactgcaagctttgcctcctgggttcacgccattctcctgcctcagcctcccaagtagctgggactacaggcgcccgccaccacgcccagctaattttttgtattttttagtagaaacaaggtttcactgtgttagccaggatggtcttgatctcctgacctcgtgatccgcctgcctctgtctcccaaagtgttgggattacaggcgtgagccactgcgcccggcttttttttttttttttgagacagtcttgctctgtcacccaggctgaagtgcagtggcacagtcttggctcactgcaactgcaacctcagcctcccgggttcaagcaattctcctgcctcagcctccccagtagctgggattacaggcgtgcaccaccatggccagctaattttttttatttttagtagagacagggtttcaccgtgttggccaggttggtcccaaactcctgacctcaagtgatccacccacctcagcctcccaaagtgctgggattacaggcgtgagccaccatgcgcagccgtaaaaaccattcttagctcactggctgtaaaaaaatcagagggctggccagatttggcctgcaagctgtagtttaccaactgctgctctagggagtggcattaggtaccaaggacagtctgtgtgtaaggaatgatctgctgaccatgagtcttttcacctgaactccttcacatgtacataaacctcaacaccatcagcacctctgcttctatatgttctggcagttagaagggacacagtggaacaatgagataaaattaccctgtgtgctgtccaccaggttttgcctctactcattgccatctttgagggtcagaaacagtgctgaggacatgactgaaaagcagagaaattatagtcgcaaatatattagattgctgtttagaaccctctcctgattgtccaggtgaacgctaaaatccacatgcatgacccatcagtagggctggaagtaaactcctgaatagtcaggggaaacaaaatgctatgagatggccaaagcagagagccctgctgacatgctcagaaatgcccaactgtttccccaaggaacacttcatgttagaatgcgttgggggtacctgcatcagcatctccgcagccacaagtttccaaggtttcgtattggagtttgcagtcacttacgggaagtggcagcagtatcaataaaatgggcacccaaatatttcagttattctacctttggaattgaggaaaagttccagaaaagcagagaacttgagatgtgtcaagtgccattcctgaatttctatgataaccagacataaaaagtaaaaagattccgaaaggaaagagggtactacttaagaatgatggaaggaggggtcattgaaaaagtcctccgtgtcatttttgtttcacagacatggctgcttgaattccacaagggtagggtagggagggaatgacagctttagaaagcccctcacaatgtgagtgcttgtgtatctgacattatatatgtcttagcttgctgatgattttgttacacaaccagtggaggagaaggtatggctgcttctgtatcccctgtttgctaaaaaaaaactaagcaagaacttaccctgccttgaatcctctcctcccatctggctgcccatgtttagtaacaggcagaaaaaacctcctggctcaatgtatctctccaagagggcgactggtcacccagccaggtgggaggccaggatgttgccaccaaagcccttaccctgcagccccaccaagctgctctgcggccttttcatcttccttggcataggtctgaaggaatttcagagctatgtgggagggtgagagcatccaagccacactctgatgagacctgagagagcttggacacaccttccaacctgggtgctttctcccacacagatgggatattctgcccaggaaggtgtgagtttctgctaatgcttcgcatttggatattgtctttctgggtggcgctctctctctctctctctttttttttttttttaattttccctatcctcttcatatgtccttgtttctctccttccctccttgtttttatttttattttttgttttttatacctgtctccttcccctgatggttaaccactggtacacattccgtttcttcgcttccttgcaactgctgctgctgcttcctcctcctgtgacttcaggacggggccttctttatggagtttgtccgcagcccacgcacagcatcgtccgccttctaccctcaggttagtccaactccagggcttcgcatgcctgtcccactggcagacgccatgagctggccttctgttaggctctgaacacatggaattgggctgcaactaagtttggggggcagttgaacttgaatttggtctcagaattgtacattctcttccatgttgtttgtggcggcgaagggggggatggaagaggttaatgtagaagaacatatgattgtaccagtgatgactcaagtgtttctcatcactgtctgtttcacatagttgtcactgattctctgccactttgcagcatcttcacttttaggttttatgagcaacatgaaatatgcttagttaagggctgaacacttatttttttcccctcccaatacaaccagataaatttataacagtgtggcaggaagtggtgaaaaaacacagcaaatatttattcataggcatgtgctaatgcataggccaaaggtgtagctcacctagcttctggatttcacttaaattatttgtcagttaaaagatttggatgagccgggtgcggtggctcacgcctgtaatcccagcactttgggaggccgaggcgggcagatcacctgaggtcaggagttcagtttgagaccagcctcaacatggagaaaccccatctctactaaaaatacaaaaaattagctgggcgtggtggtgcatgcctgtaatcccagctactcgggaggctgaggcaggagaattgcttgaacctgggaggtggaggttgcagtgagccgagatcgtgccattgcactccagcctgggcaacaagagcgaaactccatctcaataaataaataaataaataaaaataaaagatttggacgaggccaggcacagtggctcacgcctgtaatcctagcactttgggaggccaagacaggaggatcacttgaggtcaggagtttgagaccagctgggccaacatggcaaaaccccatctctactaaaattgcaaaaagtagtcgggcatggtggcacatgctggtaatcccagctactcaggaggctgaggcaggagaatcgcttgaacccaggaggcagaggttgcagtgagccaaaattgcaccactgcactccagcctggcgacagagccagagtccatctcaaaaaaaataataataacaaaatagaattttttaaaatgagaaaagaaaaagttgttagctggttagtgggcatatagctagtgagtgactgagctcttatatcattctgcccactgcactgggagggtaagggtttagttaacattggaacaggtcagaggtaccatgcctttctgtgtaggtcttcggatatccccacctgcctcttcccagtgagctgtgtaaccataggcaaatccctgtaaggacctttgagtcctaatctaagcatctctaaaatctgagtgtgggtagcacactgtgtttttggtttaaaacaaacattggttgatccttttcaccttttactttcttttttttagaggtagtatcttactcggttgtccaggctggagtccagcctcagcgtcccaagtagctgggagtataggtatgaaccaccatacacagctaattttttatttttttagaggtagggtcttgctatgttgcccaggctggtcaactcctggtgtcaagtgattctcctgccttggcctcccaaagcactgggattacaggcatgagccactgtgtctggccattaaccttttactttgtggttttttgtttttgtgttgagacagagtttcactctagctgcccaggctggagtgcagtggttcaatgtcagctcactgccacctccacctcgaaggttcaagcatttctcttgcctcagcctccccagtagctaggattacaggtgtgcaccacaacgcccggctaacttttgtattattagtagagaaggggtttcgccatgttggccaggctggtcttgaactcctgacctcaggtgatacgcccaccttggcctctgaaagtgctaggattacaggcgtgagccattgtgcctggccaccttttacattcttataggagactgttatggaaagttttagactcaggagaggcacacaaataaggattatattacccaccaggtgttttgttgaaaaggcaggaagtgaggtgggaagatcacttgagcccaggagaataagaccagcctggacaatatcgtaaaaccctgtctgtaattttttaaaaatatatacataaaaaaattatattaggaggccaaggcagacagatcacttgaggtcaggagttcgagaccaacctggtcaatatggtgaaaccccatctctaataaaaatacaaaaattagaccgggctcgtggcgtgcgcctgtagtcccagttacttgagagggtgagggaggagaattgcttgaacctaggaagcagaggttgcagtgagccgagattgtgccactgcactccagcctgggcaacagagtgagactccatctgaaaaaaaacaaaaaaaaattatatcagaagtagtaagagctcattatacatacacaaaattaaattgtaccttatgtttatttattatttactgtggtaaaatacacaacataaaacttgctttgtgtattttctgatgtgcagcatagaatggaggagggaggccaatggagtcagttggatgctttcttttttttttttttgagatggaatttcattcttgttgcccaggctggagtacaatggcgcagtctctgctcactgcaacctctgcctcccgggttcaagtgattgtcctgccccagcctccctagtagttgggattacaggcatgcaccaccatgcccggctaattttttgtatttttagtagaaatggggtttcaccatgttaggctgctctcgaactcctaacctcaggtgatccacctgcctcagcctcccaaagtgctgggattacaggcaggagccaccaccacacctggcccagatggctgctttcaaatcttgacctctgtgcaatgttagggagctgtgttaggcacatgaattaaccttctgaacctgtttcttcattaaaatatatatatatatatatatatatttatatatttatttatttactgtgtgtatttcttcatttgtaaaaggaaataaaaaataatttctttgtagggttgttctgaggattagaaataatatccatttctcagtcatgcgtggtggctcaagcctataatcccagcactttgggaggccaaagtactgggatctcacttttttttgagatggagtcttgctctgttgcccaggctcaaatgcagtggtgcgatctcagcccactgtaacctccgcctcctgggttcaagtgattcttctgcctcagcctcccaggtagctaggactacaggcatctgccaccacagccagatattttttttgtatttttagtagagatggggtttcaccatgctggccaggctggtctccaactcctgacctcaagtgatccacccgccttggcctcccaaagtgctgggattacagaagtgagccatcgcgcttggcctaattttgtagttttagtagagacggggttttgctatgttggccacgctggtctcgaactcctgacctcaggtgatctacccgcctcggcctcccaaagtgctgggattacaggcgtaagccaccgcacccagccgtattttttttatcttattgtatgtctgtttattagtagcctcaccttttttggaatgatgtaagatgtaaaaatataagtaacgccaggcgcagcagcccacgcatgtaatcccagcactttgagaggtggaggcaggaagatccctattagtccaggagtttgaaatcagcctgggcaacacagtgagaccttgtctttacaaaaaataaaaataaattagctgggtgtcgtggtgcatgcctgcggtctcagttatttgagagactgaagagggaggagtgcttgagtctgggaggttgaggtggggacagtgaccatgattgtgctactgcactccagcccgggcgacagagcaagacctgtctcaaaacaaaacaaaacaaaacaaaacaaaacatatatatataaccatttggagcgaggggttaggatggacacatagaggaaggaggctgcctctgtgacaaaattcatatcaattgagatagcaaattccaagcacctgctgggtgtagggctgtgccaagtgttgtgggaaataacagggatgaataaaatcctttatgaatattaatgcctgtctttgctcaccgctagatggcaagcttcatgagggcagagagaaggttttaatttgggataatattccccttccctaatcttaaccttggagaacatctgagctgtgggtctgcaagttattcccaagctttccctctctgcaaggcatatgggattctgttgtggatccctttgcaatgcctctgtctgcgtggcaggagctgagtgactggaaagcaggagcccacttagcccatttgtctccgggtaagacaaaggggagtgtcatctctaccagcctccaggcacagtggagagctgggctggcagatccagctgtttccttgtagctgatgacccaccagcatgagaaagtggggctgtgacaagcccacgaggtggaaggtagaagacccatgggggatgcctgtggtgggtggtgctaatctcagaggcatctctaacagggttccctcccttactttctcctgtagcttgggagtgccagaaagtggggggaaattggggattggtgctgctgctgagaggtttggtttttttttaatcaaacgccagacttggattttgccatttttttcaattaatgtcttctttctattctaggatccaatcttgggtaccacattgcctggcttcccagtctcttctaatctgtgactgtttctcaggctttccttacatttttctttcttttttgagacagtctcgctctgtcgccaggctggaatgcagtggcgtgatctcagctcactgcaacctccgcctcccgagttcaagcgattctcctgcctcagcctcccaagtagctgggattacaggcacacgctgccatgcccagctaatctttgtatttttagtagagacagggtttcaccatgttggccaggatggtctccatctcctgaccttgtgatccgcccacctcggcctcccaaagtgctgcgattacaggtgtgagccaccgcgcccagccctttccttactttttaaaatgaccttcacagccttgaggagtcctggccaggtgtcctgtagaatgtccccaaatctgggtttgtccgaggttttttttcatggttagactggagttacagatactcaaaaagaataccccagaggggaagtgcccttctcatcacatcacatcagtaggtacctgagatccacacaacatcactggcgacgataatcttcatcactccttcatcacttggttaatgtcatatttgttagccatctctactatgaagttactatgttttccttttttatactccatttattggaggcacatcactaagtctagcccactctaaagcggaggggggagtatctacatatgttcagtggagtccttttttcggacaaggttcataagattcttaagatgaaaggcatctccctttacttggctctttgccaggaatctacgtgcgacatctgccattctctccatcctacctgctatttatctttgttcaccactgatcttattccaaaaagttatttcatgtggatcatggaagtaaatgcaacccctaaaataaaaacatgactagatgggggaaattcaggtaaagaaaaaaaataagacaggatgtaatataaggccttgtaaagtagatagaattttgtgccaaattcagctctgaacctcctggtagccaaagaaaagtgggaaacctctgttccaagactcatagtggttataaaataaagacaaccagattccttgggagaagcataccttttcctggtattaggatctaaacaaaatgccttttctgtgcagcctcttaaaagatacacattgtgtgatacatagatagagcagaggtcaggaaactatagggcagatctggtctaccatctgcttttgtaaatgaagttttattgtaatagagccacacccattcatttacatattgcctgtggctgctttctcactttcttactcaaagttgagtagttgtgacagagaccctatggcccacaaagcctgaaatatttactctctggtctcttgcaaaaaatgtttcccaattcctgatccagaggacaactctttaaccaccccctaccccggctcccaccaaaataggactgcaggactaatgtgcatttctggtaatggccttcacgttaggctggtagagcaattcttgttatagtacatgagagaaccccactacaggggcccagaaggcaatgcctaagagccactcttatatgcataagagctggttctagtcccctttagttagcttattctcatttaaatttacggcatggtctcatttaaatttacagcatggtaaaccttactggttagaggcaggtggtaattggtaattgcaagctgtctcttgctgcatttctctgtgtgtttatggtgccagcaaaacctgtgtggtcctttttattattattgttatttttttaacaaatcattgagcctgctatagaacagcaaaatggttctatgagaaccaggaggaactttaccccccaagggacatttggtaatatctggagacatttttatttgtcataattgggggttggggctgatagtattactggcatcaagtgggtagaagccagggatgcttctgaacatccagcaatgcacaggacagccccccacagcaaacagttatctgaccccagagggcaatactgctgagactgagaagccttgttttattttcttcattttatttatttatttttttgagacagggtctctctctgtcgcccaggctggagtgcagtggcaggatcccagctcacagcaacctccgcttcccgggtgaagcagtcttctcacttcactctcccaagtagctgggactacaggcgtgtgccaccacgcctggctaatttttgcattttttgtagaaatggggtttcaccgtgttgcctagggtggcctcgaactcctggactcaagtgatccactcgccttcgcctcccaaagtgccaagattacaggcgtgagccaccgcacccagctgagaagctttgttttagaaagcaatttttgctaacaaaatatctgatagaaagatcccttctggaagtacctaaaaacctcaagttaggaggttctaagagccttacacttttccagaattgctctaaaagacttagtcattctcttcatatacttgctctgggtataatctttgatgcatgctgctgggcttccgggtgaacaggttataatcctgcctccaggacccttaaaggtgatataacaacattacaggctgtaatcccagcactttgggaggctgaggcggaaggatcagttgaacccaggagtttgagatcagccgaggcaacatagctagactctgtctctacacacaaaaaaaagtcaggtatggtggcgcatgcctgtagtcccagttacttggaaggctgagacaggaggattgcttgagcccaagagtttgaggttacagtgagatgtgatggcaccattgcactccagcctgagcaaaagagggcaaccctgtctctggaaaaaaaaaaaaaaagatgcagcaccattacatgaggcacagcttggcagctaccagaagctcatagaggtccagagtagagagggagatggatctccttgaggcctcgggcggactgaatcggaacagtttgctaagggagcagcgtttaaaatggccctaaagactgatgggattagccaggtgtggtggctcccacctgtaatccctgctacttgagagtctgaggcaggagaatcgcttgaacccaggaggcagaggttgcagtgagccgagattgcgccactgcactccagcctcggtgacagagcaagagtctgtctttaaaaaaaaaaaaaaaaaaaaagactgataggtttttagccactagttgtggagaagagcaccccagggcgatatggggcacatagacaggatttatacacacacggtgtcatttggctggacacatacacatgggtgaatggtaggcagtgtggtgagatctcaggtcaagccaatgttgtgcaggacccgtgatgtcctgtgagtcggttttcagtgtggtggttcatggggagacttgaaagttttcagagtaacagaatgatgggattggaactgttcttgacagacgatgcaaatggagctggctcacagggagggtttttgagggagaggctgcaatcaggggctatttagaagaatgttacagccctccctggccagaggaagtacaggcatgatttagagatgcatgtgaatctgcagagggcaggccgtgggactaggcctgtctttagatgcaaagctggagaagagagctatcagatggctctgagagttgaacctgagcaaactgaaaggtagaagaaaggaggttttgggtgggaaagggtgagtcacggtaggcagaagatgtacattgtgatgttcacctatttgtctctaaatgtggtctttcagtcctgctgtcctcataaggagtgattctgacttctccactctttctatggagatttttctttagtgtaaatcgtgtggtttgaggcaggtgctgaagcgatttctttggtcctggggatttactgtgaagagtggcctctcatctgccctggttggagggtgggagttcccagctgctctgatagaaggcagtgcacacaagactgggtagagtctctagacaactttagctgtgccactagggaccaaggggtagtgggaatgagcagaatgggaaggattgcattaatttttgtttattttttgtgaatgcttactgagtgaataagccagtacagcttatttactgtgttttcctgtcagttatttttggaatcaagtattcatttttaaatctcctgcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcaggtgagattcagagtggccaaactcatgttcctggggagtggggacagtctgatctcaaaggctgcagaggctgaagtccaaagctctgggccgagttctgactctgccacaagtcacatgcgaccctgggcaagttagtccttaaccacatctgtatgatgggactaatgatctgtttcctgccatcctcacaggatagctaagaggttcccacagagatgtaggaaagtgtcaggcaccacacaggagtacagggcttccggaagggggctctgtccagtctgtcttgttcactgtggtgcctgtggcacaatgtcttgcacgtcatagcatgctgtcagtaaggaaaagaacaaacagtggatgaatcactaattgtggccaaacatgactgttcttcttctattccttagtatccggaggaaaaggaagctgtgtgtacttcatttgctcgagcaagtgcaccagcttttactactgttgtcaattctgagaaaccgttttattttcttcccagctgtgtttgctttatagtaattatgccgcagtcttttcttattgtctcactgtattgacgaagcagtccttggcaaaatcatctaagagacttaacttttatacccctgccctgagagcagaaagttctctggggctgctcacctggctggcctctgtcaggagtcactccatttcccttatgtcataaattctgtgctggtgtaatctgtgtctcatctactgcagcctgttcattctggccagtagaggtgatggtcatttcagaagcaggagcaggtctgaacttctctgctccctgccttcgctcatgcccttatacccatcaagcctacctggctttttggctgtaggcgtggaggagattggagaggctgcccaatgcatagaaaaaatctgcttcctcattgcttacaagggtagaacagtaggtttacttctgctttcagaagaaatgaggaatcggggatatttaggctggaggtgaaaagaccaaaaatgacatggcaggtagaatcaggaccaatgactgaaaaatacagagaacagattctatttcatgatgaagaacttactagcagtgggtcctgctgcacggaaatgggctgcacttagaggtgccaagttctttgccattgaagatgttcacacagataggacagcctcttgcccagacacgtggtctcagcagagactcaggcattagaaggaagttcatttcaagggtctttgaaaactttttctaaccctgaaattctgaaacacttccagtgatttctggaccctctgaatagtcatgaagagtagtctgggactgaggaaagggagaagttcaaagaacttgaggagcttctggataagccccacagctggcccagttcggtatagtgggtggccactcagctgctgagtattaagcacgttttaagggaccatcacacctttgagcaagaatgtgggcagcaggtggtggaaaggactttggagagagactgacctggattcagatccacatcctggtacttctggctctttgaccttcagcagttcctttagtcagtttcaaagggtcggtgttaattattttagtattgtttaccactttgggcttcctgtgtgtcagccctgtacatgtgctcagcatcgtataaacattcgcctcacatcagccctcaaagacaggaacagcattaaccccatttttcacatgggggcgctgaggccaagaaaagctatgtagcaggttagtgatgatactgggattccattccccatgctcttagggtgttacctagtactctggtcaggattcaatgaagctacctgtgaaaggctcttggggcaaacccagagcagtccagggggtttcttggaagtggttgggccttgggcctgaggaatattattaaaaggagagatgcttactaagggcaagtttggacacaaaagtactttgaattctaaatgtggacattttttattttattttattttattttatttatttatttgagacagtctcgctctgttgcctaggctggagtgcatgagtggcacgacctcagctcactgcaccctccacctcccagtttcaagcgattctcttgtctcagcctcccaagtagctgagacaacaggcgcacgtcaccatgcctggctaatttttgtatttttagtagagacgggatttcactatgtttgccaggctggtcttgacctcctgacctcaaataatccacgtgcctcagcttcccaaagtgctgggattacagacgtaagccaccaaacccggccctaaatgtgtatattttaaaataggaaaccccctatgagataaccccctgatatagctgtttggaatttactaaaatgcctttagtgtcaacattgtcctggtttctggctccataggaagtggagactgttcctaatattcgtgctcttgactgcatacgtgccatcttgctttgctgacctgacaccctgtgttacagctctcagcagctggtggcaagctccttgacctcatcctctaccctgacagagatcctggaagccatgaagcacccctcgtaagtggctcaccacagtgtagggttggaaggttcccagaagcctgtgccacagccatgtttaggcagcgtggtttggtagatttgtacatgactgtacttctcaccagttttgagagcttgggcaagtcacttgacctctctgagcctctgtttccttgtttgtaagatggaattgttttttgttttttttttttgaggcagagtctcactctgtcacccaggctagagtgcggtgtcgccatcttggctcacccaacctctgcctcaagatgggatttttttaaaagggattttttaaaaagtagttaagccacagggttgatgtaaagattaaatgaaataattatgtgaggtacctagtatgatgcctgacaagtataggtattctccgaatgtgagttcccatcttttcctttctctcccccttctcctttttccccataacaacttcttctttttttttttttttttttttgagacagagtctcactctgttgcccaggctggaggacagtggcacgatctcagctcactgcaacctccacctcccaggttcaagtgattctcccacctcagcttcctgactagctgggattacaggcacccgccaccacgcccagctgatttttgtatttttagtagagacggggtttcgccatgttggtcaggctggtctcaaactcctgacctcaggtaatccacccgcctcagcctcccaaagtgctgggattacaggcgtgagcgaccacgctgggcccccggtaacagtttcttttgtcctctcatgggtgtttctctgagtctaggaatagcatagggacattgctttatggtattaaatgctctagtgggagtcccttctttttcatctttccttccacttgttgccatggggcacacacatcccctgctccccgttcaccgtgttggaacccaggacaggagtccagctgctctctgaacagaagggcctctcaccgtactgcttcatcagcgcggaggtggtacactggttggtgaaccacgtggaggggatccagacacaggcgatggccattgacatcatgcaggtgagacagcaagaggggcccatagagctgtttgcttaggtcccgaaaaatcagggcctgccttagaagccatcaccctttccagtaatgagatctgcaggttggggtgaggattttttttaataagtgggaggcctttctggaattgatgaaagaacaagtcttgctttgaaatacactgtatcttgacttaaaaaccgtgcagaatttattgtctgaactgaaatgttttggacagaatctgtgcatttataaacctcagaaaaatctctatgatttttgggggaatgccctccctctgacctcaagccgccagtttcccctggtcaatgcatgcttattcaagactcaatgctggattcaaggctctgacccaggggccttctgtcaccttgtacttactctgtcagagctcttagcacaacagaatgaagatctttctctcatttgtctcctgcctcaaccagctccttgagagcaggatcacctcttattttccatttctgtatcaccagtgccaggcatgttgcttggcacctggtaggcacttagcaccatgcttgctggatttaattacgctgctcagaactggaactctggaatatggcagaactggaataacaaggaaatgggaaacggccagttgactgagccagttcatgccatcctgtctatacggaggccccaactggaagtcagtactgtttccttaccagctgagttgtcatcatggaaatgttaaaattgataactgatttgaaaaagcatgtgattctcagttctcactctgagggtcttgatgtgctgttttgcacagcctttgccgtatacactctcgtctccctgagaatacgatttccttattcaaataatgaaatgctactacagcagtttaaatgaatgagctgaaggtacatgtatcaacatggataaatgtcagaagcatgatgtggactggaaaaccaacttataaaatgatataatattatgccctttatttaaaaacttagaatcccgaaagaataccttatattctctatcatacgtgtttatataataaaattatttaagaataatattacactaaccatttatttctggggagagagaaagagtaatgggagtgggagagtctaaggagatttttttttaataagaatatctgaaatcagtatagagaagtgtcaaatttgtgaaagtagaatagtggcatatgtggatttttttttttttttttttttttttgagacagagtctcacttcgtcgcctaggctggagtgcagtagtgctaatctcagctcattgcaacctccacctcctaggttcaagtgattctcctgcctcagcctcccgagtagctgggattacaggcatgcaccaccataccagctaatttttgtatttttggtagagatgggatttcaccatgttggccagactggtcttgaactcctggcctcaagtgatccacccccctcagcctcccaaagtgctggggttacaggcgtgagccactgctcccggccatctgaatttcttcatgcccttctgcatgtttgaaatatttgatgatgatacgagtttacattttaaaatataatttatatcaagtacaacatgtctaatctgggggtggagggtagggtctcctcagtgctcctgtcactcccttgtctccagagcatgactgagggctgccccttcaagatgcctctctgcaggaatttcagagtttcaatgtctctcctagaaaatgctggaagagcagctcatcacacatgcatctggcgaagcctggcggaccttcatctacggcttctatttctacaagatagtaacggacaaagagcccgaccgaggttagagccgaggcgaatgcggttgcccacaggggcaagtgtttttcctggtgacttgctctttcacatgatggtgcttcctgagctgcatgtgtgactttgtattataagttgacagatctgtcaacttccttgagcctttgtacttaatttaagcatagccagagtgacaagggtttcttaagctacagtgtgttcttggtgagaacagtgtgggtgaaagataaagctaaaagaggccaagggacctggtgtgaggaaattcccacacatcagtttttggtagctgtttttaattagagtgccccacccccttgcccacccagcccaggtggttctgattatattatcatgggctccagtctgtgatttatagcacttttcacttgctagatctccagttcaggctccatttctaaccccaggaaactatcaagtcctagcaagttttccaagtaatattttaagtatctgtggggttttttttcttttgtttggtttttttaaataatgaggaaaaagtaattccccagagggaaaacttttttagcgtggtcagagctgactcacataactggaggcaccccagattcagaccagcatcttgccgggcatgctggctcatacctgtaatcccagcactttgggaggccgaggctggcagatcacttgacgtcaagagctcaagaccaacattgggaaaccctgtctctactaaaaatacaaaattagccgggtgtggtggtgcatgcatgtaatcccagctacttgggaggctgaggcaggagaatcgcttgaatccgggaggcggaggttgtagtgagccgagattgtgctgctgtactgcagcctggttgacagtgaaactccgtctcaaaaacaacagccggctgggcactgcggctcacgcctataatcctagcactttgggaggccgaagcaggtggattgcctgagctcaggagttcgagaccagcctgggcaacacgatgaaaccccacctctactaaaatacaaaaaaattagccgggtgtggcggcaggcacctgtaatcccagctactcgggaggctgagacaggagaatcgcttgaacccaggaggcagaggttgcagtaagccaagatcacaccactgtactctagcctgggctacagagtgagactccatctcaaaaaaaaaaaaaaaaaaaaaaaaaaaaaaacaggccgggcacagtggctcacgcttgtaatcccaacactttgggaggccaaggccggcagatcacaaggtcaggagttggagactagcctggccaacacagtgaaaccccatctctaccaaaaatacaaaaaatagctgggcatggtggtggccgcctgtaatcccagctactcgggaggctgaggcaggagaattgcttgaacccgggagatggaggttgcagtaagatgagatcacgccactgcacttccagtctggcgacagagcgagactccatctcaaaaaaaaaaaaaaaaaaaaaaaaacagcaaaaacagaaaaccagaccagcatctccagtacacctatagcaaaaggggaccttgcctgttctggaagtgactcctatcctgcagacaaatggcttctctgcctctgggtttaaagaatcaaacatggccgggagcggtggctcacgcctgtaatctcagcactttgggaggccgaggtgggtggatcatgaggtcaagagatcgagaccatcctggtcaacatggtgaaaccccatctctactaaaaaatacaaaaattagctgggcgtggtggcgcacgcctgtagacccagctacttgggaggctgaggcaggagaatcacttgaacctgggatgtggaggttgcagtgagccaagatcatgccactgcactccagcttcgtgacagagcgagactccatctcaaaaaaaaaaaaaagaatcttacatgagatgaagcagctagtgccactccccatgctctcttgtccaagaatatggcagaagtggacgtgtgtgggatttttttgtatatccattgacacttttccctttaaattatacatttgaccagtagatacctatcttaccttcaagttgaaaacataccaggttactgttatatattctgaaatttgaggtatgaaactgatcataaggtcaagtgtggtgctgactcgtgcctataatcccagcgccttggaaggctgaggtatgaggatctcttgaggccaggagtttaagatcagcctgggcaagaaacatagcgaaaccccatctctacaggaaaaaaaaaaaaaaaattggctgggtgtggttgtacatgctggtcttcacagctactcaagaagctgaaatgggaggattgcttgagcccaggaggttgaggctatagtgagccatggttgtaccactgcactgaagacttggcaaagctgtgcagaccctgtctctaagagaaaaaaagaaataaactgagcataaaatattttttagggccgggtacggtgacacacgcctgtaatcccagcactttgggaggccaaggcaggtggatcacctgaagtcaggagtttgagaccagcctggccaacatggtgaaatcccgtctactaaaaatacaaaaattagccgggcgtggtggcgcatgttgctactcaagaggctgaggtaggagaatcacttgaacctgggaggcagaggttgcagtaagctgagatcgtgccatcgcaccactccagcctgggcgacagagcgagactccgtctcaaaaaaaaaaaaaaatatatatatatatatatatatatacacacacacacacgtatatatatatacacatatatatacatatatatacacatatatatatacatatatatttttaattgaagtgaaattcacatgatataaaattaaccatttaaaaatgaacagctcagtgcatttagtacatccacagtgttgtacaactatcatgtccatctagttcctgaccattttcatcaccctgaaatgaaaccccatccccttgaggagtcaccttccaactcctcctcccacccccagcaaccaataatctgctttctttctcaaagatttgcctatttgctacgtttcacataaatggaactatacagtatgtggccttgtgtgtcggcttcttttacttagcgtgtttttaaggtttatcaagttgtagcatgcatcatgaagaaaataagcatttgtgttgagtactccttctctcccctccacttttcccagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttaggtacatgctcaacccagacaaggtctgagggtgtgccagtgggtggctgcgggaaagtagtggccagccaagggaacgatgccacatgaaccaggattagagtcgctgaggccgtcacacaggccactgtgtctgtcggcactgttggctccgttgctgacttccacttgccgagtggttttatgactgtcccaaccaacagacggtatttagcacctctcaaatcagaacatagtgccagacctgttcggataggagagaagaaatatgtggccaattttcccgagggttctgtaggatataggagatgtgagatagtgctcattgcaccagctagttcctgccggagcccctccctacaaccatagcatcctatgatctcagaagaggaaggaacctaaaaggtcatccattccagacactcatgcagagcaaaagtctctctctctctctcctcttcctttcctccccaaatgtgcttaccatattgaaggatgtaaactgaaacacttccctcctttccaccattcctgcagctctaagatgggggtaaacagctgcttattgaaaggcaatgacctctgataggaaatggggaactctgagctagaggacctgactgatgggttgaaatgtgaacatctttagaaaatacctgctctgggcaaagaccatgggatttatcttaagggcaagttggaggatcctgaaagccctctgaaaggaagaaagcaaatagaacataaaccaaactccagggaaattccatgttctgctttgtttgcctgtaatcgcccagctaattggaatcctttactagctggtaaaacggagatgttaatcgtcatcaaagtttctagatccaggccgggcacggtggcccacgcctgtaatcccagcactttgggaggctgaggtgggtggatcacttgaggtcaggagttcaagaccagcctgaccaacatagtgaaaccctctctatattaaaaatacaaaattagatggctcatgcctgtaatcccagcactttgggaggccgaggcaggcagatcacaaggtcgggagatcgagaccatcctggctaacactgtgaaaccccatctctactaaaaatacaaaaaattagccaggcgtgacagtgtgcaccaggtactcgggaggctgaggcaggagaatggcatgaacctgggcggcggagcctgcagtgagccgagatcgcgccactgtactccagcctgggtgacagaataagactccgtctcaaaaaaaaaaaaaagggccaaacgctgtggctcatgcctgtagcccagcactttgggaggctgaggtgggtggatcacctgaggtcaagagtttgataccagcctgggcaacatgatgaaattctgtctctaccaaaatcagtcaggtgtggtggcagacgcctgtaatcccagctactccggaggccgaggcaggagaattgcttgaacctgggaggtggaggttgcagtgagctgagatcgccccattgtactctagagcgagactccatctctcaaaaaaaaaaaaaaaaagttttcagatcctcagattcacttggatctgggtgtggctcactccagcattgcctgttgctgtgtgtgagaagtgaaggggtggggaggatagggtagaaccttgagcagctcctcctcctttcccttaggcagtcatgacttgctcttctcccttcattgcatttctaactgtctacttccttgacgtttttttgggattaaagaagccgtatacccgttaccctggggtgctcacttccagcaacctaaaccacctagagcactaccagggcttgagacctaaggcctttgaatagcaagcagcaaccttgtgattttatgtcatgggaggacctattagaaatagcaaataaggccaggcatgtggctcatgcatgtaatcccagcactttgggaggctgaggcaggaggatcacttgaggtcaggagtttgagaccagcctggccaacatgatgaaaccccatctctactaaaaatacaaaaattacctgggtgtggtggcgggtacctgcaatcccagctactcaggaggctgaggcaggagaatcgcttgaatctgagaggcagaggttgcggtgagcctagatggcaccactgcactccagcctgggcgactccatctcaaaagtgatggagtgagactccatctgaaaaaaaaaaaaaaaagaatagcaaagaaaagggcaggtacctaccctgatgtcagtgggaagcagaagccaatagtccagcaacaaaggtggagtggggaaaacctgttacaaatataacaaacacaagaacttgataagtacagtgttaatcattcacttatagcactaggctgcatacgagaagcttctcaagaagcaactttacaccatttttctcatgaaatcaagtttatttttagtagccaagttttaaagtctactttttcctcatagataaaaattaagaattttcatctctgcggaacaaggaactaagcctgaaagctagctaggtgctttcagatacgcaccaaagagagagctgaaaagtcaacttcccactcccctcggggttactttctgagaaaaagacacaatgcattacaataagtaaatattggatcatgcatggcgacaatttatgtgagagctgaagaaagcaaaaagatttcttcctttcaaataaatttcaaatattcaaataaatgccacgaatccaagtgacacctccttgtagtaagaggcgctcgaaccagcacatagagcatatttactccactgatttcttggaagtgtgtttacagatctcttggtaagaccccagattagaagcagaaaattggaggcagctaatggcagcaagtgtataacacattttagcaaaatgttttgcaaaataaatctgttaaattttgatcttttaaggtgggaagtaactatcatttgttcattctttctctttttttttattttcttgttccttctcttctttctcctcttctcttctcttctttttaaaaatagagacagggtctccctatgttgcccaggctgttctcaaactcctgggtgcaaggaatcttcctgcctcagcctcccaaagtgctaggattacaggtgggagccattacgcccggcctgttcttccttttcttgaaagtgttcaacgaaaggaattattctaatgtgaatcttctccagtagatcatacaaaacccaagagcagggtttctcaacttcagcactactgacattttgggccagatcattctttcttgtggggaagtgttctgtgcactggaggatgttgagcagcatcctgccctctacccagtagcactaccagccccacccagtgtgataaaatgtctcctgacattgccaaatgtcccctggggttggtaaaattacccccagctgagaaccgctgtcctagggggaactgaaggattccaatcaggagccaagattagagcaaaacctgagaggctttgaagcccatcagtaacttccctaagcaggtgtcaagttgatgcgtgataagggcgtgctttcagaactttggggtaggatgaatggtcagagctggagctgagatgttagagggaagcactgtcctccactctgctctgctctgctctggcccctgggctcctcttgtgctttctttcactggtgccagtggtggttgcttcagtcttgcctgctgtggtgcgatggtaataacattaatgccatgatttgtagaaaattgatgtgtcaggtcctgtacagagcagaaaatcttcattaatctttacgtcagtctcctgatgggtactacaatttatgctttagagtttaggaaactgtgaggctcagagaggcgaagtaatttgcccaaggctctgcagccactaagtgctagagctggagtttattctcaggactgcctggccctgaagcctgaactccaagcacactgcatttcggcccaaggagacaaaagtcaaagcctgtcaggattttggatgatttgcacaatagcccagttccaggagtggcttctgccctgtgatgagggacactcaggtcccaggcccttgctacagaaccacaactctctgggtgtgtcctttcttcccctctatgccatccctgctggtcttcccaatgcactccctccagtcctggcttcaacagttctttgacccccaccaggacctgtaaccaattgatcttgctatcattctccctctcccacctcacatctcactttatgtaatcatagctttgagctgccaaacctcattacacagctttgagccccgctccccaccctcatcatcagcatcttgtgtcactgtgaaaactgaagcggtcagaagaaaactcccacctgccatctgccctcgcccagtagctgtgtctgtccccactcttctgcctccccctgatgcagcatctccacctgcacacaagaccccagccctcgcagtactcagtgtagcactttggcagtcatccccctccctgaattctccctctctgctaaagcatccctgtcgatctgtgacaggcacacactctctcctgctggcaaagcaaaactcaaatcgggtttctgtctattccctccgctggaacagccttcccaatgcagggagcccatgttgtttagcctggcggccagtcctcagtcctggtcctccttgccctgcaacagcatttgtcaaatgatctctgactcctcctttaaacccttaccttgcttggctctccttcttcattttaaaatcagtttcctttgctggtttctcttcagcaacctaatcttttaatattatagcattcgggtctcagcctgccctcatctccataccctaaagtgtctcatcagtccagtggcctttattaccccaagatctggtcactgccaaatttctatctccatcctagaccatgtctccaatttgagactcatccctccagctacctacttgacatggtcacttagaggactggatgtacagtgttcagaaccagctagccctgctgtttccccgcaacaccttcgtcttgccttctcattctagtcacttaggtagaaaaattcagttgccttctcatgtctttctttcctgctctacatccagcccatcagcaaattcagtttaccttttagttaccttcaatattgattcaggattaactattccttactctgtctcctctatgatcgtggttcgagccaccttcatcttctgtctgcattgctgctgtcacctctgcactggcctcctggcttcctcccctgctccttataaactgctttgcacacaggatccagagagacctcttcaaatggaagtcaggtcatgttccccttctgggcaggatcctcttgtagctcccagctcactcgaaaccaaagctagagttttcagcagcctacaggaccccaggatgtggtcccctcattctctgccttgtcccctgtccgcctcctatgtactctgctgcaccacgctggcttccatctgtgtctggtgtccgtgaacacgccgtgcacatctctgcttccagtgctttccttccgcctggggcactgttccccaaagataccctcgggtctccctccctcacttgcttcaagtctcttgtccaaaaatcatgtgtgggctgggcgcggtggctcacgcctgtaatcccagcactttgggaggccgaggcgggtggatcacaaggtcaggagattgaggccatcctggctaacacagtgaaaccccatctctactaaaaatacaaaaaattagccaggcatggtggcgggcacctgtagtcccagctactcgggaggttgaagcaggagaatggcgtgaacctgggaggcagagcttgcagtgagccgagatcatgccgctgcactccagcctgggcaacagagcgagactccatctcaaaaaaaaaaaaaaaaaagagacagggttggccaggcacagtggctcacgcctgtaatcccaacactttgggaggccaaggcgggtggatcacgaggtcaggaatttgagaccagcctgaccaacatggtgaaaccccgtctctactaaaaatgcaaaaattagctgggtgtggtggcgggcacatgtaaccccagctactcaggaggctgaggcaggagaatctcttgaatcgagaggcggaggttgcattgagccaagatcactccattgcactccaccctgggtgacagagcgagactccctctcaaaaaaaaaaaaaaaagacaaggtcttactctgtttcccaggctcactacttactcctagctcactacaacctcaaactcctgggctcaagcagtctttccacctgagcctcccaagtagctgggactgcaggtgcacaccatcatgcccggctagtttttttgttggttttgtagagacaatctctctctgtgttgcccaggctggtcatgaactcctcggctcaagcaatcctcccagttggccttcaaaagtgctgggactaaggcatgagctgattccctctcttgacagtttctataggaatatcctcgtttccaaagccttcttctaatgcaggctggtaaaaccctctcttgacttctggtcttcagctcaagatgaaattcagatcatctcagtttagctttgataattcttagtgcttaaagaaaagcagtgtataggccaggcatggtggctcacggctgtaatcccaacactttggaaggccgaagcaggcagatcacttgaggtcaggagtttgagactagcctggccaacatggtgaaaccctgtctctactaaatatacaaaaattagcgaggtgtggtggcatgcacctgtaatcccagctactcgtgaggctgaggtgtgagaattgcttgaacctgggaaacggaggttgcagtgagccaagattgcaccactgcactcccgcctgaaaaaatacgtctccatctcaaaaaaaaaaaaaaaaaaaaagagagagagagaggccaggcatggtggttcacgcctgtaatcccagcactttgggaggccaaggtgggcggatcacaaggtcaggagtttgagaccagcctggccaacatggtgaaaccctatctctactgaagatctctactaaagatacaaaaaattagcatggcgtggtggcgtgtgcctgtaatcccagctactcgggaggctgaagcaggagaattgcttgaacccgggaggtggaggttgcggtgagctgagatcgtgccattacgctccagcctggacgacagggcgagattccatctcgaaaaaaaaaaaaagagagagagagagaagcagtatatagaaaagtaagtcataggccgggcatgttggctcacgcctgtaatcccagcactttgagaggccgaggtgggtggatcacctaaggtcaggatttcgagaccagcctggccaacacgatgaatccctgtctctactaaaaatacaaaaaattagctgggtgtggtggtgggcacctgtaattccagctgctcgggagctgaagcaggagaattgcttgaacccaggaggcagaggttacagtgtgccgagattgcgccattgcactccagtctgggcaacaaaagcgaaactctgtctcaaaaaaaaaaaaaaaaaaaagagaaaagtcatatgtccaaaaaatagggagatttgggaagaagagagggtttatgtccatagcaggtagtttattaaacaagtgttctcctggggtctctgtgtgggccttagggggtcagtgagtctgaaactaggcagagttttgtgtgtgcccatgtttcctgggaaaacatccttttgttagttttcctgtggtttccatagttgttacaaggaatttcattccatcagcctcttgcccatccgtcttcccaaaagaaatgggtttcttttccttttaaacctgatatggccatatacagctaattctatccaataacagctctcagccctttgtgttaggatatgagaggtttcttcccagcattttttcaggttagaatgtagtcttttactgtgtcatttactcaagtggggaagatctgttttctttaaattgagctgtattcattgtttgggtttttcttcagaaaaaaaataacatgatttatagggggaagaaggcctgtgtatcatttgtgacttgtccctttttttgttttttgtttcaacatgttcctttttaaacacttaggatactcagttggaagttagcattggaagtctgttttgaaatgcctgacattgacacatgaccttctctggcttggctcatgggggctcccactttctcattgcagtcaccctgggctgctcacctgggaagcagcaggagcatctgagactctagaagcagcagccctgcagctcttaggcccactcacatgcctttccttctcagccttgttttgtctgtggttttttttttttttttttttttttttggagacggagtcttgctttgtcgcccaggctggagtgcagtggcgtgatctcagctcactgcaacctccgcctcccggtttcaagcaagtcccctgcctcagcctcccgagtagctgggattacaggcgtgcaccaccacacctggctaatgtttttctatttttaatagagatgtggtttcaccatgttggtcaggctggtctcaaactcatgacctcaggtgatccacctgccttggcctcccaaagtgctgggattacagtagtgaaccaccacacccggctctttgtttgtgtttttgacacagagtcttgctctgttgcccaggctggagtgctgtggcatgatcctagcttgctgcagcgtcaaccttctggtttcaagtgaccttcctgcctcagcctcccaagtggctgggaacacgggcatgtgccagcatgcctggttaattttttgatattttgtggagacagggtctttgttgcccaggctggtcttgaactcctgggctcaagcaatcctcccacctcggcctcccaaagtgctaagattacaggcgtgagccactgcgctcggccccagccttttcttgacggcccactggattttgggatcagaagggaatttagagcacctctgtccaaaccctgacacttgaatattttctgcagcactcctgataagtggggagcaagcttctctttgaaaaaccccctcaacatggcactcactcccaagactgcttgttctgtacctgggcacctctgattgttacgtagagtatcactcccctacctggggttgcatttttctcctctgctgacactgtccccttccccaggttactgataaccccctagctatgacctgggtgaaggatgctcagcctattcctcctctgggcttgcatgtatttattggtcttgtgtgaataagttggttctcatggaactcacgtaatgattctatgaacttactgaaagctgaactcagctggtctcatatctttatcaacatcataatccgctagaaacatatgtactgccaaatctatccccaaagtacagggccagtagtatcttcagcctgtaaccacttggttgaacagcgtacttcctggcccaggccagcatgttctgaacttaacatgccagatgggagagaagagatgcatgaggccactgctggtatttattgaatatcctcgtctttgtgacacagacttttcacttgggaagaaacacacagtgtccaagaccagagggcaaaacttctttttttttttttttttttttttttccagacagagtctcgctctgttgcctatgctggagtgcagaggcgctcactgcaagctccgcctcccaggttcacgccattctcctgcctcagcctcccaagtagctgggactacaggcacccgccaccatgcccggctaatttttgtatttttagtagagacgggtttcaccttgttagccaggatggtctcgatctcctgacctcgtgatccacccgcctcggcctcccaaagtgttgggattacaggtgtgagccactgttttgattttggctaagtaaagggttattctggcagtatcaggaatccataacatgaagcagagacagaatgtagttttgatgagccttttagcattggagtgaccaagttctttagccttaaatgtcacagacagccaaccagtgtccatgggcggcacagacaggcctcagattgaacattggcaaactaatggcctaaattgggagaagagaccagcaggaacagaaggaaaagaggagagttacaagttaggtggctgggtaaggcaagagaggaggtccacactcctttctcatccatgcttcacctgattctcatcctgtctctatgaaccatctgggctggcacatctcagtttgtagttcaggaactaaatcaggagaggtgaaacaatgctctctgagacatatggttactaaatggcagagcttagatcttccaacttcaaatcaataagttttcccatttgcatgttctaggtttttgtttgtttttccattcatgagatatttattaaaataacacatttgggggaaaaaatcaatacaacatagacatcactactgaaaaccatatatcatcatacaaaaagggattttggccaggcatggtggctcattattatcccagcaccttcgggggccgaggtgggcaggtcaattaaggctaggagttcgagataagcctggccaacatagggaaaccccaactctattaaaatacaaaaattagctgggcgtggtgatgtgcacctgtaggcccagctacctgggaggctgagacacaagaatctcctgaacctgggaggcccaggttgcagtgagccgagatcacgccactgcactccagcctgggcaacaaagtgagattctgtctcaaaaaaaagatttttaaaatttttattttattttgagatggagtttcactcttgttgcccaggctagagtgcaatggtgcgatctcggctcactgcaacctttgcctcccaggttcaagcaattctcctgcctcagcctcccgagtagctgggattacaggcatgcatcaccacgcccggctaattttttgtatttttattagagacggggtttctccatgttggtcttgaactcctgacctcaggtgatccgcctgccttggcctcccaaagtgctgggattacaggcgtgagccaccatgcccggctaaaaaatgaattttattttgggaatggttttctaatttatggcagatattactttcaaaaataataccacagaacaacacaatctaggtcaatcttaaagactgacaggctgagcaaggaatgtttttatttttttgtaggagctccttctttaaactgtcaagtactagggctctgccttttggagtgatttcagccaccaagtcatcgacaataacgtgttctagtcctttctctttaattacctcttaatgcaaaagcaaaaaacatatcacttaaaatcattatctttacattatctttatcaactcatcctttcagccacattcaattaatttagctcagcagctctttcaggcgttctcttactccggtttctgtcaacttttggttaatctctgctctcatattcatcttgctaaccacacttcctggacttagtcttttgagagaatggtgagtggtacatctggcagctgaatgccagtttgcctgaatgccattagtgacctagctggagctctcctgccttacaacagaagctcattaaaattgctgacgcaagagctgtttatctttgtcagtgagaaaaacccactcagggcttctatctgcagaacccagaactaaactgaccacttcagctgaagaaaactgttgaattcatgggggtaagggagaatgaggggtggattatagtttatagaaaccctaggtctgggggtacatgttctcaggatctcttaagactgtgcctcagggaggcaaaaaacaaacagaaaccctaggtctggcagtgcccagccaggcagaacagaagcctgaccttttctttgcttctgagcgtattttagggccttagcctggtcaggaacttgattgacacgtctctgaaacatcctatcttgagttggtaggatttctgagcagaagtcccagataggatgagtaagcttggtactcacccagcatccttgagcaacatgtcaatgataggacagggtgttaagcttcattataaggtttcatttcttgagaaaagattgtagaactactgtcttcctgggttgaaacctgaaaagcaagacttgtcactggtggtctgtgctgtttgcccattgtgtttcttcataggtcactgaaataaaaagatctggggtttagcctggctgaggttctgattccatcatcttggccaaggcatcttccctccctggctgccatttcctcatctgtaaatgaaggggttggattacttagggagaagtaaactatggcttaagcagccaaatctggctcaccatttgttcatttataattgactatttcttttagagcagttttcggttcatagcagaatctaatagaaagttcctgtacatctggccgggcatggtggctcaagcctgtaatcccagcactttgagaggccgaggcgggtggagcaccggcggtcaggagtttgagaccagcctggccaacatggcaaaaccccgtctctactaaaaatacaaaaattagccgggtgtggtggcgcatgcctgtaatcccagctacttgggagaatgaggcaagagaatcacttgagcctgggaggcagaggttgcagtgagccaagatcacgctactgcactccagcccgggtgacatagtgagactccatctctgaaaaagaaagaaagaaaattactatgcatcctttgacctccacccccacaacctgctgcccccactatcaacatccccagacggagtagtccattttttacaaggtacaatccataaacctacattgacatcattgtcacccagaatatccatggtttacattttagggttcactctttggtggtgtatttttttttttttttttttttgagacggagtctcgctgtattgccagactggagtgcaatggcgcgatctcggctcactgcaacctctgcctcccaggttcgagcgattctcctgcctcagcctcctgagtagttgagactacaggtgtgcaccaccacacccagctaatttttgtatttttagtagagatggggtttcaccatgttggccaggatggtctcgatctcttgacctcgtgatctgcttgcgtcggcctcccaaagtgctgggattacacacgtgagccactgtgcccggctggtgttgtatattctgtaggtttggacaaatgtatagtgacacgtatctaacatgatatcctacagaatagtttaaccgccctaaaactcagtctgcttttataaagttttattggaatacagccaggcaccttcattatgtaacgtttgtggctgcttttgcactacaatagcagagttgagtagttgcaacagaaaccatatgtctcacaaaatgtaaaatatttataatggggccttttacagaaaggtttccaatatctagatgatttccaggaaacttctggaatctgcagttttcttttaggcacttgtatatagtttcatatctggatacttagttatttgttcttcttcatcccactccttttctcactctcttggggcccctcctgtgtgctgacatagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtgagaaccttcatgcatgttgtcaggcctttggctcacctcacagtgggcatggagatgcttgatagagattcatgtcactttaattttttagttcaggctcttattaccattcatcgggactattggagtaacctttttaaaaaatttaaacatagtaaaaattttaagcaatcaaaaaaggtagaatcagggtttcttagccttagcagtattgacatctgaggccagataattctctgtgggggagtcctgcaccttatgggaaattgagcaacaaccctagcctctacccactaaatgctagtagcacagccccaggtgtggtaagcaaaatgtccccagatattgtcacatgtccccaggaagggggagtattgctccctcttgagaatcactggtttagagtgaaaagtaagtctgtttcccactctcattccctgggatctacttctgctttgttgagtaaacttccagagagattctaagcatggacaaaatcacgttactttttttttttttcagcagagatggtagcattggatacatactacttacattgcattttttctatcacctatgtgttccatgtcagtacaaataaatctgccttgggattttttttattattattgttattgggatttttgtttgtttttgttttgcctcgttgtttttaagggctggagagttttctattatttgtttaaccatagttaaccagtcccctgttaataaacatcactgctttgaactcagtggttctttacctgggcggattttgccacccgggatcatttggcaatatctgaagacagaaaagggtggctgggcacggaggttcacgccttgggaggccgaggcaggcagatcactcaaggtcaggagttcaaaaccagcctggccaacatggtgaaaccctgtctctactgaaaatacaaaaattacccaggcatggtggtgcacgcctgtagtcccagctactcgggaagctgaggcaggggaatcacttgaacctgggagatggaggttgtagtgagccaagatcatgctactgcactccagcctgagtgacagagtgagacttcatcttaaaaaaaaaaggaaaaaaaaaaagaaggccgggagcagtggctcacgcctgtaatcccgggccgaggcaggaggatcacctaaggttgggggttcgagaccagcctgaccaacatggagaaaccccgtctctactaaaaatacaaaaaattagccaggcgtggtggcgcactgcctataatcccagctactcgggaggctgaggcaggagaatcgcttgaacctgggaggtggaggttgcagtgagctgagatcgcgccattgcactccagcctgggcaacagagcgagaatccgtctcaaaaaaaaaaaaaaaaaaaaggaaagaaagaaaggggtgagggcagggtgggtgctactggtgtctagtgggtagagaccagcaaagctgctcatcatcctataatgcacagggcagcccccacaacaaagaataaccagcccaagatgtcacaagtgccaaggttgagaagccctgttttaactggtcttcctgcctgtcctttctccttctagttcatcctggcctgcatctgtaatcaggccattcactgctcctacactaagaagccatacctgaccatcccccatcgcagtgctcactccttagccaagttgtcagtatcttccaggacagctccttaaccatctttatagtgtgccactcctttttatacactctccaatatagccaaaaagaatattcttctgtggcttctactgaatctcgcttctctcaacaccagcccagccatctcttcatacaacagagaacagctgggaagttcaaaaagagtttactaaaagctaggagataagcaaagagaaatgagtacagcatgagccagcaggtttttttttttgtccagagctcataggctaagttttgtcccacaaaacatggtatcctgggaaagcaatttttccaggtctctgtctgcctccacatggcattagcatcttcaaggacccctcccttggaaagactctcatctggggaacatccttaaggtccaaataaaaaaagacagcctgctgctcattctgctcagctcacagaggacaccagcccttccccagctcactgataccagcatgaccacttctttcaggtaaaactaactctctgacccagtaggcataagcactctccttgctggccctactagataagcatatcccaaaacagcatgaccacagcattgatagacacacacatatagttatagttgggcaggaaggacagtgttcatttccttagaggaatttagcaactgtctctgtaaagtacacctttcacatctgttcatgtaaaacccactgaaagctgctaatctctttatcattattttattaagcttttaaaacttcagtgtatgtaagttaattattatttaaggcaatgtccacatttgttaaaaatcagattttattgagacaaatactacataaaataaaaaggtttttgaccaaggcttaggaattatttcggtcaaacagagatctcggctttttgttgttatttttgttatgaacattccgtgagagaaaagataagggtggtaccctttaattttttacataatcatttgtttaagtcaagctgtgtcccaactctatttttttggaaataatacttgacacaaaaatcatctgtatgccagaaccacatcgatcaaccttttttttttttaacatacatcatttttatggttaaaaagagtatctcaagatctagaaaattgccactgttccctaagaaaatgttattgatggtaggtttatctttttgccccagtaacttttgttctcatctttggacagataggatttgggactctgccagagagtggctctcactctgtcaggtcagggcttaccattatcagaagccactgtggtcatttcccctcctccatcacatttctctcagccagcctgagtgagttgttttcctatttgatactttgaacttattaaattcctggtaaagtacaaaattaggctgggatcatgcctataatcctagcatttgggaggctgaggccagcggatcacctgagtcaggagttcgagaccatactggccaagtggcaaaaccccgtctctactaaaaatacaaaaattagttggatgtggtagtgcacgcctgtagtcccagctacttgggagtctcaggtgggagaattgcttgaacctgggaggcggaggttgcagggagctgagatctggcccctgtactccagcctgggcaacagagaaagactgtctcaaaaaaaaaaaaggacaaaattagaaggacttaacctctatcctgtgacctttctccaacatcccctagaatgggaaggatttcaactctctgcagaccgttctttctaaaagaaacaccgaaggtgcagaagtttgggctgtaaagaggagctgtgtgcttagctcacagtttttgtagtatttgtcaggatgttaaactgcatttttgcctgtccaggaccaatttgcagccagcaaacatgaataaatgagcatgcaaatcaatatgcatgctgcctttctggcgggttttctccttgggaagtattttctcttgtttgaaagaacttggagatgatattgtttgtttctgtactttccgccaggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagtaagaaatattcccttctggaggttgtctcaaccagtaagaccccgtccctaacaaggacaccactctgggtatccagtcaacacggactagggaaaagggacagcctttcaacaaggggccaaaaggatcaaggttctaaaggatcctgattcttgacttagtggctggataactctggacaaatcatttcatgtctctgagtctcgaattccttattcctaaaatgagagtgtctagagctgcctggagcaaagtggtgggtgggagagggcgctaaactctataaatcacaggcagcactggtgttctcccacgctctcctttcatatgctccagcctaactggtttgggctgcagggatttaaacctcacgggagacttgcatatgctatttcgtgcaaaaaggccaggaaagggagggcatgaaaagcaaaacaggaaacagcatccttttgtgcaaagctgtggcatgtcagcctctggaatggtgcgtgtgactcgagtcatgcatctcagggaagacaaagcaggatcagaggatgatagcaggaaccaaatcagagcctttccctctgggaaaggttttcaatcagaaagagagtacccagggtcagcctggacctgctgctctaccccagagcccagaacccagagggcaggtttaggacagatcaaagacgagctgagctgtacttgacacagcatatagctttttattaccaagtgctcgttgtggatgcacatataaatagctcctacaaagcttttgatgagttcacagatgatcttttttaaaacgcaaagctagggttgatgctgatacgtcaggagccctgaggtttctcaggtataaagattagaactgtgaaggaaacaacatttgacgtaagagagatgctttcttcttgtccccttgtaagtctgtgtcgtgatcagcggcagagaaccagcccaaaagataaggagatctccccaggtggattaggccaagcaaagtattcctgcaatttccatgtgacaggctgccctcatggtgcaaacagcttttcttccaaaagcccatccgtgtattttttgtttgcagtttggaagattttttttatagacacaatgttctaagtgataatcggggtcccaagcaagccccacagaggccctacctgctgggggctatagactgtgggacacacagagcttacaaagcccccttgaaacacacatgttcttgtttaacctcacagtgatgtggctgagagaggaccatttatgcagtcctgaaatgccagatgattgtgttcatatggggcagttttaagccaagcagctcctggtactattgtttttattatgttgaaggaacagagagatcttcccccgaaactgtccaaagactctttgggggtttttcacctttgctataacagcacaggattgcccacagggctggcgttggaggacatttttgtgcaagttgtttttccctgccagttgtaactcagtcttcaagaccagcagcctctgttggttgccatggttacagctgcagaaagggtcccagtttaaagcaataaggatttgaatctaaaaatcaattttcttgcttctgtgcctcttctctttttgttcttgccatttcctatagcagcaaattcaaaatcttaaaaatctgacaagagtgtgctgtgtgtgtggattttctctgtttaaagccaaagtcttttttgctttttgcccttttttttttctttttgtgacgtagtctcgctctgtcacccaggctggagtgcagtggcgtgatgtcctctcactgcaacctccgcctcctgggttcaagtgattctcctgcctcagcctcctgagtagctgggattacaggcacacgccattcatgcccaggtaattttttttgtatttttgtagagatgggatttcaccacgttggccaggaaggtcttgaattcctgacctcaggtgatctgcccgcctcggcttcccaaagttctgggattacaggcatgagccactgtgcctggctttttgctctttagttgccctaaatcctcaaatccatcccaggtagaaaattccaaatgtggaaagattagcaaaaccaccgcaggcactcttgtctttgggatggctgtgcaattaccaccccaggcctcagcacctcctccctgagagcagcccggactctgtcctctggtgctgtgcgacagccttccccagccctccacagccctccacccttccccctccactcttggttctcagcaacagccttgcagaaggcatgaggctggagtaacaaagtgggttatggaggagcggacttatcttttctgctctcctccccagctgattactcttcaaacttttattttattttactttattttagtttttttgagatggagtcttgctctgtcgcccaggctggagtgcagtggcgcaatctcagctcactgcaacctccgcctcctgggttcaagtgagtctcctgccacagcctcccgattacctgggattacaggcatgtggaaccacgcccagctaatttttgtacttttagtagagacggggtttcaccatgttggccaggctggtctcaaactcctgacctcaggtgatccacccacctcagcctcccaaagtgctgggattacaggtgtgagccgccgcacctggcccaaatttttatttttatatttatttgcttcaattttcctacctctagaatggagcttataatatttgccctttcttgtgggaagattggtaatacaaaaaagtgggggtgggccgagtgtagtgcctcacgcctataatcccagcactttgggaggccgaggcaggcagatcacctgaggtcagcagttcaagaccagcctggccaacatgttgaaactccatctttactaaaaacacaaaaattagctgggcgctgtggcacatgcctgtaaccccagctactcgggaggctgaggcaggagaatcacttgagcctgggaggcagaggttgtggtgagccgagatcgtgccattgcactccagcctgggcaacaagagcaaaacttcctctcaaaaagaaaaaaaaaagtgggggtagtagttgttccttagaagcagcttacatggtccaggcacagtggctcatgcctgtaatcccagcactttgagaggcagaggtgggaggatcacttgaggccaggagtttgagaccagcttggacaacatagtgagatgccatctctacaaaaagatttaaaaattaaaaatttttaaaaatgtagaaattagttggggccgggcacagtggctcacgcctgtaatcccagcactttgggaggccgacgcaggcggatcacttgaggtcaggagttcaagaccagactggccaacatggtaaaaccccgtctctacttaaaatacaaaagttagccgggtgtggtggcatgtgcctctaatcccagctactcgggaggctgaggcatgagaatcacttgaacccggcaggccgaggttgcagtgagccaagatcgcaccactgcattccagcctgggtgaccaagcaagactctccctcaaaaaaaaaaaaaaaaaaattagttggccatagtggtgcatgtctgtggtcctagctacttgggagattaaggtaggaggatcacttgagctcgggaattcaaggcttcagtgagctatgaccatggcaactaacatgcatttacagtttatcttctgtttgtactttaatatcatgctcctttcagctttgggtataagaagtcattcgaatgagccttatattgagttctggtagctcacactgactgctgaggacttcaccttcctagacccagctatagcttgcttgggggaagggatggtgtgaacacacagctgtcctttctttgacccttgggatggaggccagtctttctcaaagggcgtagtatggagaagcagaggttaggctcaaggggactgattgccaagagtagtaaagggtacagaagactggcccagagagaattacaaaccttgtgatcacaacccaatatttattcttattttcctttcaggctttgaacccgaaacgtactgggatcgaatgcacctcttccaggaagccattgcacacaggtttgtcccttagcaagtgtgaagagtgggaaggaaatcagtgtttatcttgaatagcagttaccaaagtgaaactcatttttttagctcctagagaaagggatgtattccaccaatggcaaattcactgcttatctccaacaggactctttacattggtttttgagataagcgctgcctccctgtttcctgtaactattgtttttcagacctcattattttcttcttccagttgagtggagaacatagaactctctccttagcctccaacaagaccctaggccaagctattcaggaaataatataaaatgaaaaattaaaaaatgtgtcaagagcccaacacaggttgaaaagacaatgaatggttaaaaagcaatagatgagtcagtagatatttcttggcacctaatatgtgtgccagggaaagcctgtcctagacttcactgtctcccactagactagtccagccgactgtgttgtctccaaacatcaccagcctggtatctgatggccacttcatgttagtcatggtaaaaacaaagccccttgttcttgctttggtaatcctctcattacaccttctccagtatcctgtcatctccttattatatatatatatatatatatatatatacttatatatactcatacaaccacaggactatttagcctctcacacccacgatggccccagcttaccttagaccttcgtctaaggtctaccccttcacagacctagctcaggtgcttagcaaagactgtggaatgaaggcaagggtggctgatttcctccttccactaacagtgggtggtgcagattcagggcagaaggtagagagtgcagcagtcaatgggaaagggccttgatgtacgaagtagacaggccttatccactcccacctccaccagcatctggctgaggaaccatgagcaattctggaactggtgagcctccattttcttacccctcacggggaagctgggagggttctctgatgttctggagagcccggtgatgcacctagtgagccctcagtagacagcagtcaccaggggggaccctgctaactcacgagtttctaagtagctcttaccctgcttgccctgctggcaggatgtcactcagaacgtggcctttatttgttaaatctgcttttttccttcactgcatcctcctcctgatccccctcagtccagatcctggtctatcttcccaggaactattgtactttcctcctcagccagctttttctaccacagataccctcacctgttttctgaccagtcctctgcatcattgtaccagtgtgctgcagtgtgctccttacctaaacccccaaccttccacacctaaacccccaccttctgtacctctacgttccacacctaacccccctccaccttccacacctaacccccctccaccttccacacctaacccccctccaccttccacacctaaacccccctacgttccacacctaaacccccccaccttccacacgtaaaccccctccaccttccacacgtaaacccccgccttccacacctattccccccaccttccacacctaaacccccccaccttccacacctaaatccccctaccttccacacctaacccccccaactttccacacctaaaccccccaccttccacacctaaaccccctcaccttccacacctaaactcccccaccttcctcacctaaacccttccaccttccacacctaccctccccccatcttccacacctaccctccccccaccttccacacctaaacccccccttatacacgtaaactccctcaccttccacacctaaaccccccaccttccacacctaaagccccccaccttccacaactaaacccctccaccttccacacctaagcccccccaccttccacacctaacctctcccacctttcacacttaaacctctcccctgttccacacctgtcagaatcttcctccagggattcccaaatgtttcctctctgaattcctctttccctttctttcaaaacactctgaatgtattccagtgacttgggggcccttggagggcaggggtatgctttttcctatttgtgtttccttctataatgcctagcaaggtgcctgcctagagtagtttcatatgtagcttttgcatagggtggagctttaagtgcaactgtggctctaaatgacacatcagcccacccataaggtccatctcagaaagagctaaaaaagtgtccatcttcctcagcccctaggctgtgacctacagctcctccttcatcttcctcagcccctaggctgtgacctacagctcctccttcatcttcctcagcccctaggctgtgacctaccgctcctccttcatcttcctcagcccctaggctgtgacctacagctcctccttcatcttccttggggcaggtggagatgattatatcccctcccctgcccttactgcgtttctgtcttgcattctccctgagtggacagtcaggtggccaggaaccatgtggttaaattgcctttttgttctttcctggtgacctaaggaagaaatgaggtaaaaaaaaattactctggtaaaaaaaaatcaggctgatccatgctgaggaaatcagtagccttaattagaaagtagagagaaagcaggctgggtgtggtggctcacgcctgtaatcccagcagtttgggaggccgaagcaggcggatcacctgaggtcagcagttcaagaccagcctggccaaaatggtgaaaccccgtctctactaaaaatacaaaaattaactggtcatggtggcgcgtgcctgtaatcctagctacttgggaggctggaagcacaagaattgcttgaacccgggaggtggaggttgcggtgagccaagattgtaccactgcagtccagcctggatgacagagcaagagtagagaggattttgcaaaggcaaaatccagagccaatcctcatcatataatcagcctgtagacagggagcttacagtgcatagtagcctacccatttagtttgcatatttgacttcatgtattctttggtaaaaaattatggaatgcagattatgtagaggatacaacacagcacctccccaaggaactcagtccaggaaagaagacaggcattttcccttctttagttctgcctacatcactgtctccattatataaacccctcagacttagagggcaggagccacatctgttaccacgtcctttacagctcttagcaggtagaactgtaataaatgtgccttatggaaatagaaaaaccaggaatagaacaagccatagatgaaaaatggctcctcctgcccatttccagagcacagggaagcagagagccccagcttggcgttcctctttttttttctttttgagatggagtctcgccctgtcacccaggctggagtgcaatggcatgatcttagctcactgcagcctccgcctcccggattcaagtgattctcctggctaattccagaacaatcctggctaatacaaaaattagccaggcatggtggcacatgcctgtaatcccagctactcaggagactgaggcggagaatcacttgaacccaggaggcagaggttgcagtgagccgagatcatgccattgcactccagtctgggcaacagtgcgagattccctctcaccaaaaaaaaagataaggaccttccctggaggaatggatagcctcgagtatgcgggtgggtatgtgtggcctgtcaagacatgaggtagattccagtgagaggcccaggatgggatgggggagaacgctcagtgggaaggtctgctgggatgggtagggaacatggtaggagggacgggctgtctgagcagagatgaaggctggatgaagagtgcagccggtgggaaggctttctttcactatggtggtagtgacatggtggaccacggagatgacgggctgctgggtgtgaggaggtctggtaagccatggtgttggaagaggtagaggtcagaaagtggtgagggtgaggacaaaaataagcagcctgcatgtgcaatctggaaagagatctttccagatctctgtgtctcaggctgtccgagagtcctatcagctacattctcttcccttgcccctttaactaaggaggcgctgattagcatgtcttcctgtccttccctaggtttgggtttgtacaagataaatattctgcctctgcttttaacttccctgctgagaacaagcctcagtatatccacgttacaggtgaggagctacgggcagagttgggcaggtgggtccacatccctttccttgcaccaagcctatggctgcagaaccacctcagcaggctccaggagccctcctggtggctgccacacaggcgctcccctttctcttcaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatcatttctttccccacccagtt

SEQ ID NO: 35 - DNA, 287190 bp, Homo sapiens
  source 1..287190: mol_type = genomic DNA
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttggtgtgtcttttatacttacagcacatctcaatttgaacaagccacacttaaagtgctcaatagccacgtgtggctggctagtggctaccatgttagacagtgcagctctggagtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttataggcagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttattttaacatatagcttctgtaatttaagaattctattatggcgtagatttgggagtacttgatttaatgggtttttgtccagttctagaatcatagctctgagaaatcgtaaagacctagatctcatggctagactagtccagagaattatctatcaagaagcaaaagggaaacagttgagggtcctcaatctagatttatttcgattcctccaataagggtttcacctcttgaaaatatcaggagactttttcattggggtggagtgaaatgttttgattctgaactattgaaacatggtgaggttgtggaagatagagaagagccttaaatttcttttaacatatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctctgtttgttttctgaatgaaatttggtaaatttcatctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaaacttggctgtagctgattgatgtttagctctagactaagttgctttcaagtgataattgccttcattttaggcttgggaagatacacatgcaaaatgggaacaagcaacaaagctaatccttaactatccaaaagccaaaatggaagatggccaggtaagtctgtaaagttgacttttgtctgttaactgatctgctaaatatatgtacttcactttgataatctttcaagagtcgctcagtaaagtaaacatatagctgtgtgaagactgatatttagttgtggtttatctagacctgtactttgtaatgtggtagctactagctatgtgtgactatttaacttaaattttaacataattaaaattaaataaaatttagttcctcaatcatatagtaaccacatcgcaagtaccagtagccacatatgacaattacttactctattggacagcagagagagaaaatgttcctgtcatcacagaaatactgggcagcactgctagagactgtttgttgcagagaccatttctttaccttttcttgctctttctcccttcatcagggtgtttcacagaattttcagaaaaggagcaacagaggtagagataaattaacatggaaacaattcattttgctattttgttaggtattctaattaaggaatgtcttaggcagtagattgatcccatagagtaaatgaaattttaaaatgtggacagttcattcaactattactattgactatattatctgttactttggaaattaatgatcagttagtgtttgtgtgtatttgatttgtaatgttcatattgctctcattattaggtgatttataaaaactggttgttcctccatggtgtttttgtcatgcttaattacaataggaaaaagttatatttttacgaagcaaatgtgtgtacctaatacctttatttggaggggacatgtagctttagaatgaaagcttttggggggataactgttttatataattacataccatacagttcacccatttaaagtgtccaattcagtgactgtttttaatgtattcacagagttgtgcaaccatcaccacaatcaagttttagaacaatttcatcaattgagaaaaaaaccccgtaccctttagctatctctgcctctaaccaccccccacccactttcttgcctctcttcccccaacgtctctagccctaggcaaccatgaatctactttctgtctttgtagatttgcctattccggatatattctgtaaatggaattatagaatatgtgggcttttgtgattagcttctttcacttagcatgatgtttccaaggttcatccatgtgaaatcaaaactttttaaaagaaatttgacactcggctgattatattagtgtatgataaaaatagatcagtggctctttaaaaatgtatatggtaattttatgggttgattttaatgtatattttacattttttgtacttttgtcatggaagaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggtaaagtgttctcttatttttcacctttctctatgaatagagtgacttgtttgaaataagcctttttctttcagattatttaaattaggtactcacagtttttaaaaatttccaaaaaattgcagaaagaagagtcatctcaatgtaggggtcagcttgcctcttaggaactctggtgtgtatgtgtgcctaagggtatacgtgccctgtgtatgggtacgagtgtctgcgtatatctgtatgcttatttggctctatgcctgtgggtgcacttactctgtgtgtttagatcagtcagtttcatctctctagggggtctgtcttctgggcattgatggcaaatcattaatgtatttgttctttctttaggttttattgactgataccaatactcaatttgtagaacaaaccatagctataatgaagaacttgctagataatcatactgaaggcagctctgaacatctagggcaagctagcattgaaacaatgatgttaaatctggtcaggtaagcattctactgaaatgtagcagaaacattttaagagataagaaaaacctcttacacactgatactggtagtaattgataaaataactggccattctttactgcacacaaactagggtgtgacagtaaggtagccagaagttgtgtacgttcttttctaaataaatatcttattgttttcaaacttacatttaattcgttttacttgatgactaaagtatttagaatgccttctcttttgtctatatctgataatttttttattgtttctatgtctatataggtatgttcgtgtgcttgggaatatggtccatgcaattcaaataaaaacgaaactgtgtcaattagttgaagtaatgatggcaaggagagatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttttaagaaataattgatttcctgattcaagcaccagagacagaaaaaaaaggaagtaatcaagtctgctttaatgatacttattgacacatatcagaaaatgattaaacactatggactgtataataagcattcacatatgtttctttgaccaagcctagctttataatacagtcttctctgtcagggattggttccaagaaccactccccaaacccctgcccacatcttactcccatgaacactaaaatccacagatgctcaagtccctgacttaagatgtcatagtatttgcatataaactatacacatcctcccatatatttttaattatcttcagattacttataatatctaatacaatataaatgttgtataaatatttgttataccatattgtttagggaataacaacaacaaaaaatctgtacatgttgagtacagatgaaaccctccttttttttcccccaaatattttcaatccatgggtggttgaatccatggatatagaactcactgatacagagggcccattgtacatgcttctgatttaaggtagccattttgccaagattactttgtagaaagtaagtattaccttctccccatttgagatgattttgtattctgggatctgcatattaactcaaattatttgggttgtgctaataatttgtttaatgaaataggtagttcctaaggtttatatctgttagtaagaggtttatttgaggggaagtgaaagaacttgaaagattcatggtctctaaattttttttttttttttttttttttttcagagatttggaccaggcaagcatggaagcagtagtttcacttctagctggtctccctctgcagcctgaagaaggagatggtgtggaattgatggaagccaaatcacagttatttcttaagtaaatttcagtcaccaaaaaacataaagcaaaaagcaaataaagccccccaccacacaaaaaaagcaaagaaataatacccatgacaggactaggataggaaaataactgtgttttgtgatttttttaaagaaagtaatatgatcagtgaaattttgcttataataaaacccagattgcttcattaagtcatttacaaaagtgacattgtctaagctgtttggaccactaattttatatactaacattaaaagtgacacatttaccaggtaatattgcatctatttgatgctaatgttatgaaaggtatactaggctatatcaggtaaaatcatgtccaacatagcacacttcataataagccaccctggctgattatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgctaaaacgttgagacgggttgttgttcctttccagtgttaaaaggctatttgctttttagtgtaccaaaactgatttcagttatagtaaattatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaattttttaaataaagaatcagttaagggccgggtgtggtcgctcacgcctgtaatcccagcactttgggaggctgaggcgggaggatcacaaggtcgggagatcgagaccatcctggctaacaccgtgaaaccctgtctctactaaaaaaatacaaaaaaatcagctgggcgtggtggcaggtgccaatagtcccagctacttgggaggctgaggcaggagaatggtgtgaacccaggagggttgcagtgagccaagatctcgccactgcactccagcctgggcgacagagcgagactctgtctcaaaaaaaaaaaaaaaaaaaaaaaaaagaatcatttagttcaagtagctttaattcgttgagttttatattaaatgactttgagaaggaattttctgttaggccagatctcacctaccacattattgtaatccttggatcaggcaagaattagagagctatgagccatgatcctggcctttgttgttactgcttgaggattgaggcatctttttatggctacccctattatctataaatttcttcttatcatgtgattaaacagtgatttaccattagatcattttttcttgagtgtaccccaaactgttttactacagagagttataaaggatgtcatttaggtaatagatagaaatttcagccctcatccttgtgaccctagctttgtatgtaaatctggctcatctctgggttctgaatgcccaattccttttcttcctggtttctcaaaaatcctatagtctttctgtttttgttgtgtctctgcctagtatatattcagtattcgctgagttccccgactgtatgagaagagagtagaactcttctgatcatcaatcttatttctgctctgtgcaaatgcttgtacaaatcaaactaaattctttgctgtcatcttctgtttctgctctctttcattttgtgatgtaatttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtttatttatttgtcatttttttaaaaatttgagacagagtctcactctgccattcaggctggggtgcactggcgcagtctcggctcactgcaacctctgcctcccaggttcgtgtgattctcctgcctcagcctcctgagtagctgggattacaggtgtgcgccaccacgcccaggtaattttttttttttttttgtatttttaatagagatggtgtttcaccatcttggccaggctggtctcaaactcctgacctcaggtgatccgcctgccctggcctccaaaaatactgggattacaggtgtgagccaccatgcccagcccagagtgcagtttaaaccaccatttctgtgaagctttctctgcttgttaccaggtactacccacgaacaaagaaatatgctttgttctgtgctgtgcaccaccattgtaacaattgtgacgatttatgagtttctctctcctctagactgtttgctcttttacatttttacatctttatatccttccatgaatatttagcatggtgtctgccttatagtgaacattttataaatatttgttaagtgaatgaattttaacggaatatcttatgcttgctttttctaagccacatgttaagatgttcttgtctgtctttcagttaggactttattttttacttttaagttcagagcttcttgatgattgttcttcctaaataatcattatttagcaactgtgtatcagttgatatttttggctctgcatttgctgaagtatcaactgtaatatctattcagaactccagcactaagccaatttttgttaaaatagttaaaaacttaaaagcaatttttatatttttatttacttcttattttttgaaatggggtctcactctgtcacccaggctggagtgcggtggcaccatctcggctcactgcaaccttcctgtgcaggactcaagcgattctcccatctcagcctcccaagtagctgggattacaggcatgcaccaccatgcaaaatacaaaatttttgtattttggtagagacgaggttttgccttgttgcccaggctggtctcaaactcctagactaaagagatccacatgctgtggcctcccaaagtgctgggattacagatgtgagccaccacgcctggccaaagcaatgttttgtaaagccttgtattttcttgccattaagcactttcagtttttttcttgacaacttctcatgtctactttttttttttttttttgcaattttcaagtgtacataatacattattacggattttatgttaattttgtgccctacaattttactgaatcttattattaagcaattttactttctaaaggttaaagaattacttagagagtgaaccagctgcttcaaataagtttactatacaaagtgctgtggtccagataagagaactagatggcaaacaatatactcaggttgcttaaaatcaaactgaggcccactctgacatgtcaagagcttgaaagtcaacactcctgtgttcacaacatgaaaaaagctaaaaaactgaaaatcagcagctcttagatccatcagagaatttaagtccactccaaaaactggagagacaggtaaatgtatacagagaatcacagtttaccaggagaagaagctgctggagccagtaactggtaggaaagcttagatcataattgacgagttgctggaggctgagcatggagtgcctagagagttaaaactcctaggggcctagtcttgcagggacccctgcacctttgtaagttttacctccagaagcctcatcaggctctcatggtgaagataggagaaaaatccctttatgctttgggcaggggaaggggaaaagtagccatttttaaatatgaccacagtgttctgttatccctagcaaaggtttgccctcaggagaaattactttaccagagctttatttgacttagaagttagccacctccagccccctctagcgtttctgtaagaagagagaaaaggctaagaaactctttgagtctggcctggtggctcacatctgtaatcccagcactttgggaggctgaggtgggcagatcacgaagtcaggagatcgagaccatactgtctaacatggtgaaaccctgtctttactaaaaatacaaaaaattagctgggtgtggtggcacgtgcctgtagtcccagctaccaggaggctgaggcaggagaatcgcttgaacccaggaggtggaggttgcagtgagctgagatttgcaccactgcactccagcctgggcgacagagcgagactctgtctaaaaaaaaaaaaaaaagaaactctttgaaggtcacactttaaggaatttggcccaataaaacaatggagatataatcagattgtagagtacttcccttccccagtatcccagttaacggggaaacccagggacaacaaaagagacagaaataagagcactagaggaaatgggcgcctacagttacagcgaacattaaacataacctaacttctaggcagattaacagaatgcctcacactaaagtccaatttacctcagttcctatgacccaatacatcttgtctggctttcaacaaaacattacaatgcatgctaacaaaaaatgaaaaattagtctgaggagacaaagcaagcatcagaatcagactcagatgtggcaagatgtattggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataatgaaacgcaaagctagatctttttattttttaatttttatttttttgtgggtacatagtaggtgtttatatttatggggtacatgaaatattttgatacagacatggaatgtgtagtaatcacttcagggtaaatggggtgtccatcacctcaagcattgatcctttcttttttcttttttgagacagagtttcactcttgtcgcccaggctggaatgcagtggtgctatcttggctcactgcaacctccgcctcccatgttcaagcaattctccttgcctcagcctcccgagtagctgggattacaggtgcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgatgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcctgggttcaagtgattctcctgccacagcctcctgagtagctgggattacaggtgcctgccacgatgcccagctgatttttgtatttttagtagagacagggtttcaccacgttggtcaggctggtcccaaactcctgacctcaagcaatccacccgcctcggtctcccaaagtgctgagattacaggcatgagctaccatgcccagccatggaatatcttttttctttgctttattttcagtctgtgtttttccttatagatgatgtctgtttcttgtaggcaacagattgttgggtcatgggttatttttgtttgtttttaatccattcaatcactcttacgtcttttgattggagaatttagtccatttacattcagtgttattattgacgaggacttactcctgctattttgttatttgttttctggtggttttgtggtcttctcttcctccttttcttccttcctgccttccctttagtaaaagtgattttcacagatgatatgtgttaatttcttgctttttattttttgtgcatctgttgtatgtttttgatttgaggttaccatgaggcttgccaataatattttatgagccattcttttaagctgatgacaagttaacactgatggcataaagcagcaaacaaagaagcaaaaagaaaactaataaaaactctacactttaactttatccccctactttttaactttttgttgtttttatgtataccttattatactgtctgtatcttgaaaagctgtagttatttgtaaaaggttcatcttttagtcttctcaagatagtagttcataccacaattacagtgttataatattttgtgtatttactgttaccagtgaattttgtaccttcagatttcttattgcttgttaatgtccttttccttttgattgaagaactccctttagcatttcttctaggacaggtctggcattgataaaatccctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaacccagccaggcttgcgtcctttcgttcaggcagtgagttctccgtgggtccagagatgccattcaggagccagagcctagagttgggtacatcagagatctacctagtgctctattctgctgcggctaagcattaagctggcacccaagctgtaagacaaagtccttcccgctcttccgtcctcttttctcaagcagaggagtcttttcccatggccgccatcgccccaggcccatggtgagtgctgcctggctaccactgatgttcactcaaggcccaagggctcttcattcagctcatggtgaatgctgccagttctgagtctctcccttaaggccttggggctcccctctaacccagggcaggtccaggaaagttttccaggagccaaggcctggaatctgggaccccaggagcctacttagtgccctaccccactgtgtcaagctggtacccaagttgcaacacagagtcccctttattcttacctcttctttcctcaagcagaaggggtctctctccatagccaccacagttggtaatgtgctgggtcacccctgaagccagcatgtctccaagtctcacccaaggcccacagcaagtactgcctggctatccctcctggttgttcaggggccaagggctctttagtcagcaggtgatgagttctgccaagactgggtccttccttttaagacagcagatttccttctggcccagggtttgtttaggagtgttgtctgtgaggtagggcctgaaatgggggcctcaggactctgcctggtgccctctcctactgtggctaagctggtagttacaagacaaggtcctctttactctctccactcttgtatttgaacagagggaaggcatctctgttggagctacaagctgagctgagctgcctgggtttgggagaggggtgatgtaagcattcccttggttgccctggctgtctcactaggtccaccccaagtccactggctctgagcccagcacagcaccaggacttacccagaaactgcagtccttgtgggcctagactgcctttcaagtttatttaggacctcagggcactttagctcttggtggtggggcttgctggaactcaggtttcaacagctgggatgggtgatttacctctggctaggtctgttctaagttctccatccttgagcaccagctgagctctgccctgtgttgctttctgctatgacagggcagcatttagtcctaatgcaaagtcccataatcactgtgctgtccgtcccccaaatgcagattttctttgcacaccacggggccactgccaggaggtgaaggaagggtggtataggtaagtcaagacagtttttcctacccgcttcagtgcctcttccttaatatgatgttaagaccaggtattgtgatcacttacctgattttcagttcttatgaaggtgcttttttgtatggatggttgttcaagttggtgttccaataagggggacgatccctggaggcctccattcagccatcttgctccacctccagttctcaagctagttctttgaaaatcaacttgggaaaagttttatacacaggaacacttgaataattgaacacaaatgttcattgtagttcagaattagtagaatattcaacaggttaccattggcatgtgggaagcaagagagcactgtggctagaaggtattgttttagagggaaacctgaaatggactgcagtgtacctgctgctatgctgactcaaaaaaaaaatttcacaaagtaggcaattgtcagggtttctagcagtctctttgagccttgttaaagaaattgttaatctcattcatacctaccaactcctagacctccatatcttaagatttggattactgttgtagcttaactgttctccctgcatataatccccatatttaggctgtctcttcaattagccacatattgcaagttcattttcctcctctggcttcctaacaaccatcagccattctccaatagataccaaccaggtgtccttgtgattcagttcaaccgtgacactgtttacctggagagagcatcagatttcccataggataagggctgagtaagattgctaccacttcagatgccaattacaagccccaggttgttacctgtgcttctcacaacttcaccttgagttggattaatttgctagaaggactcacagaactcaggggcatactttacttttgtttgcctacttactataaaggatatcagaaaggatacagatgaacagccagatggaaaagatgcacatagggcaaggcatgtgggaaggggcttgcagcttccatgctgtctccaggtgcactaccctccaggcacctctatgtgttcggcaacctggaagctcttcaaactctgttcgttgggtttttatggtgacctcattatataggcatgattgattaaatcatgggtcattggtgataaactcaccttcagcctctctcctctccttggaggttggggagtggggctgaaagtctcaaccctctaatcgaaacttggtctttctggtgactagccccgtcttgaagctccctaggacctcccagccaccagtcatctcattatcatataaaagacactcagcacttccagagattccaagggttttaagagcaatgtatcaggaatcaggagcagagaccaaatatatatttatcacaatacccttgaattattgtattgagtacttagtgtggaatacctggtctatatgtctttctcctttttgaaaaggtcaaaaggcaattgttgaatcctcagcacctgatactaagatggcagatagtagatgtgcactaaatatttattggattgattacctgccgcacctactttctctttctgaaatacccttacttcttttgtctatgcaaattctgtgcctcctttagaactcacctgttcaatgaagtatttcttgctttgcagtccatgctaatttctgaactcttactgtattcatatgctgtgccacacagcaaactctaaggaatctacagcaatgacgtaagtgtccaaagcatttctgtaatacgttaattaatatagaaacaaaattactaattaacctgttaaaaacaaatatttactcagtacttgctgtggtaaggcactgtgctagtctttaaggggacataggtaaatacttccttcaaggagcttacagtttagtaagagggataaaacacacaacagataagtggtgagtttcataaggggtgtattttgagagttcagattaggctagttagagagtaaaggtttgtggatttgattactattgggtaaaatttaaactacataaagtaggcattattagtcctgtattattgatgagaaaaaatgacacccagagaatttaaggattgtgaccaactcataatgattgataactgatagagctgaaatttaaacctagtaagtctgcctgcggaatctcttcctttaatcacaacatcagagtttagaggtggtactgataagagttagcaacactgggccgggcacggtggctcatgaccgtaatcccagcactttgggaggctgaggtgggcagatcataaggtcaagagatctagaccatgccggccaacatggtgaaaccttgtctctactaaaaatacaaaaattacctgggcgtggtggtggtgcgcctgtagtcccatctacttgggaggctgaggcaggagaattgcttgaacctggaggcggaggttgcagtgagccgagattgtgccactgcactccagcccggcaacagagcaagactccatctcaaaaaaaaaaaaaaaaaagcaatactgattggatatggggaataatgaagtagagcaggaaaaagtgacatcagagatggcctgaatgatgtgattaagaaagtgatagtgctattgataacatagagcacatgataagacataagagtacgaggaaaaatcagttaatttggggcatactgatttttagataccagtggggaggggacatctagcagttagaaatgtcagactggatgtgaaatgcagttcaagataggggaaacctgaatggccacaaaatatctaaaagcatgtctaaccttagtaggaactgtggaaatagaagttaaaaacatgagctacctcatgttttactcaactgctagattggaggggaataagaattcttatacagtactagttttagagctatttggcaatatctagtaaagttatatctgcatatactcaataactcagaaatttcatttttaggtagctgccttagagaatctcttatgtgcaagaatgttcattgcaatggtgtttgtaaaggtgaaaaatgtttaatgttcattataattagagaatagataaatcatggtatacaatagactattatgcagtaaagtgaactatatcttcatctatcaacatggataaatctcagaaacataatgtagagtgaaagatgaaagttgccttttgttactattgatgaaaaaagtaaagacctacatcattcagccgggcgtggtggcttatgcctgtaatcccagcactttaggaggccgaggcaggtgggtcacttgaagtcgggagtttgagaccagcctgaccaacatggtgaaaccctgtctctactaaaaatataaaattagccgggcgtggtggcccatgcctgtaatcctaactacttgggaggctgaggcaggagaatcacttgaacccgggaggcggaggttgcagtgaactgagattgcgccatcacactccagcctgggcaacgagagtgaaactccatcccccgcccccaccccccaccaaaaaaaaaaaacacctgcatcattcatatgtgtgtgttaattttttcatatgggcatatacacatagaggattgtgaattggaaaaatacatgatattcttgttttatctgtcccctctctcccccttttgttgcttgggtattttaaagcatatctcagagatcatgtttctaacatatacagacttaaacacacatacacgtgcatgtgcagcctgagtatttccacacaaattaaagttaataatcctgaataatatatctaagactagttttctgttaaatttttttcagttatctcaaagttgtctttttttttatttttatttttgagattcagtcttgccctttcatccaagctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaaccatcagagagccttgaggaaaaccagcggaacctccttcagatgactgaaaagttcttccatgccatcatcagttcctcctcagaattcccccctcaacttcgaagtgtgtgccactgtttataccaggtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaaggtgaattattttgataatctagctatcttaaattccccttccaactaaattttcagcttttcttacagtacttcctcttacatttatatttgaaataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctctgagttattggtctatctgtaaagtagggataaactctttgcctgagttgtttttagagaaaaaaatgagataattcataagaaagcgctttgtaaatttatgtctggaattctgcttttcatgcagtgtgaatctaattgatcctcatcatctaagctagccttgtacaactctctcttccagtttatcatcattgtagttgttactgactttttttctgttagagaaattggagttgaaaaggtatattgctgaatgacaagccatgttggaaagagagtgaatgtcagcataggattcatattctggcactctgtgtacccatacaaagttaaaaggatcaaagttttaatcctggctctgacctagcaggctatatatctttggggaggtctttcgtctggaccttcatttccttatctgtaaaatactagcctctttccaaagtttcatccatcttaattttgttgttgtttaacttcagagcctactttgaagctgaagccgggtatcagaaatggaaagccaactttctccttgtcctttttgctttgtctaatgtcaagtcacattgtgtgaacaagccctccatatttgtaatcttagttacttcacaaagttacttcttataaatttaattcaaacataagtctgggtgtatctggtgttgaaaattctaatgactttgcatttttgaaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacaggtaagatttcccagtcatggggatagtgaacactctccgtttaaatttagattaatacaattattggtcatgaatagtgctttttactttgcatcttcttggactaagaattatggtttagaaagagaaagattctttttttcaaaaaaatacaaacaaaaggttaagtcatattaaataatcaacaaacctacctaggttccagtggtcattattattatttttttgtcaggttaagaaatcacagatttgctctttgggtttttatggcttgcagattgttatagatccaaagaagttcagattagcgttggcatttgactctgaagaacagccaattcgtaggaattcagtaattaaaatattgtcagtgttttaattctatgataaactcattcgtgatactcttaagtatatgcaaataaagctttatatagaaaataccggcctggcacagtggattacacctataatctcagcactttgggtggctgaggcaggcagatcacctgaggtcaggagttcgagatcaggctggccaacatggtgaaaccctgtctctacgaaaaatacaaaaattagctgggcatggtggcaggggcctgtaatcccagctactcgggaggctgagccaggaaaatcgcttgaacccaggaggcagaggttgcagtgatccaagatcgcacaattgtactccagcctgggccacaagagctaaactccatctcagaaattaaaaaaaaaaaaaaaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaattttttttctaagtagtttgctgtatctagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggtaaagtacaaccttgaaatagttgattgctttctttttggttgagaaggagagtttgccaccaggccacttgttagatatgatagaagactatgaggaaagatgtatttaataatcacattgccatgtttggggaatccaactatatattatttatatatatagggtgtgttttattttatatattgattgtcataacaatagtaacaaatcatattttatcatcttgctttcataagttttcacatttaatacttaccagggagtgaagacaacattattttcaaattatagttaaggaaaatgcaactcaatgtgaataattgacttgcctaagattccacacctgattcataggtcttttggttttaagtgcaggacttctctactacactataacatttttcagaaccctcataaaggttaatggttttaaattatttcagattaaggttcagaaaatatagtatacttcagtattgctataaaatttctgtggacatttgtttgaatcccatttagtgggatttagtttgtgaatgaaaagatcctcattgttagacacttactctgtgatgatacagtgagagtagtttgctgaatcttttaaagtacctttcacaggactttatgcttagtaagtgctccttcgtgtctgtgatttgagtgctatgttcatagtatgttccaaaacagaataaaacagaatctgatgatgagaagttaaagatttgtatataatatgccttgaattgtaagtgcctgttgttagttgtattacttacaggtcatggttttgtacatataactccaaaccattgatactgttaaaagaatatatgaatatatgaaagaatgtataaacataagaatgtatgggtatatagtgtcctttccaaattaatttttatttttagctctactagattttttttagtgtaacaaatgtttattcctatgtaattaagggcatattttccatacagactattcacattacctaattgaaaattatatactacaaaaatataatactatttttaggccagacatggtggctaatacctataaccccaacattttgagaggccaaggtgagagaattgctggaggccaggagttcaagaccagcctgggcaacatagtgagaccttgtctttattagatagatagatagataggtaggtaggtaggtaggtaggtaggtaggtagatagataggtaggtaggtaggtaggtaggtaggtaggtagatagatagatagataagataagataagataagatagataagatagatagattgggcacagtggctcatgcctgtaatcccagcattttgggaggccaaggcaggaggattgcttgagcccaggagtttgagaccaccctgggcaacatagcaggactccatctctacaaataataaaatattaaccaggtgtgatggtacgcacctgtggtcccagctacctgggaggctgaggtgggaggattgcttgaggatgcagtgaactgtgattgcaccagtgcatttccagcctaggtgacagaatgagaccttgtctataaataaagaaataagtaaaaatataaataagtaaaaagaaatataagtaaatataaatataaataaatataaatataaaaatgaatgaatcaaaacagtttttaaatttgacatcactgaggacatcctagccatttttctagaaaaatatttttattattccttttttctgagatcctaccttcccttacaaagcaatcttttgtgcttttgaagattaagtaatccaatatatataatatacttagcatagtatctggtacttgtaaagtaattaataaatgttggatcttatttttgttctaaattcccactgatgctcttggagacccattttcttttttttaaaaaaaatgaaggtagctttataatattctcagttatttaaaaaattattaaattacttgatatagaaatctaaagaaagttaaaaaaattaaaaattgtttatcctccctctcagaatacttcacttaacgtttggtgaatagtctcccagtcatttatctatgcacatgtacatttgtttctcctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctcaaaaaaaaaaaaaaattaaatttatagctgaagctagtttctaagcaaattacctagcatacagtcagtatagacagataaatggaaaatatgaaagaggttaggagatgcagaagataaaatgaggaggttcaaaatatgtctagtaggtgttccctagaaactgagctcagtgagaatgggaagaagtaatatttgaaaggctaatggatgtatgttttctagagttgatgaatgacatgaatcttgaggttgaagaagcacactgagtcttgagcaaactatataaaaattaaaccaggctttaatacatatgggaacataatatatgctaaagctggtattcagaatcgagattaggatggactttcaataaatggttttgataaaactgagtaatgatttggaaaaatattttcataccatttatgataaacttccataaatcaaaaaaaatgagcaaagcaaggcctttttcatccattcaaaatccataaactagaaaagattgataaaatgaattatttaaaaaatcataaacttctgtctgggacaaaaatgtcatgagtaaaaccaatcctatggttaatattcttgcccagtagttctcttagaatagtcctaaaagtgcttttgtggttcaaagagtaataccttgaaatttttggtgcatgttgccaaattaccctttagaatgcctgttgcttttaaaatattttttcattttagtattttattgtttatccaattatagacttttttacatactcagtagacaacataaagcctcataattactctgttatttttcttttaggcatcaggtacatgaaaaagaagaattcaaggctttgaaaacgttaagtattttctaccaagctgggacttccaaagctgggaatcctattttttattatgttgcacggaggtaagaaatactatgttttgggtctcttaacagaattttttaaattatagcaaatatagagagatggcaagtttggtttttcccagttgacttaacaggaattgaagacaagtttacttgggagcatatagcagggtaaatagcctgcgtttcctaaaatgatggtcggtatctagtagctgcttttcatactacccatttcatattgcttactctgtcctacatcattttttaaaatactgcctgcaatggattaattaccaagagttaaaaacccacaaagaatcttttgttttcaagtatattctgattaaatagtactcacaacatgataactgggaactttttttaaaggaagaaataaaactataagagcctatttctgagaacttttaaaaatatgctgtgtaagacagcatcaggatgatttaaaaaataattcaaaggagtggtgaaaaatctctatgaagatggtgcaaggggtggcctggaaaacggtgcttgttcatgctgccctcagttgaggctagttcctagaaagcctttctggaaatgttgtgagctcttccttaataataggtatgatgcttgccttgctttccctaccattgtcttttcttttttgcttcattttaccttccttttgaaaactcaatctgtgacgttatttggtcagttttactttttcccatttaccatgacatacattcatggtaattgagccttagagacaacatgatacatagagaaaccactgactttggaatctcaaggaccatgtttagacctagttctgctactcattagttatagacttaatctttaccagtttcctgaatttaacagtatttaacatccatgaccattaagttagtagacttacattgttagtcagcttgctggccacaggtggcagtgtgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgtttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatcttttttttttttttgaaatggagtttcactcttgtcacccaggctggagtgcaatggagcgatctcggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctggggtatgtgcttataaaaactgtctacctctcctataaagtgttttgtgacctataaagttgtgtaaggagtaaatttgagattttctttttttctttcattctttttttgggggatatggcactgtcagtttcagattttcaatccttttagtttcttacttagacctactggagctcctcctgaccttcattttcacctggtgtgaagcctagctccaagacagatgagtacacagtatatcagagcagagcatccatttactccattatgaaggtcttgtctgtctgtatgccgtcagttttgtcaaagagcacttgggtttgacttctcttttgatattcctgtgtttctgtggcttagactactatgtattaagtaatgctttttgaattgtggattttctaatttccttatcgatggtccacagacgtttcagacttgaaatgtccaaaacttaattcagtatatcttcaaatcaacctcctcttcacaccgtatttctgtttctcagtaccatcatcatcccttctagttccccatctagagaccctaatcattttaaattctttcctcttattgtctttctcattgttagtcaccaaatcttggttttacctgtgagatcctgggcaatcagttaagttgttttagttaggcttttattgcaaagcagtcatttgtattttctcaaggatagtttttaggaaaagcatgaattagcgcagagcctacccagatatagagaactagatggctgtggtgctggaactggctatgctctttgactgtctctcggttttgtgttcaactcttcctcatgattttcatctttctgtatcctttcagcttttgccccagatagtaacccgttcattatctcagtactgcacatctgaaattccagaaagaaaatatgattcagctaaaaagcatctctgcttggcagaaactttaatgttaggttctggccagccagttgattactggctgcccctatgtccagtatgtgctcctggcccagcagtcatgtgattcaaaatgtgaccacttggctgggcgcggtggctcatgcctgtaatcccagcactttgggaggctgaggcgggcagatcatgaggtcaggagatcaagaccgtcctggccaacatgatgaaaccccatctctactaaaacacaaaaaattaggcaggcgtggtggcacgtggctgtagtcccagctactcgggaggctgaggcaggggaattgcttgaacccgggaggtggaggttgcagtgaaccaagattgcaccactgcactccagcctggtgacagagcaagactctgtctaaaaaaaaaaaaaaaaaagtgaccacttggtgctgtttcttcatcaggggctgttcttaggtatgtgttttaattttttttgttttgtttttgagacagggtctcactctgttgtctaggctggagtgcagtggcactaccatggctcactgcagcctctagctcccaggctcaaacaatcttcctgcctcatactcccaagtagctgggacaacaggtgtgtgccaccacagctggctaatttattattattattttttttgtagagatgaggttttgctatgttgcgcaggctgggcttgaactcctgggctcaagcaatcctcctgccttggcctcctaaagtgctggaattacagatgtgagccaccacacctggcctaatttttttttttagttggaccttaatggtctaatattactattacgtaccttggcaatgtctttcgaaaccattttcccccactgctttgctggaactctgtgtcttacctatactaatgtagcattattctcctcctccttcatcaccagttgactacttctaggtaatcttaacatttcttctggagccagtttccagtagaaagcttgtctgtcccattgactccctgtataaagtccaagttctgtagtcaaacatgcaaggtaattttggcctaatgtacttttctaatcttttccttctattccatccaatatacttatgctcttgccctgtggtaaggtagcataatacaaggacattgttgcaacattgtttatatagtggcaacaaaaaggaaaacaatagagttgtgtttcaaaaggggaattgttgaataaatgatgatacatttacattagggaataaggcaatgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactattaacacattcatgaaatatgttaatacagatgaatgtgttattttgtagagcgctttagtttatcagattagcattttttgtctgtttaataaaaaataaaatatagaccgggcatggtggctcacacctgtaatctcagcactttgggaagccaaggcgggtagatcccctgaagtcaggagtttgagaccagcgtggccaacatggtgaaacccctctactaaaaatacaaaaaattaatcgagcgtggtggtgggcatctgtaatcccagctactctgggggctgaggcaggagaattgcttgaacccaggaggtggaggttgcagtgagctgaggtcatgccattgcactccagcctgggcaacaggagtgaaactctgtctcaaaaaaataaaaataaaatacaaaaacaacttcccccataccactccttatcccacacccccatcctctatcccctatcccctatccttcatctctctgtcactgttgctcactcgctctctcactctcatgtgtgtgctctctctcacatacaccacacacacacacacaccccacctacataatttcttctcttacacctttaatataaatatctgagttttggttcagttttgcaaacatttaaaaggcaaacatggtattttgcttgtttcagcatttaataaggtagtgcatacttctttcatatggaaggaaaacatcatattaagttaatatttaaacgtacacaattataatttgcaaaaaaaaatcaagatgataatttcttaaatagtaaattgaaataaatgatattttcctagcatgcttgtcattcagcaataataagaaactgagataagaatgcaggcagttgaagttcacttcagcctgagtgcaagtatacacaaaacagcaaaaatattacatagaaaataaatgttgtccattggattgagtatggtgctaccatttgtcacagtgttcatattcatagttgtggctatctttggggtcactgctgtattcagacttgtcttggaatttggagtcatctagggatttgaggtcattttgagatttgggcttgtcccaggattggtgctaccatttgtcacagtattcatattcatagttgtggctctttggggtcactgctctattcagacttgtcttggaatttggagtcatcttgggactcgaggtcattttgagatctgggcttatcccaggattggggttcattctgggattggtgctcttcctgggattaggtctggtcccgggattcaggcttgacgcaggattggatactgccatagaatttgaggttgttgatgttgaagtttgtccccggaatgttaacaaacatgaagagcaggccaatcggtgatagcttgaacatcatcctcctctgtttcacaataattatataattttaattgaacacttggatcacaaataggcaagcatatatccttaattgtgtttatcagtacatttgtgttatgtaaatgtttgctttttcactattagtgaacaaattaaaagcttccctttctttgttgtcaacatctgctgacacaagacctattttctattgagggctaccaactgaaggcaaaaacaatcccaagactgaaaaagagcttaattggcatttttctatttaaaaaaggaaaaaaataaaactctagacattcaatgcaataaatatgggggcttgagatcagtatagagtagggtaggggcaaagactgagaggcaatttgggacagtagagcaacaaaagaaataatgaaataaatattggtattttcttgatttctcatgacctttattccaacaatttaaggttttagtttaggtcacaaattaggatattacttctaaatatttacccaaagactaaagaggttaaaccaaagcatttccccagtgctgggatgaggttttcttcattaacaacaacaacaacaacaataacaaactagagaagttcatagttttaagatttagaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatatgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaatggcagaagtacaagccagtacatgttcctcacttgttttactgtgctgtgaagatcatttttcccctgaatgaataaaccatgaatagaaccatgcttggtaaatcttatttatatggtacatataataacttcacttaactggaggttaatgtggtcagatctaagaagtaaacaaacaaaaaaaaactacttggcaaccagagtagatattatgaatcggagtactgcagtaatttacaggagtttgtcattgtcctctctctgctcacttgctcattctgtggatttctttggggggtatatagttggtaatagtaatagtaatagtaatagtaatagtaatgtttcgaacttgagcaaactgtgacttattctatttttctaatcttgaccttttgagtactacacttacacaactctttattgatgcttcaaacacctcagtctcaacttgtttaaaattcagaagttagtgttttctccttcctatttttgtatctagatatattcttctcataatctcttggttaattgtatcatcacctagccaaatgtttctccaacactggatttctcattatcttctctttcttatttatcttaagctctccaggcctcttcatgatgattaagtaaaatttaaattctatttagtactcaaatgttcccaaacaaacaatagtcaatttgccattattcaggtcttcaaatacccaccaactttgtatctttgtgcagcctccccaacttgcccaaagtgtaataatagccccctcttatcctaagtttcactttccatagtttcagttacccatggtccaccatggtctgaaaatactcaatggaaaattccagaaataaacataagttggatgtatcatgaggttaatagtagcctagcactgtgtcacagtgctgcattagtcaacccacttcatcttatcacataggcattgtgtcatatcacatcatcacaagaagggcgagtatagtacaataagatattttgagagagatgccatgtgcatgtgcttttattgtagtatattgctataacttctattttattattgtttttaatctcttactgtgcctaatttataattaaactttatcacaggtatttctgtataggagaaaaacacagcatatattgggttcaatactgtaattctgtggtttcaggtatccctgaggggtcttggaacatatcccccacagttaagggggtactactgtactttcctcattcaaaattgtgttgtttcttcaagctccactcatgtcagcaccttttatacgatccttccctaattcttcacgtcagaatcagtcattttagtactttatactttgatcagagtctcattttcactaaagaaactaaatcttccaccatattctggctttttttgtggtaagataccacctcttattccttctattccctctagcttctaatatagtgagtgtttataaagaataggacacagggccagttataaagaataggacacaggctcatgcctgtaatcccagcactttgggaggccgaggtgggcagatcacgaggtcaggagatggagaccatcctggctaacacggtgaaaccccatctctactaaaaatacaaaaaattagccaggcttggtggtatgcgcctgtagtcccagctacttgggaggctgaggcaggagcatcgcttgaatccaggaggtggaggttgcagtgagctgagatcgcaccactgcactccagcctgggggacagagcaagactccatctcaaaaaaaaaaaaaaaaaaaaaaaaggggcacaataagtattggaattcattgaaatacctcctgtttctccatgtcggagggctggtatcattaatgatgtctaaagtaagagttatttggttatttgcagttttcccttcacattagcataaatttggaaggcacaggcttgagtttaactttcatctctactttcctggctgctgttttgagaagatttcttcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttagtgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatctacgtataacttttgcctccccaaaaactaaactactaataagactgttgatcggaagccttttgataacataaacagattaacatgttttgtaagttaaatgttgtatatgctatattcttagagtgaaataagctccagaaaagaaattgttacccagaaaatcatgaggaagagaaaatatatttactgttctctgagtggaagtggattatcacgaaggtcttcatcctctttatcttcatgttgagtaggtggaggagaaagaagagggattggtcttactgtccccgggctggcagaggtggaagtaaacctctgtataagtggatcagcatggttcaaagccatgttgtttaagggtcaactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtctcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtccagttttcccttctgtaatttttttctttggtctttttggattttttgggttttttttttttttttttttttgaaaagaacacagagatcttttcttgagtgatatttgcacagacattgccttggtaattgaagcttttttttttttttttttttttttttttttttttttttagaaaatcctattaagttttatgccatgtctatgctcattgcacctgtgcctcatgtctcattcattcattcgtttatttttttattattttttttttttgagacagagtttcgctcttgttgcctaggctggagtgcagtggcacgatctcagctcactgcaacctacacctcccagattcaagtgattctcctgcctcagcctcctgagtagctgggattacaggtgcctgccaccacgcctggctaattttcgtatttttagtagagatggggtttcaccacattggccaggctggtctggaactcctgacctcaggtgatctgcccacctcagcctcccaaagtgctggaattacaggcgtgagccgccgcgcctggccttcatgtctcttttaaataggacttctaaaattttgaaatgaggtcagcttcagtggctcatgcctataatcccagtgctttggaaggccaaggcaagaggatcacttgaagccaggggtttgagaccagcctgggcaacatcatgagaccctgtctctacaaagtacatttaaaaaaaaattagccaggtgtggtggcacacacctgtatagtcttagccacttgggaagctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagtttaaaaaaaaaaaattcattgaaatgaaattcaccctttttgaagtgtacaattgcctgggcacagtggctcacacctataatccctgcactttgggagactgaggttgggagagtcacttgagtccaggagttcgagaccagcctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtctggaaaaaaaaaaaaaaatcttttttttaagtatacaattttgggccgggcgtggtggttcacgcctgtaatcccagcactttgggaggccgaggcaggtgaatcccgaggtcaggagatcaagaccatcctggctaacacggtgaaaccccgtctctactaaaaatacaaaaaatcagctgggcgcggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaacaaaaaaaaacactaattaccagtttttttgtttttgtttttttgggacagggtctcactctgtcgcccaggctgaagtgcagtgacgcagtcacagctcactacagcctcagcctccctgggctcaagtgatccttccagctcagcctcctgagtagctggaactacaggtgtgcaccaccatgccagactaatttttgtatttttttgtagaaacaccatgtctagctgatttttgtattttttgtagagacagggtttgtcatgttgcccaggctgatctcaagctcctggactcaaatgatccaccttggcgtcccaaagtgttaggattacaggcatgagccaccttattaggcctaattaccagttttaattatagacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgcctcagtctcccgagtagctgagattaaacagtcatgtgctaccatgcccagctaagttttgtatttttagtagagatggggtttcaccattttggccaggctggtcttgagctcctgacctgaagtgatccgcctgcctcggcctcccaaaatgctgggattacaggcatgagccaccgtgcctggcctaatttttgtatattttatagagacggggtttcgctatgttggccaggctggtctcatagaactcctgacctcaggtgatccacccacctcggcatcccaaagtgctaggattacgggcataagccactgtgcccggccaaaagtttttttgaatcacctatggttcatttatttcagtttaagtgtataatcctcaaaggaaataatccattgggatgtatttatgaagtttaagtctgtaaaacaatgtggaggccgggcgtggtggctcacgcctgtaatcccatcacattaggaggccgaggtgggcagatcacttgaggtcaggagttcgtgaccagcctgccaacatggcaaaaccccatctcttctaaaaatacaaaaattagccgggcatgctttgcgcgcctgtaattccagctactcaggaggctgaggcaggagaatcgcttgagcccgggaggcagaggttgcagtgagccaagataatgccactgcactccagcctgggtgacagcatgagactccatcttaataaataaatagccaagtgtggtggcacatggctatagtcccagctacttgggagggtgagacaggagaattgcttgaacccggcaggcagaggttgcagtaaaccgaaatcgcaccactgcactccaacctgggcaagacagagtgagattctgtttaaaaaaaaaaaaaaaaaaaggaaaaattctgaaacaaccatgtaagaataaatgcatccaaatgaacgttgttcatctcagaagagtcacctttggaggtgatgcacttagttccaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcactttgggaggccaaggcaggtagattgcttgagcccaggagctcgagacaaacctaggcaacatgatgaaaccccatcacctgtacaaaaaattagtagagtgtggtgatgagagcctgtagtttcagctgcttgtgaggctgagatcggagaatcactttagcctaggaggtcaaggctgcactccagcctgggtgacagtgagaccctgtcttaaaaaaagttttcttatgtaacttacaaactagctcttagtggtatttgaaaggaacagccccagagttgttttcagtaacgatggtatcattggagtaaaagtatagcgatccaacctgactactttgaagaaataatacagaaaatgaggtgtatcatgtgtgacatttatgtttaaatttaaaatcagtttatagtcaactcatagttaatatacgaatattttttactaacttcaagtgattccttgatcctttaaataattttaatatgcttttttgttgttttttgttttgagatggagtcttgctctgttgcccaggctggagtgcattggggcaatcttggctccctgcaacctccacctactgggttcaagtgattctcctgcctcagcctcccgagtagctgggattacaggtgtgcaccaacacacccggctaatttttgtatttttagtagagacagggttttgctctgttggccaggctggtctccaagtcctgacctcaggtaatctgcctgtcttggctcccaaagtgcttacaggcgtgagccaccacacccagcctattttaatatgttttaaagagactttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgctctgctgttaaaccaccaatatagttagaattattttgatcagacaagagcgaagcagttttcctgtttttagtgagtgcgtatgtatgtttaatttctgtgctttgatctcattcataactgtgtgtgtgtgtgtgtgtgtgtgtgtgtgtgtgtgacacagggtgtggctttgtcacccaggctagagtgcagtggcatgatctcagctcactgcaacatccgcctcctgggctcaagccatcctcccacctcagcctcccaagtagctgggactacaggcacacgccaccacacttggctaatttttgtatttttttgtagagacagggtttgccgggctcagagctcaagcagtctgcccacctcggcttcccagtgtgctgggattacaggcatgagccactgctcctgggctcattaataacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctacacattgtgcacatgtaccctaaaacttaaagtataataataataattaaaaaataataaaaataaaacatagttttaaaaatacaaaaaaaataaaaaataaaataactttccagaaatttagattcagaatctcaggtcaggctttctagataaggataagtgggtatgttgagcatgtgtctcacctggctcttaaatatgtttaacaaagttggggctgttgaaccaaactgacatttcttaacagttgatcttcttaaagacctcactttgcaccacagttttctaaatgtgaaacatactaatctgcttaacacattattaacaccttaacatgacatttgtttctacttctcttctaacttcccttgagcaattttctatattgaattgttcatgggtatcagaattaacctttctctagaattgttccaaaggtaactccacattgcccagaactagttttttttgctttgttttttttttttttttttttttttggagtgggagacagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaatacatggttctatgtcctataattttttcttatttttctaatatttgcgttttccacatttcacactttaaaaaactcttcataaatatttttattggccagatattctggtcagtgggtcattgtttacttaatttcctaatggtggatatttattgttgtttcagtttttcttgttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtattttgtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggattttgtatagaccaatctattgataatttctttgtgattgtttttttttctaattaaatagccttccacctgaagacttacaaatatttttaaattcttctgctggttttatgacttccttgttcatgttttctttcactttgtcagtgtatcacatgaagtgagtgttaaactgaacttttttccaatttcctcatctcatttattgagtcttttcctttcccctttggtttctgatttttctttccacagctaacaatgtttgagaatttactgtgtgctaggcactgttctaaacactttatctgtattatctcattttcttctcacaacaaccctgtaaggaaatagaggcacagaaacctaatttgctgaagtgacacagctagtaagtaaagctttgtcacatattcagttcttctgtgtacctgtgctctcattgtgctgttgtttctatattgtggttatctttctgtttttatgccactatcattctgtaattattatggctgatacatgtttctctctcaagaaaagctaatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctgactttcttctgggtccctatttcactgatatctaaacctgatttctagcagggaagagactaaagcaagcacatcctttcattcccttgctctcagtgtgtagagctgaaatgtttccatatatgggaatttctcatagcattgggtttggacatacagatgtgataataatcctcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcagtgtttgggagggagtggagatagcttccgtatatagagaggtaatgcattttaaaatcatttaggggactttttcaaataatcctgtttcttcatggtgagattccctgacacagtgagccaatcaggtttgctaaggcagaaaatgttcgagagccactgtactagacagcatgaaagatgactgttttgttgaagcttaatggtaatttttccataatcctggtccttaaaaagcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattttctcctttattttctctctccctccccccttttctaaccatattctttcttatttatctttctagagccttaatatgataaaatagcattctttgcaaataaatagttgcagttgtaggctattactatttttgatgatatgctttcttactcagatgagaaaaaatggctgtcgtgtcttttttttttaatctctgcagtaatgtaattcaatgtgtgtatatagggtagattttatttagatattaaagcagttcttcgaaattttatctgtatgtttttaggataaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatgatattagtcccactattttttaactcctgcctttttatattcctttctaaaattgtataattttcatgtcacttttttaatattataaaaaatctgttttatgacttttatgtcttcccccaacatggtgattattatgtttaatcagcttttcaaatttatcaaccacttaagtgttccgtcttcccttttaggatgtatagaagtactgaaatacgattattttttctttatctttctgatacaatgatcatttgaccaaggctacacacaagccaggatacatttggaaattagcatcttatacttcagattatcagttcctatgtaaaataaacatgttttattttatatatttggagttaaagttttttttctttatgcaaccttgggtggtaagtggatatgagtattgttttttccaaagacatttttggtgctgtatgaatgaccatttatttgattttatgttttaagaatagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattctaacaatctcttacactgggtgcagcacaccagcatggcacatgtatacatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtcttttccatcctatttccttccttctgctattagtaactgtttttattagtttttcgttgtatcattaacatttctttttgaaaacctaaaaaaaatgtaagcatatgtatggtatgttcttatccccccttctaatataaaaggtgacatatatacatactgttagataacttgttcttcttttcttactgtatcttgagtatcactccatatcagtatataggtatctgtatgattcactgtttgatccatagtactccatttgggaatgtaccatggcttattcaaccagtcccctattggtggacatctgggtttttcagacttttgctgttacgaataatgccacagtgaatacccttgtacctaaataattttatatgtttgccagtaaatctttgaaaaagattcctagaagtaggattgctgggtaaaagggtaaatgcatttggaatttttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattcagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctggttaatgctattttggttaagagcaccactagtatgtggtgtgaactttaatctaccttttattcccctgtgccttattcttttgcagtattcatgaaataaactttctcttctggatcttagttctttaatcttttctctaaaagatttttctttgttccagcattttcttctgtcctgcatttattagtttgtatctcttcctgctgattaagcaaggattgccactgtttggctgctcagcttccactgacctcactggggaaaattacatgcagttaaatgtgaattattcttcccccagcaaagaatttctttaaaaaaaataaaaggaaaaaagacaacataaaaacccggctgctgccagtagtctgtcctgttatacaaagaacagaaagagaaaacctccctttaaaagtacttaaagatatcagacaacactgtggtcagctaatcagctcccgtttaatctaagaaaattggtatttccctatttttccctgtatttctttcaggaaagaaggtggtaaaaaggggcaaaaatgtggaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaataccaaaattagccaggcgtggtggtgcacgcctgtagtcccagctactcagtaggctgaggcaggagaacccctttaacgtgggaggcggaggttgcagtgagccaagatcatgccactgcactccagcgtgggcgacagagtgagactctgtctcgaacaaaagtactaactttgaagaatacatgaaagaaaatttttaatgaggaagacaaaagatgtaatatgacaataagtatcatgcttattcaggaaaagtaagaagctcaaggaagtgtttctatagattaaaaaattaatggtcagtaaagatggcttgaaagattttaggaaaaacattgtatgtaaaattcctgtgtccaaaaccctactggttcttattaaatatggagctttgttaatgtcatgaatgccagtgctatgaataaatgctatgttctactctgaaaatcccagaactatgagtggttctccaagactgggctaccattttattctaagtgcttgtttccccctggagttagatgggactaatgaggaagaatatgtgcttgttgggcaaaggagcacttctgcagacaaaggctggcatccccaaaagtataggctgatgaccactcttgactttgacaaagattgggcccattcctactctaataactcagacttaccaattgtcagataatggataaagatgaaattctgtgtaagaaaggtgacttaagagtggatagcatcagaaagtataagtttagtaaaaagttgagaatcatctgtgttttgatagtctcttttcctgaaaaaaaaatcacccaaagtcacccgtatttagaatgaagccatagtcttcttttccttttttttgctttataaaacttgattttgtttgggtgtttataaagaagaaacttgtaaagatgccagttttaaaatttgtgcccccccaacatggtaggaaaatatttacattttatgatgcatcctcatatttttttcagggtaaatgttcctaacccaacccttcagttgatgttttaacatgtttgttttactctttgcaatgaaaccaagaagaaaatttctctattctcaaacatgcattttaatctcccattcccacaaacttggaatatttatttaatacttgaggtattaatttaaaacttgaagcatatacttagtctcttattcctctccaccctggtctttgaaatggaaacataaaagtttattcaccataattttatacacagcttttcaggggaaaaaaaactgtactgggtaataagtatatgtagattgtttcagagttcttaaattattgaaacataccatttacatatgtaaaatgtactatactttaaagataggtactataattagtaaatagattactgttaaataactttttttaaaaaaaagtttcatctatgcacataggctctgagcagatttcagatagttcctgaataaaaatcaaaattgactatcagttgccattttatatatgttaacatataaagaaaaaagagtcatttgaggatggaagatcagctaaaaagcaagttgtaatatttataacagttctgcaggtggaggtggcagggattcattaagatcttgatcagagttgggaggaatagagaactcctgacactggatctcaaggttggaatcttcttggtttttcataaaatctactggtggcaggggcaagttaagtgagtcaagcggtggaaatgattgtattatctcagatttatgatctccacagtcttgattgagacagtccagagatggagggagactagtagaatcatttggaagaggagatacaattgtcattgtgggtttgtcagattggttactttcctgtccttccaaatccagaaggggaggtggtggaggcagatctgcatcatctgaagaagaaacagcagttccaactgttgaaccatcagcactatcttctgatgtaccatttacttgatcttttattttctctgttttggggttgttggagtcttcaatgttttcacttgattcaaacaacttaatttctaagtcatctgctaaaagtgtgcttttgcttggtttccagggtgtaagtgaaatgattgatgtacgttttgtggatatttcattttctctgatgttatccatacaaatgtcaggggtttctccatcagcaaatggagatctacctgcccaattttgatcatttaaaactggtttccttaagcatttccaaagtacaatgatgattatagctaccaacatagaagtcagaagtacaccaattagtatggcagctattgaattataattgtttttttgtggggtttgtttgttactggtagtatctaagataaatcctggtgtactcctaggtgaatttttgacagttgatgttggttgtgtggatggattatgaacagttatttgttttctagaagggatctggacagatgatgattgttgagtaaaagtatagacaaatgactttggtggttgtgtggtagaagtacgggcagatggtagttgtctggcagaggtgaacacggcttgctgggaggaggtgttggctattggtgttggttgtttggtgttgtaggcaagtggttgtccagcagaagtatgtgcttctggtttttcagaagaggtatagacagctggtgttggttgtccagcagtgactttggcaggtgatattgattgtccagaaaaagtgtcgctgaattgtgttggttgacccaaaggattccctgttgtgttttgagaattagccaatacctgtgacattgatgatgtgaataaggtaggctgtgactgcttctctgttgtaattgtctctgtctttgaaaaaaatgtattgttcaggtgtccacaaaacaaaattaagatgaaatatttgggatccatttcagaatatttcctcgttatctatagcgggtttataatgaaagagaaagacagttaggcgtcattggtgtctagttaaaaatttgacttttcattatgattcctggcataaagtaggtagacattattcctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagattaaaaaaaaaaaaaaaagatagtcactgcctttaagtgtttcagattctagtgatagaagcaaacagtaaaggccaggcgtagtggctcattcctgtaatcccagcactttgggaagccaagatgggaggatcgtttgaggccaggagttcaagaacagcatggaccacatagtaagatcccatctctaaataaaaagaagaaagaaaaaaagctaaaaaataattacaataattttttttttttcaagacagtcttactctgtcacccaggctggagtgtagtggcacaatctgggctcactgcaaattccgcttcccaggttcaactgattctcctctctcagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtgatgataaatggccctgttttagtagaagaaaagatatgtgatttttttccctatacgaataattcaagcctgaattttaaaacagttctcctttgaactctcctgcacactgctgaattaatcttaaaagtgtgcatgatcaggttactactgccttgcttgagggtttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttcttttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttatattttgatttctttgtagttaatgccttatatattaggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctgaatatttagaatattttaaaaagaaaaacataaatttaaacattttaaagacagttacagtgaagcaggagtccccgtgtataagacatgttctttttttttttttttttccgtttggagacagggtctcactctgtcacccgggttgcagtgcagtggtgcaatctcagctcactgcagcctctgcctcctgggctcaagcgatcctcctcacacctcagcttccctaaagaagttagaaactgcaggtgcactacaccacgcccaactaatttttgtattttttgtagacatggggtttcaccatgtcacccagacttgccttgaactcctggactcaagtgacccacccaccttggcctcccaaagtgctggaattataggcatgagccaccgagcccggccatagacatgttcttataaatataatgcataagtacttaaagggtccagcatttaaaattgatgctgttaagttggatatgttaggaagtatgccattatcttttaaagagaatcaagatttggagagcatatcctagacaaaagacaagtatagatagctgtatcaattactttgatataataaaagttgtgatgcaaatataatagattaaaatttagcagtagtattatctctaactagtgaagttttgaaaccgtaaaagaaaaaaccagccattctgcatcttgaggaaaagtggaaagagaaattgaccttcaactacaataggaagtatttgatgaccatcttgtatcatgatagtgaccatttactgagcacccaccaaaggctaagcagtatcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggatcgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttctttctaaattaagtgaaagtgaccattcttactatgcaaactaaaggggatacaaaaattttaatttatgcattatattatgtacaggaaaattctataaaaagtacattagaacttttaacaattaatattttggaggttataaattcagtcatagcctgtggaatctagttctatttctaacccttagctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcgtgccactgcactccagcctgggagacagagcaagactctatctcaaaaaaaaaaaaaaatatgtgtgtgtgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcataagaagtgagtgatgtgttctgtttacttgtatgaccttaggcaagactctgcacttctgagtcaccgtttcctcctctaaaggaatattttattgggttattgtgaggattaaataagatagcataatataacatgtataaatgcctcaccaactgcaggtaaccaataaatgtaatgttatttcctcataatataaaaagtccagggtaaaagtataattacattattttgcaaatgacaggatctcattcttttttatggctgaataatactccattgtgtatatgtaccatattttctttatccattcatctgtttatagacacttaggttgcttccaaatcttggctgttgtgaatagtgttacaacaaaagtgggagtgcagatgtctctttgtacagttttcctttctgttgggtatatacctagcagtgggattgctggatcatatgatagctctatttttagttttttgaggaaccaccaaactgttctccatagtggttttactgatttacattcccactaacagcgtacgagagttccattttctccacacccttcccagcacttgttattgcctgtcttttgagtataagccattttaactggggtgagatgaggtatcattgtagttttgatttgcatttctctcatcagtggtgctgagtaccctttcgtatgcctgtttgccatttgtatatttgtaattaaattattttgaccaaatattttactagtgacttttgagttcaagttctcaactatttatttgattacccacaaagtagttacttctcagtggaaaataaaataaattggggatcattttttaaataagaagttaactaaagttaacttgttactaaagggtaatgaggggttggggagatggtgttaccagttaataggtacaaaaaacaatagaaagaatgaataagacctatttgatagcacaacagagtgactgtcattaataccataattatacattttaaaataactaaaagtgtaattggatcctttgtaacacaaaggataagtgcttgaagggatggataccccattctccatgatgtgattatttcacgttgcgtgactgtatcaaaacatctcattaccctttaaatatatacacctactatgtacccacaaaaatttaaaatacaaaaaatttttaagttaactaaacaaagtgtattgaaaggagtgagtccatctgaataaaaatttctttgagtaagtcacctttcctctcttgaaaaatggagatcataattcctaatttataagcttattgtggaattaaataaatgtaaagtgccttggatgatgcatattatagtaggtacggaatgtgttaacccatgcactgctttttcctggtcactgcgggaaacacaggttattatgaccttgttcttaacttcagggtacttatagcttggtgcaaaaagaatagtttttttttatgggctcctactataaagcataatataatcaaatgctataaagcttttgattcactggtttttggaagtattgttgtttttacggacagggtattgctgtgttgcgcaggctggtcttgaactcctgacctcaagcaatcctcctgcctcagcctctcgagtagctaggactacaggcacatgctactatgctcgctggctggcttatttatttattgtaaagatgaggctcttactttgttgtgcaggctggcctcaaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacacgtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacccctaataaatcattaggctacttggcatccttgaagtccaaaaattaatcaacctttggtacttgttgttaatgttccagtaagtagtatttatagaaaagatgaatattattaatcataaacagtgaaacatactttgcgtttacacttagcctattggtgtggctataaatcttatttattttagttgtgctctatttcttattgatctttacaatgtgttctctaaagtaataaagtgaatgcaaatatacgtggtcacaggtttattctgagttttaatttattatacaaaagtaaaggttttaatttaatattaatagtagaaaaacactttcttacgtgtgccatatggaaagataaaggatctattctaaaattagctgtgttggttgataagctggtgtggattctgccacatccagcaaggaagataccattaaattacacagtttagctctctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatgcttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagcgtgctagacttctgctttgagtcagttagttctgcttttacttttctgattccttctttaaaaaaaaaaaaaaattaaggatcattcttacagaaactacccaccctctaacctgtcaccaatctttacagaagaaatgtggccttgagcttcttgcttcatgtatgaaataaatgcaaatttttttggtggaaagaggggaagtttggtagcaaccaaaagaaactgaacttcaaatagaaattcaaggtgttctttttttttcttgggtgttcatcttgaagcttagaataaagctggtacttagaaatacatttgtaagtgtatttgtgaacgcaattttactgtggtggttgtctcttttcatttatatttccctggactgactgtgtctttctgaaggcaaaggcataccagttttctcaacctaaaaatctgaagaaaaaaaaaaaaaaacagcaaatttcctctgagtagacttaaaagttcaacaaaagttgctgggttttcttttaaagcatcatttatacctagcattttttctgattttgacataattgtaaaaaaaaatgtgtaataaaatagaaatagagcatcaggatcttgatgatttgggatgaagtggcaggttataagcatctcaacagataattgaaaatgttgaatttccgctttggccctgagcttgctggaaactagtacaaaaaggagacaagttatattatacattttttaaatctaccaaatgattgatttaaatagaaatggcatatcttagaatttaacagttccatgtactgctaacccagcaggaaagatttataatcattattaaggtatcttataataatataccagtttgtcttgagctacttttgaaaggagtattttattgttagcatttatttgaatgaactaaaagcaaaactatattgttctcctgagatttactaaatgaaattgcctggttaagaaccctacgtatgctatagaaattcttctcaaatgtacttaggagtccttttatttaaaaaaaaaaaaaaaaggcagattcttacctagctagtataggtagggcctgaaagtctttgtttccaaaccaactcctaagcaacatggatgccactgctagtcaggcttttgaacatcaaggttttataagaaatggttgttatatgtcattggctgacatttgtatactattaaaatacagaaattgaaaataagaaatgtgatacgttgagttatgcaaacaaaagtagcatgtaataaacaatgctaactggagactatatttcatattaatagtagggaggaaaaactattaaatattccaggattaagattactttttagattatgacctttagtagacaattaaaggcccaagtcactggcttttgtataatagtgttcagctttaatttttaagtttagtgacataaatctttggatatttcatgattcttccacaaaaagaaatacttgaaattggattagcaagtaatttccatctttttatactagactggacttctgtattagatgctagaatgatttaaagtagattattcttttcacattagttcattaacagtgtagtatacatcatagtattggtacacattttaacagtgcttaccacggaacagataataggcctgctgttgattgtcttcagccagatgtactgcagtgcccaaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttagattatatgggacagaaaatgctttcgtgtggtgtagtgtgtgtatacacacacacacacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctcaaaaaaaaaaaaaaaaaaaaaaaaaaaaaaaaaaagaactggatatggcagcacatatctgtaatcccagctactaggtaggttgaggtaggaggatcactggtggagcccaggagttcaaatccagcctgggtaacatagcaagactccatctcttaaaaattaattaaattaatgaaataaaaagaactttattttttctttaaaggaggctgcctgtgacagtcttcttgtttctgttcatgatagcaacattctaatatcagaggcttagtatacaacacatcattttaatttaagtcctctcagtcctgatcagactttgaatcatgttggtccttccttcatattgttggatcagtttctttttccctgtttttactgtcaacagtactattttagatccttatcaggtcatacctagactctacagtgccttttcggtagccctgaatccttcttatatcttgtatacatcactgtctttggtcataccaccctttctttaagggaaaataaaaccggttgaacagttccctaatacatacaacaatgattcagaaatgtttgtgtacataaacatcagatgagaagattgtttaaaaattataaaagcaggacatggtggctcacacctgtaatctcagcactttgggaggctgaggcgggaggattacttgagccacagaaattcgagaccagcctgggcagcatggcaaaatcctgtctctacaaaaaatacaaaaaaacaaaaacaaaaaactagccgggcatggtggcgcttatctgtagtcccagctactcaggaggctgaggtgggaggatcacctgagcctggggaggtcaaggctacagtgagctgtgaccgtgccactgcagtccagcctgagttaagggaaaaaaaaaaaagataaaaatttccaggccccactacatagatccatatttagtaggtccaggttgggaccaggaaactgcatttttatcaagcaccacagttgattctgacgccagtagtccacagaacatatgctgagaaatggtgagcccctagtagaaaacctaagccctttggttgggcagttatggtctctccacaatttgactattctgtattttcccagctttatctctcaaaacttctctacctgaatcctccattctggctagactagctgtctcttcaacacatctagttacctgtttcttttcctttttgcctttctccataaggcctgcccagtcctcttgctgagtctgcattcctccttacctgattcagccactgtatcttctatgtagctttcactgactgcccagtttgtgttaatctctctctctctctcctttgtcttaataacagtattttctctgcatttcctttgataagtgattactttctacctcatatcttctatcttgaaatatttgtgttgttttaaaatcatttgacttgtcatatttttatcttattttctcccaacaagattaaaaattctgaggtgaagttttttattgatacatgataatttgtacatattaatggagtatgtgtgatttttttggttttttttgtttttgtttttgttggaatctcgctctatcgcccaggctggagtgcagtggcacaatctcagctcactgcaaactcccctcccaggttcaagcaattctcctgcctcagcctcccaagtagctggggctacaggcacgtgccaccacgcccagctaatttttgtatttttagtagagacagggtttcaccctgttggccaggctagtcttgacctcctgacctcaggtgatctgcccgtcttggcctcccaaagtgctgggattgcaggcgtgagccaccatgccctgcctgtatgtgtgatattttgatacatgcatataatgtgtaatgattaaatcagggtgattaggatatccattgcctcaaagaaaagaaattgtttcgtctagctgttttgaaatatacaatgttattattaactagtcaccttactatgaatagtagaacttgttccttctatctaattctaacaatacatatattatttattttattattatttttttaagacagtctcactgttgcccaggctgaagtgcagtggtacaatctcagctcgctgcagcctctgcctcccaggtccaagtgattctcgtgcctcagcctcccaagtagctgggattacagacatgtaccaccatgcctggctgatttttgtatttttagtagagacagcgttttgccatgttggccaggctggtctcgaactcctggccttatgtaacccacctgcctcagcctcccagagtgctgggaatacaggcgtgagccactgtgcccagccctgattatatttttatatccattaaccaacctctgaggtaaagatttattttaacttacttagtagtattatcaccagaatcatcacatatggaaaactttgggcctaagttaacatagattgttttgatttgaaactttggtaccattacttcagggctttttcatggtcctcactgtggctgctcccatttattagtattcttttggttttaagcaacatatgacctaatatggcttaatcaaaaaatggtatttattggcttatgtaactgagcagtcctgggataaatttgaccccaggagaggctttatctcatacacaaatgatatggccagggttccagtttgtctatttctcagctccttctcttcagtcttttgggaggctcttcttttatatcccaaaatatgagctagcaactcctagggctacgtattcccttgtttataaacaccaggaaagaaatatctcaaatcccaacaatttaagctaaactacctgaactgggcctctttggccctggttgtcctggtttgaataatgtgttcattgctgaatcagtctgtgatcaaggtgggataaatggattggctaaaaccatctcactccagagctccagatgggtcattcctaccagactattcgcctaaggagtttggtgggccctgcaggcaaccaactaattcccactgttttcttcctttcttgactcatgggcaaattttttattgttgtcgtggctcaaaatttttgaattggagatttgtctcttctcttagccttatttctcagtgtccaaaaaacaactgatttaaaaaatgaatccagactttgaagaattgttttatattattctctctagaaaatgaatcataaaataaaattgattagtggcatctgtatatttattttaaacactgctaataatctttgtcttttttgtcattttccttaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagtaagttccagtctgtgttttgtaaacgattcattgcttttcttgactaactagactatatcctggcctccctaggtgtcctacccctatagtggtgtataaaatgtcacgtaaggctgtcgcggtggctcacgcctgtaatccaagcactttgggatgtcaaggtgggcagatcacgtgaggtcaggagttcaagaccagcctggccaacacggtgaaaccccgtctctactaaaaatacaaacattagccgggtatggtggtgggcacctgtaatctcagctacttggaggctgaggcaggagaatcgcttgaacccgggaggtggaggttgcagtgagccgagattgcgccactgcactccagcctgggcaacagagggacgctctgtctcaaaaaataaaaggttatgtaaatctagatgtaggaagaccaacatttgtgtcatcatggaggtcctgtggaggatatgagacgtatacattttattctagcttaggctggaagtagaagagtgttttggagagggcaatttgttatgtcattcaaattgtaggaatgtgtggagagtagaaattacctaatgagagttctgattattacatgcttttttcagagtgaggaacatgaaccttcaggataaaatcagtacttttctataagattgtttgttttgttttgttttgttttttgatatggagtctcactctgttgcctaggctggagtgcagtggcgtgatctcagagtgcagtggcgtgatctcagagtgcagtggcatgatcttggctcactgcaacctctgcctcccaggttcaagcgattctgctgcctcagcctccccagtagctgggattataggcgcccaccgccacggcaggctagtttttgtaggtttagtagagacaaggttgttggccaggctgatcacgaactcctgacctcaagtgatctgcccacctcggcctcccaaagtgctgggattacagggatgagccactgcacccggccttctataagattcttgacctttttaaaaaggaaaattaaaaaatttttaaatgttttttgtttcttttgagaacatttatcataataattactgaaccatttgaatatacaatggtgggaactcttccttaaatggcatagtgttttgtttggttggttggtttctggagccttttagaattttatgtaaaagagtttaattcttctccacttcaccccgtcaccaccactttccaggttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtaggttttttaaaattctcttcagtttgatttggggtttgttgcttttaaaatgagaccatttaatgaattttaaaacagcctctaccttaatattgtaaattggaaggtatgcagtgttggttaaccactgtgacctcatcaagttgtggggtattcacatgaactgtggaattccaaacagggtgattcacactaaaccaatatatgtcctttctccatcatgtaaaacaacacgacatagcagatttttttttccaaagtatcctaaattaagtttttcttcctctaagtcctctaatttttttccattttcagaagtatatcactatttagtttaaaagtcaagtcagattattgctttacaaaagaaggcctaatgttcaataacttggtaacattattgcatactttccacctacatcactcttaacaaaattctcaaaataaatcttaagacaaataagtcatctgagcagagtgtaattggttccatttaggcttaataacttgaatatgcatgtggaaagagcatggctgtggagtgagtagatgtggtttgaacagatatgccactttctagctatgtactttgagcaagatactgaagttttcagatatctagtttccttatttgtgaaataaaggtaattgcctttcttatatacccacaaaagcttaaaaaatagtatgtgtagtagtatagtatagcaaactagcaaatagtttatacttagtaagtagtattttcttatcttttccctccctgccagcatctccttgcaccctttctcccttttctcccctctccttaccaagttaggataattctttgtctcaagtaccctgagactttgaagatttttcagatgtaaattcttaacttctgaaaattttccctgaggataacatagcccaggttttatagtgggccttttaggattccaaattctcctttacttaaagggaaaaagaagaaaatcaagatatgtttacttggatgggcttcagaaattgtacataagattttgtgtatgctttgcttcctttatctcataggtgtctgtgacacctgtcctgggttgaggaagtccaattctttataagtgttgaaatacacaggataaaagttttgtcaaaattgtataacttagaattcctgggaattagtaaaagatacaagctgagcactggcactgtagtcccagctactcgggaggctgaggcgggaggacagcttgagctcaggagttcaaggctgcagtgtgctataatcatgtctgtgaatagccaatgcacaccagcctggggaacatagtgagactctgactaaaagttttttaaaaaagaaaaaagatatgtaaacagaaataataacactaattttcacattttaggaaaatggagctataagcctgcctttaatttctaattcaaagatcttcattgaaaaatacaaccttttaacaattattagcctgggtaaacctgtattcttctctagtgacctaaagcaatctctgacagcttctgctttttgctgaagcatgtcatcccagagaaaaagcctttaggcagacttaaattccagtggctttttttccctatatggttgttgcatcaatatagtagcatgataaacattcagaggtaaggaaaacctgacagttactgaacaaactatttcctttactggacaggggagaaaattaaaatttttaaattgagtctgagtcttttaggctgtctcctaaattgcttaaatatattttcagacatttgtaagtgatgtttggtctcaatgaaacctggatattatagtttttttccatattggtggttatatatgatgtaatgaggtcatagagggaaaaatgggaggacttaattataagttaattttgtttttaaccttcagtttgtagggtaacttttaggacacccagaaagaagttcagcagatcctgattaaagattttcacattctaatttgatgaagggaagggccatctgatatctgtccctatgatccccattataactggatctagtgggaaagagaaccagaatttgagttttggctttgctaaaaatgtatggtgtgccttattctgacttaatttctattgatccacattaggaccataagtcctctcatattttatgtctcagtgagatgtattttaggaaagcctataccccgcccctctgtcataggagcctcacagtgctcttatggttatatcaagtgtgtccctttttataaaatccctaaatgattaaggggtattttggttttactgtagaattataacatcttatttctaactgatcataaaatttaaaaatagttgatcatactttgtaacagaatcacaaattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccagaggtcagggctatagtgagctatcatcgtaccactgcactccagcctggatgatagagtgagacccttctctattaaaaaaaaaaaaaaaaaaaaaaaaaaaaaaaaaaagttgtatataaaagcttggaaccattttaaaaagaagaggaacaagtgaatatttaattgctttctagatgagtaaggacatatgaagtaaaaaagtgataggatgaaacaaaggaaatagcgaacagatttgactacataaaacttcaaaacatagctactcaaaaataaacacaagtgaagataattaaaaactaggaaatacacttggagcaaatatgagaaatgattaatatccttaatcggccagacgcggtggctcacgcctgtaatcccagcactttgggaggctgaggtgggtggatcacaaggtaaggagttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatggttttttttttttttttattatactctaagttttagggtacatgtgcacattgtgcaggttagttacatatgtatacatgtgccatgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaaaaggttctagagatggatggtggtgatggctgcacaatgatttgaatgtactcagtgccactgaactgtgcccttcaaaatgggtaaagccacggaactgtacatttaaaaatagttaaaatggtaaattttgtgttgtgtatattttaccacaattttaaaaactctttgagactttaggtaaagtgtatagataaatttttgtacaatttttgtcttataaatgtgaagctttttcaagtaagtttaaaagaagtttgcagaatttgtaatgttgaataaataatctcagtataggccaggggtggtggctcacgcctgtaatcccagcactttgggaggccgaggcgggcagatcacgaggtcaggagattgagaccatcctggctaacacagtgaaaccccgtctctactcaaaatatgaaaaaaaatttgccgggcgtggtggtgggcgcctgtagtcccagctactcgggaggctgaggcaggagaatggtgtgaacctgtgaacccgggaggcggaacttgcagtgagccgagatcgctcctctgcactccagcctgggcgacagaggagactccatctcaaaaaaaaaaaaaatgaataatctcagtataatcactgaaaaaaatattcagagcctactgcatgtatagcataatccccgtttttgcgggggagtgggagtgggttatacctgtgtacacacacataaatgtacattaactctacataaatttgaaagcctgaggagagatgagatgatacaccaatgttaatacagttttcattttgtggtgatgctttccttttaccaaactttctatgattaccacatttccttttataatgagaataaaacaactttttaacaagaaaggactaaaatggaggaaaataagacaaaacttttcaaaaattggcttactggcttttaaaattactttcttcaaggactgttctttcttcgcctctacaaaaatatatttgccaagtgtcttttctccaggcctgattctaggtaatagtctttaccttttaccattttttccccgaattctttatgttaaataattgttgatgtgattttcattgaccatcacatgctaatagtgtatttttttccaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcaggtattgagtttgctcaaatatttatctagtatctcctttgtgcacatatttatctggtgccacattgggcaaagcactgcgctagacactagggatagagttgtaaaaaacacagtttcctccttcagaaagcatgtagacactcacccagctcttcatctggttcaaaattgtaaatgtctagtgcatgtctcagagccagagaaaagctagttatttgcacagtctccttcaaggcataattatatatatatatatatatataattatgccttgaaggagactgtgcaaataactagattttatatatatattatatagaactgtagaaatctggtgacatttctagtgctttattctagttctctacattccaaaggtgtcagtagatgtttcttcttattgatgctatttgggacatctgctttcatttatagttctacataagaatgccaatattaaaataggatataatgtaaattttatttttatctgacaagaattaggcatatcatttcttcaaagtaatcatttaaggaaataatgccctcactcaaacactgctgctcctcctccaaataattagaaataaccttggagccagtgttgcagccctagaaaacatcctggtacttaatgtcatttcctatattttatttttttttgagactgagtctcgctctgtcacccaggctggagtgcagtggtacagtctcggctcattgcaacctctgcctcccaggctcaagtgacccttccacctcagcctcccaagtagctgggcctacaggtgcacaccaacacacctggctaatttttgtatttttttttttttttttttttagagatagggttttgccatgttgcccaggctggtcttgaactcctggcctcaagcaatccgcccgcctcagcctccccaagtgctgggattacaagcgtgagccactgcacccagctctgtattttcaaattactattttatattgatgctacattactgtcttagaaaagcatagagatactttgcaagtgactgaagatagtattgatagagatttaaaatttttgaataccaatctcttaatctctgaaggagtcaaatgaatatactcatcctttactggatattttataataaattgtatttactgacaggcctgtaaataaaatctagtatttttgaggcctcaggtaaaatagaattttcatattgattaggctgttccaatgaatattttttaattaaaaattaaattggtagagtgattaaaaacatgttattttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttttatcatcaggaggttttttgttttgtaattacttttaaattaaactgaacttttttgtgctaaaactttgagtcccatgtttttttttttaaaaaaaaaaatcctgcttctttacaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtggtaagttctaggaaaggaatttgtgtttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattactatggagaaattaaagctgggagaagtatacttgatcgtcataagagtttgggtgccaaatgaagattatatttaaaaggagtaaaatgaagtggccactgttttaggatggtctgaccttatcccatttttatatttaagatatctggaaatcatgtttttgtattaataaaatgaaaaagattcgataatggcatggtattaccatccagttctaaagtggtttaattctgtgatttgagtacaaaggtatgccagacttgggagaaataacagagaaataatacctgttatattcctggtttgtctacaagcattctaattttgtattatacaaaatggttctctggtccccatcttctaagtgaaaatgagctcagaagggctaaataacttgcccaaagtcacatacctaataaaagaaccatgattctaatgtgatactatttgactctaaagtccatgtattttccctaatatcacagtgctaagtaaagattgccagtaataaatacttttaattcagagcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagcaaaaaaaaaaaaacaaaaaaaaaacagtactggcctaatactagtagaattacagaataaggataaataatacatgatcatccttacagaatgagcataaacaatacatggtaataatattaatagctaccatgccaggccgtatgctaaacactatacatttatttttaattttcataaccttaaggtaaaggttagcattctctgccccccatttcacacgtgaagaaataatctaaaagtaatcttagttttacttaataatgccacttaatgaaaaatacgtataattcatagtagataaggaagttggagagtctaaaggaaacttttgggtacttaattttactagtttttttattctgtctaatcttactttaaaatataccattagtggccaggagtggtggctcatacctgtagtcccagcactttgggaggccaagacaggtggatcagttgagctcaggagttagagaacagcctgggcaacttgcaaaaccccatctctacaaaaaaggcaaaaattagctaggcatggtggcatgcacctacaatcccagctactcgggaggtgaggtaggaggattgcttgagcctgggaggcagaggttgcagtgagctgagatcacgccactgcactccagcttgggcaacagagcaagaccctgtctccaaaaaaaagtgtgtatacatatattacatacacacatatatatgtaatgtatgtgtatatatatatataaagtgtgtgtgtgtgtgtgtgtgtgtgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacagagtaagactccatctcaaaaaaagaatatttgcaaatggagcattgcaaatggggcatctgcctcggtattttcatcttcaaaacagcccagtagcgggagctaatattgattctagtgccctttggatgctaggcatcagagttaataagcatgttaaaagtcaccgggatgtaaattgacagtcatttattttgtattgtaaataaaagtgatttcatcttccaccatcttcttatttatatgcttgactgtcttgcaccagttaatttgtagtagctaaaatgttctgtggttttctgcagtcaactgaaaataatttctctcaaattgaaaggattacttatcttgtcatactattgaacacaaaattaagtgagcctttaaagaaagctactgtgtgaacctcatcaaccatctcatgattatctttaatagagtccagaggaagtatttatggcaatccggaatcctctggagtggcactgcaagcaaatggatcattttgttggactcaatttcaactctaactttaactttgcattggttggacaccttttaaaaggtaaaaaagccttatttagaatatttttatgaagtactattaagaaaccagaagtaatttgaataagtgattacttgaaataaattgaagtaagttagcccttatgtcttactttaaatgcaaactaggccaggcgtggtggctcacgtctgtaataccaacattttgggaggctgaggcaggaggatcacttgaggctaggagtttgaggccagcctgggcaacatagtgagacttcatctctacagaaaatttaaaaattagccaggcatggtggcacgtgcttgtagtcccagctacttaggaggcatagatggaaggattgcttgagcctgggaagtcgaggctacagtgagccgtgatcacaccactgcactcagccctaggtaacagagtgagactttgtctcaaaaaataaataaataaatgcaaactatatctgtcttaatgagttgtgttttattcaatatgtgttttaagagagcttcatttccaattcaaatatcaaatttgcctgaaaaacaaaagagtttattctggctgggtatggtggctcacacctgtagtcccagcactctgggaggccaaagcagaaggatctcttgagcttaggagttcgagaccagcctgggcaatatggtgaaaccccctttctacaaaaaataaaaacattagccaggtgcggtggcacatgcctatagtgccagctacttgggatgctgaggaaggagaatcacttgagcccaggaggtcaaggctgcagtgggccatgatcgtgccactgcactccagcctgggtgacagagtgagaccctgcctttaaaaaaaaaaaaaaaaaagtgttgattcttacaaaaacctacatactgagtctgataatagctatattaatagtaacaatacctaagtatcttactgattttcaaaatgaaacagactgcaaatcactaagtgttatttgaataatttatattagaaaatgttaagagatttgatcacagattttcttcaacttgtttatagtttattgttgattaatactattattttataccattgtacatcacctttctggcaccctattctcacccctttctatattgcttatagccagtgatctccagctattcctcagagcccgctcattcacttcctaacctggttttactccccgttgctgacttcacagcttgttaactttggttcattaacatggggcagtcatggccagagactgcagttaataagaacagcatgtagtggtgggtcagaagcaaagcaggataaagtaagacctgggataaggagctggcatgaaccccagtggtctcagaagtggatttggccacaatagagattcaagctatagcttgagtcaacaattttgtattaatttaaatcataggcttgagggaccatggagattctcccagtttttatgagagagagagagatatgcatacacccactattgtgaatgtatgcatttgatttcactttcttatgaaatttctacaaaaaatattgacagtgttaatctctaaggtcaatggggatttctcaaaaaatactaccttactaaaggataccaagataagtaattgtaactgggctaataaagtgcttaattattctttatatctaaaagaataccaggctgggtgcagcggctcatgcctgtaatcccaacactttgggaggctgaggcaggtggattgcttgaggccaagagttcaagaccagcctggccaacatggtgaaacccctgcttgaaggcaggagttcaagaccagcctggccaacacggtgaaaccccatctctactaaaaatacaaaaattaggcaggtgaggtggtgcaaacctgtagtttcagccactcaggaggctgaggcacaagaatcgcttgaacctgggaggcagaggttgcagtgagccaagatcctaccactgcactccagcctttgtgacagagtgacactctgtcttaaaagacaagaaaagaaaagaagaccagatactttccatgttcaaatcacctatttttaaatgggggaaggattaatgattaaaagctggccaaagatcaaatttatcctctaatcaaccctatttattgggctcttagagcatatacttcctatgtcatcagcttttcttttaattaaaaatgtttttgtattccgcctgcgactcggtcccggcgctgggctgaggggaggggttgtcttaaaagtctctccttccccctgtaggggcggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaataggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcagtagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctagtcttgagtgactgtgtccacagttcatttttttccggtaggaataactccttttctacatccacactccatagagtctctccttttcagacatcctgggatgaaagaatttggcttttttttttttttttttttttacatctgttttcactcttaggcttttaaacaatagttattgctcttatccctctcagattctaataactgagagcgatggggctatattgaatctctgtatgcactgataactgagctatgaagaggatcttattaaactgctggtctgactctatggattgacactgttcctttcttttattgtgaaaaaaaaaacccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaggaaaattgcacaatttagagtagttatgccatagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaactgatattgtaaaaattaaagtaatcttgaaaatgttttgacaaaagtaaaattaaagggacatcttttcttaaaaaaaaaaatgtttttgtaaaagaaccctattttcaaatgaaatcttaaggagaattataatacatagatttttttttttaatctctgtgctgctttagggaatagaagatctgaaagactatcatgttttttaattttcctcttcctggagtactgtagagttctagggaatattatattctacacatttttggtacttaatcttatacataattaattattctcattcacatatgcatgttttaccttcccaaatggctattcttggaaagtaggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggagactgtaagaagttcatcctgttttaagtcacacttgtgatttgttaaattttttaacctgccaccgttttccttttagctttacttacagtgtctgaagaagttcgaagtcgctgcagcctaaaacatagaaagtcacttcttcttactgatatttcaatggaaaatgttcctatggatacatatcccattcatcatggtgacccttcctataggtaagtggatttactctcctataattacataatcataatcaagtttcaattttccaactaatggaggcaagcagcagagtaatctagaaggtaacatgggagaaatctagagatggcctaggaagagtaagtgaaactcattttataaatgtgtggtattttatgtgggttagtaggaaagttattcttccagtctgattgtgctaatgttaacattagtttgcctctgaagcacagaccaaatgaacaatgaaaagagatgctcttgaaaatattaggttgcaggggaagggcctggggaaaaaaactaacgcgaaatataaacaacacattacgtgcttggatagagaacgaatctatacagatttgtaaaaatacaggcatgctaacacatttgttgtatttactcatatcacacaagttatttaaaagttttctataatgtagacatagatggtaaaaattatatctgctatacatgggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctcccgagtagctgggattacaggcgcgtgccaccatgcccagctaatttttgtatttttgtagagatggggtttcaccatgttgggcaagctggtcttgaactcctgacctcaggtgatccgcctgcctcggcctcccaaagtgttgggattacaggcgtgagccacagcgcccagccaatgtaaacatattttaaaacatcatgttgtacaccaagcttgctcaacccatggcctgcaggccgcacgcagcccaggatggctttgaatgcagcccaacacaaatttgtaaactttcttaaaacattaagtgattttttggggtttttttttttttttaagctcatcaactgtagttagtgttagtgtattttatatgtggcccagtatattcttctaattccagtgtggcccaggaaagctaagagattggacacccctgttgctatacctttttatttgtcagcttttaaaaattgcagtacagatctttttgttcagcatttggtgagtacctactatgtgcaagatactatggcaagaaagttgataattcctagggatacaccaagagtttgtatcctaaagccctttaaagtgcaattttaaaattaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcattataagttgagatagagaaatgagaatgggaccttgaaacagttttttctgaatcttatactaaatattgtgactctccttattttgttttgcctttgctggccagcagggaatgggactctgagacatattagataaatacctataagaaaggaagagtcttgctgcactcaggggatttaatgatatactgtaatacttcccaaaattatcatctgagagaatatatgaatatggtatgaagctgtaatagtactatttgccgtgctttctttgaaaagacaaaaagacatgcttctcaattaccgaaagaaaataggattcttttttttcttttttcttttcttgatatgaagtcttgttctgttcacccaggctggagtgcagtggcgcaatctcagctcactgcaacctctgcctcccgggctcaagcaattctcctgcctcatcctccctagtagctgggtttacaggcacacgtcaccacatctggctaacttttgtatttttagtagagacagagtttcaccatgttggccaggctagtcttgaactcctgacctcaggtgatacaccctcctcggcctcccaaagtgctgagattacaggcatgagccaccatgcccggccggaagataggattcttgaaattaagattgctcagttacatcaacatttatagaatttttgtctctgagaagtacacctgaaatgctgcgagactcatttccattttagtaactgaaagtaaatgaatgaaaaaacccactaggccaggtgcagtggctcacgcccataatcccagcactttgagggactcaggtgggaggattgctcgagtccaggagttcaagaccagcctgggcaacatgacaaaacccatctctacaaaaaatacaaaacttagctgggcatggtgacgagcacctctagtcccagctacttgggaagatcacttgagcccaggaggtgggggtagcagtaagccaagattgcaccactgcactccagcctgggtgacagagtgggaccccgactccaaacaaacaaacaaacaaaaacactgatcttacatcgctcctcagaggaaatgcagagatgttcttgcattccattgggtaaaattgtaattgttactggaatacattaggatctgtatttcagtagccagcactgaatggttcaacagatttcagttatccatgcaaacatatttaagtatctttaggtattggaaaaatgtttgtgttcataaggaaattagtgaacaaacaacaaattgtaacataaataacgtgccagtaaaccgtgaaagaaatagaaaccatgaatgtgtcaatcacagttactagccacataggtgtgttactgttgtttgagttcccttctgttagtaccttgccataaataatcatttaggagtttcctggttactttgtgttttgtaattctggattttcatgccaatgaagttgtaaatgaaaaactaacctcagaaaaaaatatattgaattcattcaacccatgtactaagtgaaaaagataaggtaactgccctggaagactttgtaatttgtgtccaagacttataatcagccaatcacaacagcaactccaggtgccattaaaatgatatgtcttgatggagaaagctggagatctggggaaattagaagaaaaaaaactgcagagaggagataacatttgggctgtgtcataaagatttaatatatgcttgcaaaatagcaggataagtaggggcatatgtttaagagcagtggggaatagcaagaataaagaaaaggcaggaaagcaactgatgatacatcatggcatcatggggaatggggtaggaaatgagatgagaagaaggactagaactcgattggaaacgactgtatgccatggtaagatatttacccttatcacacattcagctgaggtatttaagtaggagaagaacatgaccaaattttaatttttgccaagtttttctagcagcaatgtggagagacaggaagagatttttagcaagggaaccatttaataaaattgatatagcagtccaagcaaaaaaaatggtgtgggccccgcactaatgcaggagcaatgggagaatggagaagaaccagcaggtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataaaaaggacaagtgagaaaggaaggaaaactaaatgtagaaagtagtgtcccaatctcatgtactttggaaagcactgactggttttagaaaacctgagttttccatctggtcattgtctagatccctagccatgctacctcagactaattacttaactgctcatggcttcatcagtgtacatgtgcatgaaacgaagaagccggactagatccctttggactgttaaattatttggccttggtatttatgactattatgaatagttattcatattcttgaggtaatagactttgtatttctcaagtgttaaattgtcagattttattatattggctttaattctggctttaataaaataatactgttggccgggcatggtggctcatgcctgtaatcccagcactctggggagaccaaggcaggtggattgcttgagcccaggagttcgagaccagcctgggcaacatggagaaaccctgtctctactaaaaatagaaaaatcagctgggtgtggtagtgtgtgcctgtagtcccagctactggggaggctgatgtgggaggatcacctgagcccaggatgtggaggttgcagtgagctgaaatcatatcactgcactccagcctgggccacagagcgagaccctatcaaaagaaaaaaatagtgttaatacatgattacatgattagagaaactaaaagccaaatgggagataatgctacttgctatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttcccctttttgagtcccccaccctcaaatttttattccagtctacttttaggaggcccttaaatattaaaaacatgaataggatacagtcttctacttctcacccaaacagataacaattcagccacaaagtaaaaatgttgtgtgtttacttttttgcatcttggcaggctacactggtaaaatataccacagatgagtttgatcaacgaattctttatgaatacttagcagaggccagtgttgtgtttcccaaagtctttcctgttgtgtaagtatctccttttgattttaattcaccttcgtgcctgtctttaagttaaatgcttacccagtaatgtgcactggttgcaaagagggcaaaatgagatattgtgatagtgattttagctttgagacagtaggtttaatgagggttaagattagttttgacctactagatctattagaaagtttataaggaaagacttttaaaaaatctggttgatttatttaagtggtttattttgatgatcattgctcattttcctcacttagaagcaaactattagactgctatatctaaatcagcatatctgttttggtttactttttagtagagcttttgtatttatccacagctgagtgaaaacaaaattgaccttctgtttaggaggtgaattgtttactctctcttaaggactaaaaaatattaacctcaaagtgttcaaatttaaatagttcaaataaattcttttcctgatctaggccttctatatcatgtcattattttctttttttaatctcatgttagaattttagagagttagaactcagttatttttattaatggagtgtagccgggttagaaataatttttttcctaagtttcagttggatcatgtatttcactccctctaaactattttgctttccctatttgatctgactcagcattttaaaagcactgattaacattaaatttaatttttttctttttgttttgcacagatcctaaatttagttttaacttcctaagcgcatgtcagtatacaacagatggaaatagtactaaaacatgctaagtagcagacagagccaaccttgtcttaagcaaacatttaccgtatatggttacacatggttatatgacactaccagttgtttgttttcacaatttcttccctggtgactaaaaacaaaagacaaacaaaaacagacacacacacatgttcattgtagaaaatttggaaaatgaagaaatgccccagaaagtaaaaagcactcatctccctttaattttggcacattattctggggaatgtatattatgttttccactacatattttcatttaattttcctctaaaatgttcctctgttgactttttttttcttttaggcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaaggatggttgatgaacttgctaacatgcgcgctgttgtagaatgcactgactacagaattctttataagggatagacttgttcatacttttatttccatattccatttttttactctctcaactgtatgtccaatgtaactggttgacaactttttatgctgagtatattttaagtaggttttagttgctttgacactcattctaaaaacatgttttcaacatgtacatagggtttatatatcatcagctatatgacttatttaatttctgttacaattaaaagataccttgcttgttataagagtaaaatttgatttgttgcaggttttggttttaatggcttgtggcggtttgcaggaccgttttcaaaggtaagaaaatatatttttctctaacttttggcaaaatgaaggtttctgttcaaattagtatgcctgctttaagaacacacaatgtgctgaaaaccagaaaaataattcacaataaacacatatgttacttttataaaaagtttctcatcacaaggtttttttccaggaggcagcatggtgttggggtgtgtgtattcacttttacaaacaaagtcaacttatgatcaatttttcagaagagtatgataaacctctgtgatacttttctgccacagtcccttgtgtatttgataatcttaatgcacacagttagatatcttatgactagcaaggagcattaccatggttaaaatctatttcatgaaaacatttttatttccagcctattagattagattaatttctctctggatttgtcctcatttgctcttattcagtttttttgtttgtttgtttgttttgtgagacggagtctcactctgtctccaggctggagtgcagtggcgcaatcttggctcactgcaacctctgcctcccaggttcaagcgattctcctgcctcagtctcccgagtagctgagactacaggcatgcagcaccacgcccagctaatttttgtatttttagtagaaacagggtttcaccatgttggccaggatggtcttgatctcttgacctcgtgatctgcccacctcggcctcccaaagtgctgggattacaggcatgagccaccgcacctggcctcagtttgttttttgattggcattagtttatgtagtgctacataagatgtatatgatcattttctctgtatgtgggctctctccaaattgatcaaagttccttgaagacagggtttctgtttcttccttaaacagttcctggtgcagtgttttagatacagggggtgctaaatcaatatgaattgtataaaccttgttccagtttttaagaattgggtattttatttatttcctttcactattacttgaatatctgtcaacatgcaaaggttgtcacttaaaaaatgggcctgaagttacagaaataagtatatcatacagaagtttttgcatttggattgccagtaaccctctgagccctttacagtgtctagtgagtggaatctaaatggcagctggaatgatgatgctctgctcattttctctgttttggaaaattggctagacatcattcctggtgattgtattgtctcagtattacattcagtctgtcttgtgcatggctttcagaaaatgcaggttcatctggaagctttaagctgaatagaactccctgttgtaagtcctatggtagtctataaatattactccactccccttttttaatgataagtaatacaaaggaagaaaaatagtaaattaagtccaaacaaaattaatatttttggcttcagatggggatttacttaaaaaaaaggaactaaaataatttcctattttccattacagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaaaaaaaaaaaaaaaaaaagaagaagaagaagaaacacaaaatctattaggtacctcactttcctgctgccagcaataactcaaccatccatagaccatcctgaaaatctggaagtaaataaataatcaaacaaaaaattcatctcaagaaaataacatcttaaagcccataagcatatatataccaattcgtaatgcaacttagatttgaatacactgagaaatactaatagctaatagctccagtgggactgagataaacaaggtgggagaaatggcaaacctacagaactctggacttattcagtgtcatagtgaatggtttcatacaactctggttgaccctggaggtgctattcattatagaacttaaactattgtgtgtgttattatgacagtgagtaatgaaggaaagcttttgttatggttgtgttttctatttagaaagatattcttctaaaatggttaaaaataaaagaaactttagttgtttaacgttccattatctgaaaagttcacttatgaaacacatcattgtataaggaaaagttactatatatagttcttttaagtgttagcataaatttaaaaaaaatccaatgacataactattctgtgatattcaagatcaataaatagaattcccagtttatgatctcagttttgcatgaacatttcaacttatgtaattttgaaggttctgaagaatttggcaatacccaattcatattataaactattatgtaattaactatattctattaaattctgcttaacaacaaagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatcccagaccagcagcatcatttgggagcttgttagaaatgcagatgctgtagtttcacctcagatctgcacaaaaaactcccaagtagagcccagccagcagtcagtgtgttaataaataccccaggcgattcttacacacactagaattggagaagcactgccctggggtctgcttctggtcttgcccattatcagcatttcagctgtgaaggccagggcaaaacttaaaatttactttttttacagatactgcagccactgaattccttcctgcttccccgctgataaaccttttagcattttggagctagggaaccatacaggtaatttagttttaggctcacaatattgtgtacattggggagactgagttttagaagagctgggttaactgctttatacagttcttatctagaaccaaggccaggcccttttgtactacattcattgccttccatggctgttgtctgtttgattatctatctactttcccttctccttctttatttccttgtttttgtttgtttattgctaattcattacttctgtctgccttgccttaagcccaccagttcttttttttctgttggactattttctgggttactgaacagaagttgaaaagtttttaaaagtctgcttcatcttaaccaagcttttgccttttgggctactaaactggtgttaaacatgtcaaaaatggttagtttttttattgactttttttacccagtctaattgtagggaaatttctgcctatctttgcccactaatggagacaataaaataatctggatgagaataaagaaccattacaggtttctctgctatttgattagttgcatatgtccagtgttgattggctatttgccaaatcatttgctttggtgaaacagtcttactctacaaccttttacttaaaattgtttattaaaatcagaataggttttatggctttggttccagtttcaaactaatggtgtcacctccattagctctccaaagttggtgcctttattcaggctggaaatctctgactatacacagaagagatgaggaggtttaaaagtaatagagttaagtggtattgtggtgttcaactcttcctgtcactcaattgtgtgtcattggtttgacagtttattttactacatgttttcagagaaagggtttatcttttcaaaagtaaccttactctcccacaaaacccatttgtatctctaaattacaggctcatgttcacaaaaggatcccaatttatatgcccaatcactgagtttttgtcatttgctcttacagaataactcttaatggtaagagttgatcttttgtttataattaggtatattgcttcatatctttagctccatgtaatcttatatccttatctctctctttttttttttttttttttgagacagagtctcgctctgtcgccgaggctggagtcagtggtgcgatctcgactcactgcaacctctgcctcccaggttcatgccattcttctgcctcagcctcccgagtagctgggactacaggcgcccaccaccacacctggctaattttttgtatttttagtagagatggggttttatggtgttagccaggatgatctcgatctcctgacctcgtgatccacccacttcagcctcccaaagtgctgggattacaggcgtgagccactgcgcccagcattttttttttttttccccctttggagacagtgtctcgctcagtagcccaggctggagtgcagtggcgcagtcttggctcactgcaacctctgcctccttggttcaagctattcccctgcctcagcctccctagtagctggaattacaagtgcacaccaccacgcctggctaattattgtatttttagtagaaacccggtttccccatgttgaccaggctggtctcgaactcctgaccttaggtgatccacccatctcagcctcccaaagtgctgggattacaggcttgagccacggcgctcagccatctcatttctttatggcgttgagtttgcttatatcaaaaaaccaaaagaaagttgtccagattcctaactcagtctggcgtttcaactttgctgtttagctgtatagaaaccaaaacatttccttatctccattcccagcagccaagtctcaagcagtagtattgaaagaagttctctgtcattccccgatatggagcataagtttgatttaccatcaaattacccaacatcaacctatacttagtcaactgagatttaaacagataaaggttccattgccctatttcaaaaagcaaatgttgctgatctgcacgcattcaatcctttgctataaatgtttcatgtcaatgcaaaactcttcattctagatctttgatgtttagcaggatcagctactgagctgtattttcttttgtccaacattttctactagcaaatcaacaaaataagagattcatgaacctctcctcctccccctcctgccccagcattaggtcttacttaaattaaacatttgggcagtatttcgttagttaccagctttgaggagaagtggtagtcacttacataaagcaattgtctctgaaaatgcattcttcttgacaaattagcatagcctaattctccatcctaagggggactgttttacaagtctacatataaaagtacctaaatggttgtcttctgaatccctccctagtagaaattgaatttggcatcagtggagccagtgactgtacctgggattcagtgcatatagaattgcattgactgtgaccctttaggcaaatggatgtaagactttggctcttaggattttcccaaacaccaataagagcatcttgaagagaatccatttactttatgatatataaggatatttcaggtttgatattatgatccttattaggtccagtctagctgagctggacatgaattgaagaaccagaattagaactagaaaatgaaacccaggctgagtgcggtggctcacgcctgtaatcctaacacttttgggaggccgaggcaggtggattgcttgagaccagcctgggcaacatgacgaaatcccatctctacaaaaatagaaaaattagccaggcgtagtggcatgcatttgtagtcccagctacttgggaggctggggtgggagaatcacctgagccggagaggtcaaggctgtggtgagctgtgatcatgccactgcactccagtcagggattgagaacctatctcaaaaaaaaaaaaaaaaaaagaaggaaagaaagaaaatgaattaataggatccatttccaaagcattaaaatttaatatatactttatcagggtcttctgatattcttcagaggagaattgttgtaagttaattcaataaacatttgaatacctgttttgtaggtgtatgttaagtatgtattagaatccttgatcaccagagacttgacggtttttgccttgaaagttatttccttccgatccatgttgtttaacaaattctaagtgtgcactattttttttattttaaatacaagattaatactatagtgcactgtagaaaataccaaaattccagatatttatcctacatatatgtattgtttactatatgcaaggggctcttagaccccaggggagcagaggggctgccagggcatgatacctgccttcaatatatttcagatcagaacgggcagtagaatgtacatagataactattttgacctctattgtgatacctgtcatgttgtaccttgtactatatagtattctgatagttcaaagggacatttgtgtggaaggatcatgtaataattatggcaaaagttttataacacatttttcacctcaaaaatgtttttaaacaaaacaagtaaattcgtgatctatttaatttttttttttttttttttgagatggagtcttgctctgtcacccaggctggagtgcagtggcacgatctcagctcactgcaacctccgcctcccaggttcaagcaattctcctgcttcaccctgctgagtagctggcactacaggcacccactaccatgcctggctaatttttgtatttttagtggagacagggtttcaccatattggccatgctggtctcgaactcctgaccttgtgatcctcccacctccacctcccaaagtgctgggaattacaggcatgagccaccgcacctggcctaaaatttttttttactaggaaaaaggctttaacttttttttgtttgatcagctcattttactgttagtattggtgcgtgaattttttagaacaaagacatacttagttcatcgttactttagactcccttcttccatttttatttctggccttggtccaagcctaccagtcattctctcactttgcttctgtaatgtagaccttcttcctgagaagctggctagatcaggtagtgatcataacattcctaaaccaatagtgctgatagctctgtgtacggagggatatttcatctaaaccattgctctaaacttagacttggctctgagtcagtaatacttctgtttactaggtttgaaatatctccctcttagctgggcacagtggcacatgcttgtggtcccagctactagggaggctgaggtgggaggattgcttgagcccaagagttcaagtctggcctgggcaacatcatgagaccctcgtcttttaaaagaaggaaaagaaatatctcccttttagaagaaacctagaagtctctattttgaggccacttaagatctctgaaatgattttaatgttttagagaattgtttatggtattacctgacctttttttcttgatttgttttctttttctttgttattatcctatgtttaagggagaaaaataattttaaattgagcgatttcttggtataattcttgctaatttttaaatctaatttttagcttaattcttaatttaaactaaaattcttaattttaatataagtggtaaaaaaatacatctacaaagttgtaagttctctcatttatttaccaactgtaatatttaggaaattaatggtcagaattcaataattaaaaccagattccttctgaaaaccaaggaacattataattatctagtatctaattgtatttcacccttttttaaatcttatgaacatcacttacttgcttttttttcttccattctttgtaaagcttctctgccttgctctaaatcagcagttttcatgcagctgttccctcatcaaggtactctttattttcatcatctttgcacgaaaatactgcttaccccacactcatcctgggcacatagcatgagactttactcaccggtccctgtaagctcagtctgccttaggcactttaggaacttgtaaagccaccactttataaggtcttggtacttaacaggaattgcacggccagtgtgtggcctgtcttgtttaaggagctgctaatacccacccagaacaatgaagatgcaatcccatacctggactaacaaaggcaggttaataagaaactcaagagagagttaatagagaaagagcagaatacgtggtttgatgaagtttttttagcttagaaaataacttgttttccccaaatagaaagccaaccccagtgtttcctcagaaattaaagctggctgtctattcaatcacctgtggttaaaaaaaggaatatggccaggtgcgatggctcacgcctataatcacagcactttgggaggccaaggtgggcggatcacttgagtccaggagttgaaaaccagcctgggtaacgtggcaaaaccctctttctacaaaaaatacaaaaagctattcacaggactgaggtggggaggttgaggctttggtgagctgagatcgcaccaccgcactccagcctgagtgacagagcaatactctgtctcacaaaaaaattaaaaaaaaaaaatatatggtcattagttagctataaggactaagatgaaaaaatttgacacatttatgtctaatttataaaagatgccttttcttttattcacctgtaattaatatacaaaaagattacacctaaacagaaaaagaagtgctagcagttggtgaacgtcatttttaaaaattcttttttctttttgagacggagtctctctctgttgcccaggctggagtacagtggtgtgatctcagcttactgcaacctccgcctccccagttcaagcgattctcctgcctcagcctcctgagtagctggaattacaggcatgttccaccaagcctggctaattttttttgtattttcagtagagacgaggtttcaccattttggccaggctggtctcgaactcctgacctcaaagatctgcctgccttggcctcccaaaatgttaggattacaggcatgagccacaataccaagccaaaaattcttatagttacaattttttatatttagctcaaaataaaaatatttctaagtatatatttaatacgcctccatgaatgtatttactgtagcttaaaaataggctgtagctacctaagaagatttattctattttgtgcttatttatattagcttcactcattttacaaattctagcataaaattaaagtcctagtatttgttctaaaactcctttgtatcacctggtcttttacttcagatattaggagcatcttaatttgtggagtaattattttatctgtgtgcaaaaattcttcacatagattattttgtctaacaaccctttgaaatagacaagtctgctgttatccttaattgccagattaagaattacaactaaataagaatattgatccaaacaagtctcaaacctaggtcttctgacatgtttaagttctcctgtatgtaataagagttttctaataagtttgccatattgtatatgaaataaactaaatgcagagtaaggtaacctactagtgctcctgcacaggtggcaggagatttcagtttttattagtctgtcatttttgtagtataacttctcacaaattacctaacccatttttccttagcttttcaagagttaaaagcgattctgttgttttattatttcatgatactattataactgattatttcagtttgggaaaccaaaagtgttttttaaaaatgagtgactaaaaaattgtcaggctggagctacatcactagttgtaaaaatacacaaaccttgatacctgccttcaaggaactcatgttctagcagggaagatagacatctaacttaaataacaataatgtaatctaatccttttccccagctactcaaattcactgaattttggccaataacaccttctagttaggattttgtctttatctggaaccaccacaatttattgaaacatagtactgctgatatactgctgtacagaatgtccagctgtttctgctctgcatgtttgtaattggctgcatgtttgaccacagcatatctgtggggtcatttaagctggcaaatcaggaccacagaagttttagctttatttcctttgtgtggtagcctctgggtttctgtcagtcactttgtagttttgtctgtttgttgtccaccaaaggccagaaaggagagccaatgctttaggggcaaaagagataccagaatacaaaactttaaaggggttttgatgaaaagaagtgcagcaccaaggccttctcactaacttaaaatatggcatatagcaatacaggatgtgttctgtctgcattggagtggtctatcagataatctgagagtttttcctatgggatattgaggtgaaatccttcaccagttcctagagagatttctagatttaattttagaggataaaaagaaagaatgctgccaaaattcttagaagtgagaattatgctgagaaacttaaatgccagaactagatactatgatcattctgtttcatactaccttggctttttcaagatatattttggtgtaaacgtaatgcattttaattgtttttttttaatgactttccaagatttttgttagtttctcctttgatccttacagtaaaacatctttgctgtgaagttgaacttaggaatcacagtcacaccacatttacctatgtgtgatttatacagttgggtcactaagtaggaagaaaacatacattccaaaaacaagaatttagatgaaaaatgaatttgagaaaagaagtagaatatcaacttttgacatagtgttgaagcttttggttatgagggatggggctgacaagtcactcgtacttttacatttttaattaatgtgctcattaggaaaaaaattggaaaattcagaaaaataaaaggaaaaagttacccacaatcctatcattctaagatagataaccactgtttattaacattttggtgcatttccttccagtttcttttttttatatacttgaggtcatagtatgtgaacaactttatagcttgttttgtaccctcaacatttaacaggagataaataaggcctttaaaattatttgaggtttgacggttatttgcttcacaaaacagaaagtggaatgttcttagcacttttttgaagataccttcaccctagtgacttcatctacattactacaatttatgtaattgtaattctcaggaataacactgtgcccaaacagaagcattgccacccatgtcatgactgttttcccctcagagtaggccatggtctagtagtagcaagacacacaagaacgagccccagggtagcagattgctggcagagagtcacagggccttcctagtggtcatccatgcttcatgcccctcctgcatgcgggccagctccaagttgtttcaaacctttgtctttttaaggtcctagttttgcctgaatcttattttctattaaagaaacaactcagaattactggacttgaaacttgtaggccaaatgcaaatttgaggaaatggaaggtcaaatacgctgacaaattcataattttaagtggaggatgccaaagggaaaaaaaaaagttctatcttttcaactaaaaatattataccactctctggagatcagggattgcatgctttggggctctgaattacaggtatctagctatcacattttaaaatggaagtgttcagttcattcagtattaattgaaaataatttttcaatgtattgaaaaaataactagattttacaggaaaacaaaaatgaataataatgatctttacccttctcagtgcctttactcagtagaggaagatggatgtacaagttgtagaatcataggcaagttaatttaaaagcaaggaaggagaaagtagttctggcaagagacagaataatgcatcatgaaggaaaaggatatgagaaaaaaaaatatgggttgaattttatcttgtagagatacgcaagacaattaaaagagcctacacaaacatacatcccaaagaagctcaaggcacattccagagatcatgagcagctttctttcagttttgttatttcttttgtaaatagctctggagaggatgcaaataaatatacagaagagaatttaaatagaccagaattctgttacccagagaaaagttccatgaatgtttctagtcatctttctatgcatatgattagattagattagattagaacatgactagccttaaaaaatttaataagggttttaaaaaagatttgaatagaacagattttcagtggtggttcagctatgctcacctcctggagaaatgtcgctgatgtttttccttgcactcatatgcctgatgcagtgcacatgttcataaacagtcactgacaaatgcccatgttcctttgacagcagttcagattttcaagacagcaaatctctgttgagcacgtgtaaaccaggccacgtgcttacagatgcctgatactcttgagtcgaattcagagctgaatccaaatgaaagatgagtggctcctagagggaggtcatcccaagttcatttcctgttcatgagccaacaaataactaactgggtagatctatgtacattttctgtaacataatgaatacttcttgacttgaaatattactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaagaagcaaagattctacagtatgacctttgtgatatattattttctcagtaaatagtttctttgggataggcactgtgattaaaaaaataaaagcatcttgagttttctttgaagtgacaaatttgctggaaagatcagtactttctgctgctggagagtatattctgtttataaacatgaatgaggatgtgaataaggctagaagatgacctctgctggaagtttctggtatgatttggaggaaggagcactagtcttccctggtggctgctagcctttcatttagttcaagcctgccagcctctagcttttccttgcaacttgtcttttcatttttcttgtgctattttctgctatgatagcaaactttgcataacaaaatgtgaagttttccatgtgacattaacttagtaaacattttagcaattgactattaaaatgaaatgtgcataaacaatttgccaggttgtatcttatcacaaatatagtcatgtgctgcataacaacattgcagtcaacaacagaacacatatagacagtggtcccgaaagattataatactgtatttttactgtaccttttctgtgttagatatacaaatagttagcattgtgttacaactacataaagtacacaatatggtaacctgctgtacaggtttgttgcctgggagaaacaggctataccatatagccttggtgtgtagtaggctatgctatctaagttcatgtaagtacactccacaatatttgcacagacaaaatcgcctaatgattgtttcctagaatgtgtccccgttgttaagcgacacatgactgcaatgaaattcagtcctggaaggaaaagaagaagtaactggctgttctctttttctccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaagatatgaggagttatttaatttcttcagatgtatcgagctctgttttcttccccccgagtcctcccaatcttttgaaacattaaggccattttccttaaggatgtttttggctctcctactccccgtgagaaagatctttccatttccagaacttctccacactaaaagtgaaatatttttgtgaaatgcttttttagggcctgccaaactcaggtgagtctgttctctgggataagctggcttctcttaaaatgaagccagtcagaaatgtcagggcatcccaagattgaccagtcagagggcagttctctccaacttttcagctttcccgctatagaatcttctgtgacactacacgtgtatacaatgtaaaccacctcccctggctcagctgccccgtgttactattttacttacttgattatgtgggttgcctcccccaatcagtggagaaagaacacagcccagacccagtggacaggacagagctatcctcagaagggtaacagtgtctgatattgaacaaaggactaaaaaagaccaggtgatagatacctgcaggtctgaggcaagtacttgtctgtttatgggcaggcctggaaagcaggggtacctcacctggagagcttgctaatacactggtccccatcctaatcccccaaggtaaaggcaaactctccaaggatgggctgttgggagaaagagtgtgtgtttaaacttcttaagcgattttacggagcactcagtggtttaaagaccattggagtagagaactgaaaactcaaatactgcaaatagctgccttttccctgtaacctaaagcatcttagtccaaactaggggatgtttttaggatagtgaccctctagatcagagctctcccttcctggacaacaagctccctgaggacgtgggcgacttagtacatcttgtatgggcctctctgcctgttctttgctttgctttctgggacacccttaggctagtctagcaattctgaactgcctggcttgaagagttgattcccatgggatgttgaggaggggccagaggttctggaagaatagtaaaaaacctacaaccaagtggtagcatctcagtattcctcttccacaaagtagcccatccccccccatcaccaagggaagcccctagtggtggcaggcatcttgggaatttaccttcattactaattctcccttgtctaccagtagcacttcttaacctgctcactgcccatcagaacagcctctgacaaagctgcatccaaattctttaaagggcaattcattgccccaagtaatctgccaaacctgtcttcatttggaaatcagtcttcatattcaggtgagttccacttaagacccttttagctgccaatttaaaagaagcccttttgcaatgttgattatgtttctataaatattagaaccagccgggcgcggtggctcacgcgtgtaatcccaacactggaaggccaaggcaggcggatcacttgaagtcgggagtttgggaaacatggtgaaaccccatctctactaaaaatacaaaaattagccggccatggtggcttatgcctatagtcccagctaccaggaggctgaagcaagagaatcacttgaacccgggaggtggaggtttcagtgagctgagattgcacttctgcactacagcctgggaggtagagccagacattgtcttaaaaaaaaaaaaaaaaaaaaaaaaaatagaaccatactacagcagcatagtcactgttggtttgaatctctcacattttgttcttttagaagtgctgcctaatcataagtttcataaagtaatgtggagttataattttaatcagttggtttggcttttttaaaaaattgtcttctaaaaatcggtttatactgtgtgtgtacatacatactacatatgcatatgtggatgcgtatttcaggtttccaaaacagcttgatacattttacctacattgggccaaattattttgtctttttaaattttctcaaaaaggtcatattgcaaaattattctaggtcctttactatgtctttatgctgacagtcaagctaatagtgatcaagagcattatgcttctggggttacaaggttcagaacttgccccattggccacttcctctatataaaataagacagtcacattggaatcttaatagggccctttcctgctcagaagttcagaaagcattgcctaaattaatatttttaagggaagaaaatgttgacagatgcaaccttagctgattgttcaaaaaaagtttttcctttggttataattgtaaatacaaaagaagaaagcttggcctttgtcctctatgacctcatgacttagtggggaaaacagccacacaaacaatgaccacagtgtcccaaggtgtgggtggggtttttagagggtcatggagtgactggcatggttggcaactgaggaggtgggtcttaaagaatgaccaagaagtttgtccaggttgaaatgtgtccagtgagcagttgaaaatagggttttggagtatttaatggacagaaggtaatcaagtccgttaacagactggcccagagacggatcacgaggtcaggagatcgagaccatcctggctaacacggtgaaaccccgtctctactaaaaatacaaaaaattagccaggcattgtggtgggcgcctgtagtcccagctacacgggaggctgaggcaggagaatggcatgaacctgggaggcggagcttgcagtgagtgagatcgtgccactgcactccagcctgggtgacagagcgagactccatctcaaaaaaaaaaaaaaaaaagagagagaggagactggcccagagagggcaagtagcagataagtgtttaggcagaaagcagcacaccacaggagattggcttctcgtgttatttttctccattcttttgtcccacgttggggaatgcagcttaattttctacatttacaaagtatatgggccaggcgcagtggcttacgcctgtaatcccaacactttgggaggccgaggtgggcagattacctgaggtcaggagttggagaccagcctgaccaacatggagaaaccccatctctactgaaaatacaaaattagctggacatggtggcacatgcctgtaatcccagctactcgggaggctgaggcaggagaatcgcttgaaccaggaagcaatggttgcagtgagccgagatcgcgccattgcactccagcctgggcaacaagagcgaaactccgtctcaagaaaaaataaaaacaaaaaatacgtgaagatatgccttagccccagatcacaaaaatagcaacactttttctatcctggcaattataaatgttttgagtctggcccaaagttgaagtagaaagaaattgatggtaaagagatactttctttgcaatttggtaatttgtgaatggaaggcagaaaggaattaggtgatctgtgccttcattaaaaaagactccacaaataccacccttactcatatctaggattctacaggagacaaaaattcattatcaaaataccaagtctttttgagtgtgcagcagtcattcagcaaaacattttctgggtgccttgttgtcactcaatttgagcaccagcacctcttggaaatgctttctgatctcccattggctgagagcccttctcttgcttctgtgacagcttctctatacaacaactttgtaatcatcaactatcttcctatgtccctggttaggattatgagcctcccagtgtagggaacatgctttgttcaaaggtgctcaatagatagttgttgaataacactgaaggctttatgttataaagaactatataaatagaatgggaaaatccccatacacaatagcaaccccaatgcaaaatccctaacaaaatagaggtgacctgtgtaataaagacctattgaaaattctaatccagactttgagatttcacagatcagtaaaatttccaaaatacatttcatcaacttatgcatttagaaacaagaaaaaaatatatctaacatagtttttttgtaaaacgccatttcaactctgagtagtgggggagggaatcacaggataaagtacagttctttaaaagaaattagttttgctttataaaagtcactatgttgtcctcagttttctctcattgctgcttatttttctccacacagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaacaggaaagcatggctaacaa

SEQ ID NO: 36 - DNA, 38860 bp, Homo sapiens
  source 1..38860: mol_type = genomic DNA
atccctgcagcgctacccgggtactctggatgcacatagggcggctctcgctcctaccttgtcatcctgctgtctaatccgggggcagcttccctcctccacaccagcagaggctattcttcagcaacaagaatagccgagcctattcgtccgcaacaagagcccaagaagcatcctgcaggctttctgctttttgagtgtattttaaagcaaaaacgagtggaaagctatgtatgctcagttaactatgtctagatgttaaccttttttcaaaaaacacagatggaggcctccctccgaggatgcctggcattctcctctttctgtgggcggcagcgaccccctgcggctccagcctccactacgggatctgcgggaagacacggggaagacgaactccgcacactgcatttgattaatgatttattttgattaacgccgtcacagtgacgccttagagcagtccctgttcacccgggtcccagcctcgaccccgcacggacagcgagggtgggtagctgggggcggacgcaggaaagaggaggggcggggccttggtcgggtggggtatggaatgggcagggtgggggggatgggcggggtatgggatgggcggggcccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggtgagccagggcagggggctgcagcggtgggcgagggggcggcggctccttcccggcgggcgcttccgcggcctgaaaacggtacccgccgccctgccccgcggcccggagcctgtcggggtgagggtggcgaggggtggggcggccctcccgcgagacggctgccctgggaggatccccaagcctcggcgggtcctgacctggtgggagagggtgggtagtgaacacagggtgggcccaagaagggtccagggccggcctcttggccgcaggtaacccctctacaagtcacccagagacttggaggtgacgtcctcccgcaggctgggaaggattccgcagccagttcctcgccataaggaggtggttacagacacgcctgtgggagacatgggaccactacccgagctgaatgaggtgcccagggtcggtgggaatccacatagactgctgtgtctaggagagtgtgtacactctatatagagagaatatttgatgaggccgagaaccccaaaggaattgtttttgccatcgaaatgcataagctacaggaagtaaacatcgctcaaagaaaatgaaacccaggttccgacctggcctccaccagcaggaaaactgttgtatggaaatgtacaccaaggaactgtttgtaaggatgaaatggaaaatgaaagcatagaaaagtaaggcaatgtgaggacctcagaagcctttggatctggttagcaaggtgcaggctgtgtgaacagaagaacccaccttgctcttttgacccagggagagaagagttagtggtgccaggctgcctcccaggacaggcccagttttggggcgggggctggagaagtcccagggcagaccccaaggccagggattgccctggagtggacaaggcaagtttaaatgtgacctgtagacagaggacgatcattgatttaagtcctggcataattcatctgtttttccactgggccaattttaggcgttctttatatattacgtacaacacaataaaagtaacagcttctttttttataaactaacctttaggttgcatattatgctaggaatataactaacctaacctccacccccccacccccccacccacccccggaaaaccaaactttattctcgagggcaactggacactgtattatgtcctgccgaacccccgcccttacttaggtagaggcgcataagtattctggccatgaaatacaccttctgttttatagagatttggcatatttgatatatgttctttggaatttatgaaatagaaaacccaaaggaaaaagaaaaaaattaaacttttttttaaaaaaatatttcatttagaaagaaaaaattaaaagtttttgttatttccactttgacatgtgtatgaggagcattagaatctgtgttatgaagtgatacccagatggctttgcagtgacagaaaacacttctaatttttcaaataagttagaaaggaggattttgagaatctggaagtgaatgccgtggaactgtggagaaactcctaacaatactggcatgctgagtttgtcacctacacagcagaaagcattttacaggtattagacttaaaaatacctcattatgctatattttcatttcatttcaaccaacatttactgcaagcctgctatgtgccagtctctagtaagaataacatggagagaaaatagacgggcagacgatagcagtaatttcagaatgggcggaggaggtggaaatgcagagtgttcttgggtgctcggagtagggaacagttcatatgacacaggacatcatatttaagctggacattgatctgtccagtggaagtttgccaggacacaaggggagccagacatttcgggcagagggcagaagggaggcaaggacgcagagacagaagaatgcagggaaccgtgagctctttaacgtgccttgggtacgagtgttttggtggcaggaggtgactctggtgggtcagttgggcctgggccctgaaaggccacgtttgtcttgttaagaaactgaaagtctgtcgtgtatgggaagggtggactcaggggaatgacctcatattgcaaaagaaaccatgagggcaagaggactgaaattgacagggctgaaagccagtcatttaggaggctgttaaaatgtattcaacagatatttaccgagtcctgccttctatgtggcaagtaatgttctcagtcctggggatacagcagtggacaaaataggcagaacccctgtcctttgtggaggtcaacatggctgtggtacagacaagataagggcctgaactaagcctgtggggatggagaggaggcagtggattttagaaacacttagaagggccaggcatggtggctcatgcctgtaatcccagcacttagggaggccgaggtgggtggatcacttgagatcaggagttcaagaccagcctggccaacgtggcaaaaccctgtctctactaaaaatacaaaaattagctgggaatggtggcatgcacctgtaatcccagctacttgggaggctgaggtgggagaattgcttgaacctgggaggcggaggttgcagtgagctgagattttgccacggcactctagcctgggcgacagagtgagactgagtcttaatttaaaaaaaaaaagaaaaaataaatatttaggaggtagaggtgatggcatttggtgacccattagacttggggaaaagggggctgggaagaatcaagccttactcccaggttcctgccttggggagctaggttaaagctgctgccattttctgtatattactaaaatacgaagtcacaatatcccttctagtgtgtaatgacgaggctgcttttaccccattagtaggatgcatactctaagttctttttccaaggtgggaagggtttagtcaatgcaatgttagaatcttaccccccttgtgaacccaaactcttcatagcatttgccagtagccaactcttgtctctggtcaaaaagcaagttttcactgtttaaaactcatttatcccatgtagggattgaacctacgaatacttcattagcaaatttgaagacttggccataccagggcaagggcctaaccttatactatgtgcagtgtccactggggggaagtcagtgtaaggcaggtaccatttgacacattatgactttctgaccactagagccatcccacagtggaacagacagtgcctgctaaggtcactgcactcgtgctctgtcattgaaatactcaagcctgctctataggatcatgtgccatcgaaaccagacaagacattcttgcattgaatatattggtctggatcatttctaaggccaactcagcaatcagatgtatgctcgtgtttacaaggtcaggtcattactagaattacttgatctctggaatttaaatgtatatacacacacatgcacacacacacacacacacacacacaatcaggaattgagatagcagatctgggaataaaatctaggggacttgcttttggccatccatctactaggcagtcctcagtcttcctcattggtggaatcttgacaaatcctgtgctcaattaattcatccttccatcattaaatatcacttttgcctagaaataacatacttcacatctaggtcagttgattatgggaaactctgttatttgatagaatcttagaataaatggcttagttccaatttctgtaaccttcgaagacatgtgcaaggatatgtaatgtatctctgtctttcctcagttgaatgtagctcaaggtgatgttaaaaacagagaatgaagctttctgtaactggcattccaccgacagatatttcatatgtgcactgcacagtgatagctcatagtgatgtcctaagataacctaagaattatgaagtgccctttgagtcatccaaaatcagttaaattagtttttttttctttttttttttttttttttttgtgagacagggtctcactctgtcacccaggctggagtgcagtagcatgatcttagctcactgcaacctctgcctcccaggttcaagcgattctcatgcctcagctcccgagtagctgggactacaggcatgcaccactacacccagctacttttttttttttttttttttactattacaaaatttatttaacaaaaagtctaatatgaaaatgtacatgacctaacttttacatcatagtaaaacaggccctatggagagaggacatgggtttctctgctgaacagccattttttatactcattccaaggcttctaacatgaggatactgtttcctcgtattaccaccattccagtattgttctgttgcccactagtcgccatctccacacattcatctatcacaagattcataaagggatcaagtccctgcaatattccttggacgtgtctgccaccatttaatttcaatgataacttcttgtccataaatcccttctagccatctggttagaacatgatgctattcgagatgttcaacaaaaggtggcattcgagatcttcaaggaacgaagaagggacagcatgggggtgaccaggggcccgaccgcaggaccgggaggcgagtcggccagaaagaggtgcagtggctgctggtggtaactacgccgacgtgcgagctctgctactaatttatgtatttttagtagagatgggatttcaccatgttggctgggctgatctcaaactcctggcctcaaatgatctgcccaccttggcttcccaaagtgctgggattacaggcataagccactgcacccggcatcaattaaattacttttagtaaaattttggtattaagtatttacatgcttatatttaccgtttatgctaacttcttatgtttgatgacatttgaattacaaaatattttttctaacaatacacaatatcacagaatttgctgtcattaggacagttatagctattcatgagagtgactggcctgcccgtgatacttggtgtatatgcattgaagggtggggtttagattgtggtctttctagaaactaaagaatatttttcacagagttcataaggattatcatttgctggatgagtcaataaataccactagaggtcatgtgacttcccaaggccacacatctggctaatggtacaaatgtttttttctgtggcctcccttagcacgaccccacttttttcctcgtatgcttataaaatccgggcaatgtgagaagtcagaaacactgatgtaacaactagaaccagttttaactttattatggtggtatctgtaggcttggtggaggcataaaaggtcatggaggggcccggcaccgtggctcaagcctgtaattccagcactttgggaggctgagatgggtggatcacctgaggtcacgagttcaagaccagactggccaacttggcaaaaccctgtctctactaaaaatacaaaaattagccgggtgtggtagcacatgcctgtgatcccagctacttgggaggttgaggcaggagaatcacttgaatctgaaaggcagaggttgcagtgaactgagattgtgccactgtactccagcctgggcgacaaagtgagactctgtctgaaaaaaaaaaaaaagttcattgaggaaaaaaatcttaacagttttcaaagaaacgtctctctcttttcttccctctcttctcccctccccttcctttcattttcagaaaaaaaggagaaatttgtgcatataataagatgaaaccaaacacacttctaaaaatctgcttagatcctttctttaaaaaaatctgttgaatattttcatggcctttgcaaaatatagtataatcactgaatacctaagaaaaattaactgttggcaagtaaatgatacagatgacaaggattttctcttttaggtctattacctagaattttagtattcctctgcaaattaggtaggaacactgttactcagtaaaaccctattttaatgagatgattctgggtacaaaaaaatgaattttacagaaaattagaaactgatggtctattcagattatttttgtgagaagaagagcagtctgttctagtcacctaatgctaagctatggaacacttctgcattatacctgttttctaagtgaatttgggtgtgtgacacatagatacaaaaagttcaaaaatgaatcctatggtttatcagtgttttctgcttcgtaagattgccatcaccctcattacatgactacatgagaatgcccctcttggtactagctcttgtaggaagaagtggcacaggctgtactgtcacagggtgtggtaggtagctctgtctctgattacctacaagttcctcacaccaaaaggaggttaccaggtattgcttccagaagatctacagaaagcccaaggtattgcctcctgtggccaaggacgcaacaccacagtggtgcattttgttttattttaattgatggctattaaatgcacacatagatatcatgacacagttacatgtcagaaacaggcagtgctcttatctctatcttccagggactgatatcatgtgtaatggattcttcacaactcagggttcacacaggctccatagtcatgagtggctgatggatctcattgagaccagtgcctttcccccgttagaaatgggatgctcgcttccaagttctctcctcaccccttttgtgcatgcgtggctttctgcctgatcacagttgtatagtgtacattggtgcttaatacctatttattggatagatggattttaaattattttctaaggtccaggagcagtggcttatgcctgtaatcccagcacttttggaggccgaggccagcagatcacctgaagtcaggagttcgagaccggcctggctaacatgatgaaaccccgtctctactaaaaatacaaaaattggccaggcatggtggctgacgcctatagtcccagctacttgggaggctgagtcaggagaatcacttgaacccaggaggtggaggttgcagtgagccgagatcgctccactgcactccagcctgggcaacagagagagactctcaaaaaaccaaaacagtctttttttttttttttttttgagactctgtcgcccatgctggagtgcagtggcacgatctcggctcactgcaagctctgcctcctgggttcacgccattctcctgccgcagcctccggagtagctgggactacaggcacctgccaccatgcttggctaattttttgtattttttttattagagacagggtttcaccgtgttagccaggatggtctcgatctcctgacctcgtaatctgcccgcctcagcctcccaaagtgctgggattagaggcgtgagccaccgcgcccggctcaaaaacaatcttctaacagtaaacatcctggaagtaaataatatgctttttcaggcatgtctctggactttggccattcttgacctttgtagaatgcgtgtgtgggccatgtgtacacagcgtcagcggggaggagttgcctttgctatgtattgctttataatctatccccatcagctcttgaagaaaatacatcattttcaccaagtgtgaaggtggaaatttgtgctgaaacatgtttgcctgggtggttggtaacacagaagcagagtggggatttactcattggtcttgcatttctatgtccacatggatgcctctacaaaacaaaatgatatgtgtaaaaaaatttcagaccatgcaatacctaaagatatcttagtcttttcagtatgcattgaaaaatagactattaaagcctaagtactcagtaatataactttgttgttttacaaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagtaagcattcaaagaatgttaattctccctttcttcttaaccaaaaacacaataaactaaatataggttttaaaacagcttttttgagatagaattcacttaccatgcaatttacttgaaataaggagatttgaatttgaagatttgcatgggaaatttttttcatgataccttgcccatgtctacatatatcctgatcatcatgatgtcataccctcgtctccctcccccatttcccaaatccttattgtaccctttttttttttttttggtttgagacggagtctcgctctgttgcccaggctggagtgcagtggcgcgatcttggctcactgcaagctctgcctcccgggttcacgccattctcctgcctcagcctcccgagtagctgggactacaagcgcccaacaccaagcccggctaattttttgtatttttagtagagacggggtttcactgtgttagccaggatggtctcaatctcctgacctcatgatctgtccgcctcggcctcccaaagtgctgggattacaggcgtgagccaccacgcccggccctcattgtacccttttatacacccatacacacacacgcacacacacacatgcacacatgcgcgtgcacacacacacacacttttctgaagctacatataccttttttgtttaaaaggaagaatcaaaaatgtccaaaatgtaactggagagaaagtgggcaacttttggagtaagtattagcaatcgccaatgggtttgtgggactcccggggaccccttgtggggcgggggacagctctattttcaacaggtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaaggtgagcagggctggcccctgtgtgccccattcatcctgggcctgcaagaaatgccatccctttgcactaaggcttggtggtgagctcccttctccccgtttccataggtggtagctggtggggaagcacaggatttagcatttggcaaggctaaatctgttctgatttttacttttggaaacaggtacaagtaaaaactgtgtgtatctcaaggaagtagcataatgatatttagcccattcaaaaggaaaaagaggctgggcgtggtggctcatgcctgtcattccatcactttgggaggccgaggcagaaggattgcttgagtacaggagttcaagaccagcctgggcaagatggcaagacctgatctctacaaaaaaattaaaaaaaaaaaaaaaaagctgggcgtggtggtgcacgcctctggtcctagctactggggatgctgaggttggaggattgcttgagcctgggaagttggagctgcagtgagccatgatcgtgccactgcactttagcctggatgacagagagagaccctgactcaaaaaaaaaaaaaaaaaaaggaaaaaggaagaaaggctgctatggttccagagttagtcctatatattaccttattaagagaaagcatcctggtatctcaagatggctttgggcaggaccagtatttgaatctaggagtagtaagaacttccttagctcctagtaaccatagatatttagatatttgtgctgtagtggcggtacccaaatccactttattttcttgggatttttaaggactagaaatgatgttcatcccgctagtcttttctgtaagcaaaaaccacttcgtctttttgctgctgacccttgggccaaggctaagcatggcatctttcaattcagagccatgtggtcaagtggactagagggagatttggttcatcagatcaagtccactttcctggtgtgtgactccatcactctgaacctcctgcagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggtgagcagaccgatccattgtgatgttgttttttttttttcccttgacatttgcagtggaatcttacgtgtctagactcctagatcaaaacctttcatggttcagtctggattggtgttttgcctggtcttggaagaagtgcttttgctgaaaagattggttgccctattaagggtcatggataatctcttttagaagaaagaaatttgtaaagctttgaccgtactgattgtaggcaaaagaacagtaaggttataaatcattgtattgtattcattatagatggtgcagatgggcctctgcctagaaccaacaattgtttttagtttgtctttgatataaaaaatatgtttaaaaaacccattactcagaatttttacttgttgaccttgtctgttctctcagtctaaaatggagattattcactttacattttcctttttaaaaatgctttggaaaatgtcatgttgtggtaggaggctatcgcattgccacagatgaaaagagaaagagacacatttttcttaacccaaagaacctggaaaaatgtgctcatacctgggagtggatgtcaaagatgatagtaatgacacaacccagaacaagtttgaaatccccactgggcgtggtttgttaaggagtcctctgctgtccatgccaagtgtggggagaatgggtgtgggtgggctttgatgggaggaaaagggcaggaggttgggtggtgggaacgttttttccttcctttctggaattttagacacagcttatgagtccactgttgccaaagtgtggttgattatttctatgatatcagattattccagcatggcaaggaaggctttctttcttgtcatgaagttactttaaattttgattatttgaatacaataaaataatgtaaaaatttccattttaaatgttatgtcaaaataaatcgtgggctaggcacggtggctcacacctgtaatcccagcgctttgggaggctagggtgggcagatcacctgaggtgaggagttcgagaccagcctggccaacatggcgaaaccccatctctactaaaaatacaaaaattagccaggcatggtagtgcgtgcctgtagtcccagctacttgggaggctaaggcaggagaattgcttaaacccgagaggtggaggatgcagtaagctgagatcgcgccattgcactccaatgggcgacagagtgagactctgtctgggaaaaaaaaattgtcaggtaaaagctgaaattttctacattaaagcacaaggcataaaggtgttgagaaacttccttgtcagtaggtgtgggggcaattgagtctcatggccaggtccttagtttgatttgtatttgttttttgactgtttttttttttttttttttttgagatggagtcttgctctgttgcccaggctggagtacagtggcataatctcggctcactgcaagctccgcctcccaggttcacgccattgtcctgcctcagcctcccgagtagctgggactacaggcgcccgccaccacgcccagctaatctttttgtatttttagtagagacggggtttcactgtgttagccaggatggtctccatctcctgaccttcatgatccgcccacctcggcctcccaaagtgctgggattacaggcgtgagccaccacgcctggcttggcttttttttttttttttttgagacagggtcttggcagtcttaaactcctgggctcaggcagtcttcctgcctcagcctcccaactaatggggactacaggtgtgtgccactacacctggctaattattaaattttttgtaaagatgggggtcttgctatgttgcccaggctggtctcaaaatcctggcctcaagggatcctcccacttcagcctcccagagctctgcgattaagggcatgagcccatggtgcccagccttagtttgatctgttcattcactttactccttgtcatctccaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgtgagtttttggttttatttttgttttgagcaaactataaagcctcccctggaaagatgaaacaaataccactttttcttgtcaacacaagccaaggattgaggaaattccagtgtagcaaagataaattggctctcattttctaagtatagcataatgcatgtaagggttatcatagctaaaatggaaaaatattaattaccttttatgatgaaagctgtagtctttttttttttcttcatcatgtcctggcaaattgaacatttttgtgaccagaaaaggaaaaaacccacacgaacatgaactttctgtcatttttcaaactaggtctcaaagctgtattccgcagttcacttaagggagcgcaaacatattttcacaacagaaccctctttttttgttttgagacagagtcttactctgtcttcccggctggaatgcagtgatgtgatctcggctcactgcaccctctgcctccggggttcaagagattctcgtgcctcaacctcccaagtcgctgggactacaagcgcatgccatcacacccggctaactttttgtatttttaataaaaaagacaggtttttgccatgttggccaggctagtctcaaactcctggcttcaagtgatccacccgcctcggcctcccaaagtgctgggatgacaggcgtgagccaccgcgcctggccaacagaaccttcttttcaaacaaagtggtatgaggaaccctgatacattaaaaagaagaagaggagaaaagaaagagcagaactgctctggttgtaggttgagggagtgtcctggcttttccttccctttcaaaagcagctactcaggagcctctgagaactgagtttgaagccattgctatcaaaatcaaatttctctgcaaccccagatgaagtgggctaagcgagggggccctaagctcttgagaagcatctgttacaactgtgcctgggcataggggcagccctattgaagagcagagcaggtcgatgcaccagctgggggcctgtccttcattgctactaacaaagattagacagggagaaagatagacaaggataaaatcctctgtagtatagatggtcactttcgatgagtcagagtacatatctgatacaggaaaagggactggccgggtgtaatggctcacgcctataatcccagcactttgggaggctgaggaggcaggatcccttgagcccaggagttcaagaccagcctgggcaacctggcgaaaccctgtgtgtacataaaaaaaaaatacaaaaagttagctaggcacattggcacacacctgtactcccagctactcaggaggctgaggcaggaggatcacttgaacctgggagtttgagatgctgcagtgtgccatgattgtgccgctgcactccagcctgggtgacagagcaagactctgtctttaaatttaaaaaaaaaagaaaagaaaaaaaattgtgtccttggaagagaaaaatgtacattgtagataagtcaggaggagtggggaacaacttgcaaaaaagctcacctactggttatatctgaaatatgaatgtctgactgtctttgctttctgatttatttgctgcaatagagttaggaaacagctctgaataaccctgccatccattccccctcatacatttcagtggccaaaatcaagataattaaaatgtcaattgaaaagcgtattttgccagagtaccccttctgcaagtgatcgaagattactgagacagaagtttaaccaaagaaacttacccttctgtcaataaccgataagctgcaggaaacccaacagcatatgagaagtttccagatgaagcttcttccttcagggtgcatggttagcatctcattctccctgtcagatgagtgacagttatttttagtgtaaacacgttttgcatgcgtttcttctgtgaactggaaagcactgcccaagatttaggaagaaacatcaaaaatatctagaacccccatggccccaagcagagaaaaaatatatgtatctatgttttttataatagatatatctgtatttatattatataatgaatatataatatattctataatatataatgtagaatatattctacaattatataattgcatatataattatataattatataattatataattatatatacatatatataattatataattatataattatataattatataattgtataatatattctacaattatataattgtattatatacacttacatatgtatctgtattttttataatagatatatctatatttatatatatttatatatagatatatctatatttatatatatttatatatagatatatctatatttatatatatttatatatatagatatatctatatttatatatttttatatatagatatatctatatgtatatatatttatatatatagatatatctattttatatatttttatatatattatatatatatataaatttataatatagatatatctatatatttatatatagatatatctatattttatatatatatttatagatatatctatatttatatatatatttatatatagatatatctatatatatctatatttatatctatatttatataatgaatacatataatatattctataatatataatatataatataacatagaatatagaatatattatacaattatataattgtataatatatatacacttatatatgtatctgttttataatagatatatctgtatttatattatagaatatatataatatagaatatatataatatattctatattatataatatagaatatatataatatattctatattatataatatagaatatatataatatattctataatatataatatagaatatattatacattatatattatacaattaatatataattacatatataacattatatatttatataatatatatttctatatctaaatatctaaatatattatatatatatttatacgtatatacctagaactatctttgtgcatttttgaagattttccctgggagcttattggaatataaatgtctttcaaatcctgtgggtcttagactatcttgttccctaagtgacctgtggtgcatacaaatttctaatgggaaccaacttggccaagatggtgctttgtgaatctcattcacagaaactgcctcttttttaactttacctcagtgagttctagcattttgcattttaaaggaaggatatgtggagttgtcaccagctctgtatgaccttaaccttgagaaagagggaactgccaaggaaagggaggagcagataagctttcatgtttacagagtcaggtagaatgtgtatggcgagatgaaactgaccttcacgccttagctgggatatttataatcccgacagggcgtgccaggtgaggggagggtacgtttccatttcctctgagccaccccgtttaaacagtgcacatctgaatgtttggaagcttccttgggttgcatgtcacaaaaattcatcttttgtctttttcttcttttgacaaagaatttgtcttgtagacatattgtgttaaatcccttgcatttctgttttcacaggaaggagaagcagaagggtcagtaaaagaaatcaagcatagtcctgggcccacgagaacagtctccactggcacgtatgtgaaggaagactcgggctgtcaggcagacaggctgggcaggctcgtcactgggtgcttgtcaccggaggtcaaatgttgtgacctgaggaagtaacttctttatgatttataccaggatctttccagaatatttggtttgaatgctatttaatgttgcagctcaaactggcaaagattaaaaactgtttggttcctgtttggctcacactgactgctctgttctagtggtgtctcacctccagcagatgaaaagtgaaagcaaactggttctcaatcaagtcaatgatttgttcctaatcaaagacatgtttgctcattggttccccggtgccatttgacccagaccagcctgcccagcttccataagtgaaatattttcattttcttttccctgctacttcccagttataagctggcatggccaatactggaacatcttttgtaacaatgactgatagcactctcagtcattgtgggtgttgcctgaaagtgcccagatttcttatctgtggagtctcaagtgtacctgtcctatgtagatgtgaggaaacagacatcttaaatagtggcagggccttggggagggaggcagacctagaactgagcgcctgaacctcttgactctcgcaaagcagtgctcaccaaggagactgctagctcgccttctgcaagctgcttactcctgtaatcatctattcaagagacgattgtctgaaaagaactctaaggatctcttttttttttttttttttgagacggaatcttgttctgttgcccaggctggagtgcagtggcgtgatctcggctcactgcaagctccgcctcccgggttcacgccattctcctgccttagcctcccgagtagctggaaccacaggcgcccaccaccatgcccggctaattttttgtatttttagtagagatggggtttcaccgtgttagccaggatggtctcgatctcctgacctcgtgatctgcccgccttggcctcccaaagcgctgggattacaggcatgagccaccgcgcccggccaggatctcttatctcacagacggataagagatccatcttttttttttttttgagatggagttttttttttttttttttttttttgagatggagtttcactctgccactgaggctggagtgaagtggcgcaatctcagctcactgcaacgtctgcctcccgggtacaagcagttctcctgcctcagccttccgagtagctgggaatacaggtggccgccaccacgcccagctaactttttgtgtttttaatagagacagggtttcactgtgttgaccaggctggtctcgaactcctgacctcaggtgatcctctggtctcagcctcccaaagcgctgggattacaggcgtgagccactgcgcccagctatctcatagatttgtaaaaccttctttgtataacttgatgaatgtgcatatagaatgacttacaaaacgtgaaaaaaattgtcttccgttatgtttctaagcccttgtataaggaagaaagtaagtattagataatattctttcgtcaaacacagtaattggcataaacgaaagtaattcccttttttggttaacaattcttcacgtttcccccaaattgcttttgtcatatttaaagacgttcctggaagtagtgggaaataaaaaagccctggttgaaatatcaaagccacttcctcatcattcatatccagatgcaaagaccgcttcctcttttaagccacatggctatttttaaaataacagctctgtaccatttgtgagtatcgtaattagtttgagattgatttccaggtttggagttgaagcttcagagtcctggaaaccgggatttaatcctggctgtttattagctatgcgaacctgagtcggtgactgaaagagtagctgccgttagcatcatcatagtcatccctcatgttttgtaacagtgatcatgattctgtttgtcactgatatgtctcttgatttagtcagattttgaaatcgagaaaaatacttgacatatcaacagagcctccatttctctgctctcattatttgaaaccacaagtgaaaaaggttttctccccttgacttaagctgtgatggtctctgttaacttggagaaaggccagtggtctgtacaatgtgcctttatcttttgtctgactgcagtcccctttgagactagatctctggaaagcttggcaccttcagccacggctgcctctgctgaactgttccgtgagttttgtggtgtggtgtgaggtacacagtgactgtttggaggacgtgggtgtgtgcattgtaagctggcctctccagagcctcactgagtctccacaccttccctaggaagcatggaggagcttggcactgggggtcccaggaccagctgtgcttgttcactagttgagaattagttggagaatgttctggaaagcagttcctttaagctggtcccagttatattgggttactctcttcttagtctttggaatttttctgatgaaaaccttttaacctttatactgaacagggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaaggtatgaaataggttaacttgaaatatgtgtttttttaaaacagctttcctgagatataattaagataccatacagttcacccatttaaagtatacatttcagtgttttttagaatattccaggattgtgcaaccactgttactacaatataattttagaacattttttcccccaaacagcactcactgtctgctcctccaagcaatgtgctttctgtctctatagatttggccattctagacatttcatataaatggaattatacagtctgtggttttttgtgactggcttctttcacgtagcataatgtttttgaggttcatctacaacgtagcatgtatcagtacttccttttccttgctgaataaccttccattgtctatatatacaacattttgtttattcattcatcagttgataaacattagagttgttgccactttttacctattaggaataatgctgctatgaacagtgtgtacaagtttttactgggatatgtgtttttaattctctggggtatatcgttatgggtggaattgctgggtcatacggtatcgctatttcatattctaaggaaccagcaaatcattttccaaagcagctgcgccattttgcattcccaccagcagtgcatgagcattccactttctccacgtccataccaacacttgtttcttactgttttcactttgacttcagccatcctagtggatgtgaattggtatctcatagttctgatttgtatttccctagtgacagcgatgttgagcatcttttcatgttgaccgtttgtttgatttggagaaaagtctattcagagcctttgcccatttttaaaaattgggttatttgtctttttatgttgaattataagagttcattttacattctggatacaagacccttattaaatatatgatctgcaactattttctttctttttttttttttttttttgagacggagtctcgttctgtcacccaggctggagtgcagtggcgcaatctcggctcactgcaagctccgcctcccgggttcacgccattctcctgcctcagtctcccgagtagccgggactacaggcgcccgccaccacgcccggctaattttttttttttgtatttttagtagagacggggtttcaccatgttagccaggatggtctcgatctcctgacctcgtgatctgcccgcctcagcctcccaaagcgctgggattacaggcgtgagccaccgcgcccggctgatctgcaactattttctcccattctgtggatcgtcttttcccttgatggtatcatttgcagcacatttgtttttattttgatgtaatacagtttatctcctttttcttttgtcacctgtgcttttgatgtcccatctgagaaaccgttgcctaacccaaggtcacaaagatttactcctatgtttttctcctaagaattttgtagttttggcctggcgcggtggccaaaattacagttggccaccgcactccagcctgggtgacagagtgagactctgtctcaaaaaaaaaaaaaaaagaattttgtagtttcatctctgacatttaagcctgtggtccattttgagtttgtttctgtgtatgttgtgatataggagttcaacttcattagactctcagttctgtttcattgatctatgtttgtccttacgccagtaccacaatgtcttgagtactatagctttgtagtaagttttgaaatcaggaagtgtattagcccgttttcatacttatatgaagaaccgcctgagactgggtaatttataaaagaaagaggtttaactgactcacagttcagcatggctagggaggccttgggaaacctaacaaatcctggcggaaagcgaaggggaagcaaggcaccttcttcacaaggtggcagaaaggagaaggaacgcaggaggcactaccacacacttagaaaaccatcagatctcatgagaactcactcactatcacgagaacagcatggaggaaactgcccccgtgattcaattacctccacctggtctctcccttgacacatggggattatggggattacaattcaagatgagatctgggtggggacaacaaagcctaaccatatgaggaaggagttaactgtgagccagctcctgctgtggctaagggaagggaatcagaaggtggagagacttgaaattgcactcgagagatagtgccttccaactttgttcttctttttaaagactgttggctcttctgggttctttgctgttgcgtaagaattttaggatcagcttgttaatttgtgaaaaaagccagctgggatcttactagggattgcattgtatccccaaatgatttggggagaattgctatctccaggattgtgtcatcgcagagatagtcttgctgcttcttttccagtctgaatgccttttatttctttttcttgcctgattatcctgtaaaaaaaaaaaaaaaaaaaaaaaaaaagtgttacatagaaatggagagagcaggcatccttgtcttgttcctaatcttagggggaaagctaaggccccacctttgtcatcacttcagaggttcctggtgtcactcatgcttgagtgtcctggagttcccacagtgtgaatctggttgcttcttggctgtccctactgttggctcaaaggtcggccttcttgggctggtaaggccccactcagacctgtactgccaaattttcctactattatttcctctccctttttctttgttcctgtaggcacatggctttttgaaggtccttttagtagagtttgggctgggaaaaaaattgcatgcatctgttcaacccattatctttaaccacagtctcttgtttcatttggattgggacggctttcctgtggttatgatttggtgttaagaatggtgttactttttttgttgtcgtttattcggtgacttttaaacttagctgtgtcctaaaaggaaaagtctttccttctctaatgaattcttatgaatgagataccatgttcatggaacacacatgcatccacatgtgtaaacacaaacaatttcaaaaacattgctgcataggacagttgcatggaaacaaatggtgttcaagatgagtttcacttgccttttacctctgtgtgtatttgtctgtgaatcaattctagccaattttaggatgaaaaataaaactaatgctaatatagtgaatgtgtagagattttgaaaacccctgatcctttatcccaattgtaaacaatgttctttttagtacttctgtaataattgctatttctcttaaagccaaagagaaagtaacttttctatcttctgtgattttccagagtttcagattttgaaaagaaaacaagtaatcgttctgagattgaaacccagacagaggggagcacagagaaagagaatgatgaagagaaaggcccggagactgtgagtcctaagattccacggccactaccacacccacacacacgagagtagtccagccactgaattcaaatcttgtgatgggttatttgctttagaaatatagaaatcatgttgatattgaatattatctatctattccttttatatgtccttgtcctgctctgtgtcaattgtagcgagatgtatttcttttttgttgttgttgttggagatggagtctcactctgtcgccaggctggagtgcagtggcacgatctcagctcactgcaacctccgcctcccaggttcaagcagttctcctgcctcagcctcccaagtagctgggattacaggtgcccgtcaccacgcctggctaatttttgtatttttaatacagacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaaggttcactgttgtcttgttcagtgttgtctggtaattgagagaggtgccttcgagtctgcagagagtcttcagctttcggaagttaatgaagccgtgaaggttgatagccataggggcccacgtgaaaggcatttacataaaatattcactttaggtaattaatttattcaacaaatatgtacattgaatgcctattgtatgtcaggagactgagaccttactgttgaaagaagagagaacatttagaaaacagatgaagagaccaccagtgaataatagttccctgttgactaaaacgaattcaacagccagtagcagggaaatatggtctttcaaggcatcagaaactcatttacaaaaattatagagctgccaggaaaaaggctgcacaacaaaaatagttgagtaaactagaaacatacactgggaagagagtatgggggcaagttgttagctggatagataggactgtgctttgacacctctgtggtctatgatctctgaacctggaatagggttcattttaatagcgataaagtcattatcccagtgcatccaaattgattagttcatgctttattaggaaacagaagttacccaaaacttagcaaacctaagtaccaagtatccaaaacattcttttcctacacaatgtttggggtattgtcaaagttggattgattcaccagccagtcttaattggctactaatggttcagcctgttttctcctaaagaggtttgtttaatgtcagatgataattgtacagatatgtttgggatttcccgtatgataggttggaagcgaagtggaagcactgaacctccaggtgacatctctgtttaaggagcttcaagaggctcatacaaaactcagcgaagctgagctaatgaagaagagacttcaagaaaagtaagaatgagagagcaattttatcctcctttgaaatatacatttttacaaagtatactactatataaaaacatagttttttaactatgttatgactaaaagaaaaatagacacctaattaaaatataaattcagaatatactaatgttccagttaatgtgtgagcatgaaatacttgtaagatggggggttggggactggagaactttaattctgccatttaggggcatttgttaaatgtacgagcctgggtaagatctctacagtaaagctgtgagctagttttcctgttactgacttaagctgatgacattgatgtgagtaagcataaagaaagatgaaaagagcataaagatcttgagtgacatttatttggaaaaaggtcaatttcaatttgttatttcaatcagttaattatttcaggctaacatgtagattgagcgtttggcatttgcttgtttctcttgatgtaagaagttacccaaaacttagcaaacctaagttgatgctgttctattggattcattggcaaacatgtttctagcacaatacggaggtgtgtgtgttttcttgaggttataattcccaacactctgtagaattatggtaacgtgatacaacatggcagctacaactaaggactttggacaaacagacctagatttaacatatgagtctgcaacttatttgtgttgggcaaggtatttatttcaattctctgagcctgtcttggcatttgtaaattgtgtgttgtaatttcttctatatacattgtgttaaatgatatgtctaatgggctgggcattaatgctttgtgcatagctgtcatttatttgtattatattgaaatcctctttccgatctttaagaagacttaggggaacttcctttttcccttattgaatctttgtcagaaactaaagtctttgcaattgacagaacctataactttttttttaatataaaagatatccacacatcactacatgagaagcgccttagctaattactactgtggtctgtgtttaaatactaaaaatgtatctgtatgactagtttaaacaattattcaaagaggacagtactgcatgtgagcttagatctgtacttttttatgtttaggcgtaagggttcagaaatatggccaggtctagtgaagaagcaaggaggattatgtatttcattttgcattcataaaccctacagccctaaaattcttatattgtacataaccttggggtttgtttaaaagccactgcgacgtaaaggagcattgtttatcctcatgaaatcttgacctttcttaggtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtgagtatgttgagtcagaagggcagcgacggggcagaggagggagaatcgcctttttatacagattggaattcggatttgagaataaattttaaaaaatttctttttcacttatctgaaggagtcctagcagacctctcagagagggggataaaatttaaaagttttgtcataataaaattatgctgattgtttgcactctgtcttgatttttcagaaaagattttttttgagagtaagaaatgctagtaggtcgtggggtgataaaggtaggcgagaagatttttctactggagtgttcagaaggttgggaggcaagactataagtttctatgatattttccccaggattccattttttaatatcttttttaataggtccaaattaactgtgctacagatgacacacaacaagcttcttcaagaacataataatgcattgaaaacaattgaggaactaacaagaaaagaggtattcactgaaaaaaattacttccatagcctagtaatgaacagaaactgttgaacgttttgtatataaaatagttacatgaatccttcactaaatctggtttcaaaggttgttttccaatgtatcattatttcttgcatctagggtttgtaacttctgatgttccacatatgtgtaatgtgctttattgcgtacaaagatgatgtgaatgtcctatggtcagggattaagcacttcgtatttctttttttttttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagcacttcgtatttctaaggataggtttgtaggagagctaagagcatgggcttctatgggtaggaagggccatctgctctggggaattgtgcaagaccagcgtgcctgctgtcagtgaatttgggaccctggaatcatcagcctgcagtttaaattcataataatggaccaggtgtggtagctcatgcatgtaatcccagcactttgggaggccaaggctggaggatcatttgaacccaggagtctgagaccagcctgggcaacagggaggccctatctctacaaaaaataaagagttaaccaagtgtgatgttcgtgcctgcggtcccagctccttgggaggctgaggcaggaggatcacttgagcctaggaggtcaaggctgcagtgagctgtgatcacgccactgtactccagcctgtgacagagtgagaacctgtctctaaaaaaagaaaacaataaataaattagtaataatgccagcatggtgtgatagtttagagaccacagaagcttgtgaattagaagggatctttgaatttttagccttgtaaatatactctttgtttttcatttattttcttttaaagaggaggttttgccatgttgcccagaatggttttgaactcctgagcttaggcaatccacgtgcctcagcctcccaaagtgctgggattacaggtgtgagccatcatgcccagcagtagtgttcctctcttggacctaataattttaaatttaaaacatgtttcttcttttccactgactgcaggaagtaacaagtggcaaaataacagtatcaacgagtcacagccttattaacattggagtttgttattgtatccctgatttcggtgttatcaccttttttttaggaattcattatttgcaagccacaacttaaatacaactttctgaataagttagcgttgctgattaatagactggttagagctgatacattttttagatctcgctatgttgcccaggcttgtctcccactcctgggctcaaacgatcctcccacctcagcctctcaattctaggcatgagccaccacacccggccagagctgataattaaaaaaataaacctttttctaatattttactaaaacaggcagaattatttcaaaaccatttctagaataaatgtttctttttcagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcaggtgaggcaccttccaaaaccccagctgagcgaggccagccctgactgtattctcgcattggaaagcaatggtgtttagaatgtttgtaattttctattttatatattttttcacccgtgagtgtattaaaactttaaaattgaaacatttggaaagtgctcagtggatcttatctgttctacatttaataggtaattggattctttccagtttgtggcattatgattaacgttgctaagacattcctgtgcatgttgctctgttcacatgtggatattttatatttctgttgggtacacacctaggagtggagtcgctggatcataggctctgcatgttactcacttttaacaggtaatgccaaacagttttccagagtggttggaccagttttcactcccatcaacagagagtttccatggctctacatcttaccaacacttctattatcagtcattttcctttaaccactctggagggtatatagtggtatctcatttaatttgcatttccctgatcactaatgggaaagagtactttttcaagtgtttttggcctttgaggtatcctcttttgtgaagtgccttatcaagcctgccttttttttttttttttttttttttttttttttggtttggtttgcctggcattttttttgagacagagtcttgctctgtcgcccaggctggagtacagtggtatgatctcggctcattgcaacctctgcctcctgggttcaggtgattctcctgcctcagcctcccatgtagctgggactacaggcatgtgccaacatgcctggctaatttttgtatttttagtagagatggggtttcatcatgttggccaggctggtctcaaactcctgacctcaggtgatccacccacttccacctcccagagtgctgggattacaggcatgagccactgcgcctggcctggctttttaaaaaaatgtaatgacttctatgtatactgcacatacaagtctttgtcagttatttttgccttttcactctcataaaggtgtcatttgaggaacaaaagttcttagttttaaggtagtccagtatatcagccttctcatttatgattagtactttttgtgtcctgtttaagaaacttttactaccccaaggccaggaagatattccctctgttgtcttctaaaaattttgttgtcttaccttttacattaagatgtacaaaccatttgaaattggcttttgtctatagaaaatgaggtaagggtaaatatttatttttttcctatatgaatatccagttaacttggcaccatttaagccatcttttcttaagtgctctgctgccctcttcatcataacttgtgtccatatatgcatgggtctgtttctggattttgttctattttattggtctactcatatatctttgctctggtaccatgctgtcttattataaagcatcaaactttttttttttttttgagacagagtctagctctgtcaccaggctggagtgcagtggcacgatcttggctcactgcaacctccacctcccgggttcaagccattctcctgcctcagcctcccaagtagctgggactacaggcgcacaccaccacgctcagctaatttttgtatttttagtagagatggagtttcaccacgttagccatggtggtctcgaacagttgacctcatgatctgcccagctgggattacgggcgtgagccaccgtgcctggccagcatccatttgaatggttggatcatgagttatgtccatttctcagttaaataaatattaccaagctgtcttctaaaactgcctaaccaaaattatactctcaccaaaagataagcactcctatgtcctcacattcttgcattattttaaaaaccttggccaatctgatgaacatattatttttaatataataatgtcagcagtttgttattccctacatacagactcattatcaccagctgcccagagtggctgacccctgtgaaatgcagccagttgactggtacttatagctttagttttatttctacaggaatagagcctcaacctgcattctcagctcttcagagcatttccttgcttgggtaactcatgtcattgggttcttccactctgctgcagtcatgtatttttgctcattctagacatagacatttgttttctcttgatggatactcttgctcattcattcaataacttcttttttgagcacttataatatgtcagagacggccgggcatggtggctcacacctgtaatcccagcactttgggaggccgaggcaggcagattacaaggtcaggagttcgagaccaacctggccaatatggtgaaaccccgtctctactaaaaatacaaaaattagccgagcgtgttggcgggcacctgtagtcccagctactcgggaggctgaggcaggagaattgcttgaacctgggaggcagaggttgcagtgagccgagatcatgccactgcactccagcctgggcgacagagcgagactctatctcaaaaaaaaaaaaaaaaaaaaaaaaaaaaatcagacactgttcttactgcctgggatataggaatagacaaaacaaagactctgttcttactggctcaaagctagtaagtgatagaagtgagactaaatcgaatttaagtcatactccaaaacacccatgatccactgccaacactgtgagatgctgaaccactcacattgataggatatcccttaaaatgatctctttattacatacttttaagtaactatagttttgatagaatatttagatttttaattttacttttaaaataatggataataatttatatctcagaaccagcaaatttgaaaagaaaaaactaattttaaacatagaaagtgaaaaattagtattaaattccaataccaatggaacagttcactcaattagctgacagcattaaatattaaaacactattaagtgttttgttatttataattttttaaaaattacttaatttttaaaatgttgtgttgttttgttttttgaggcagggtcacactcctgtcacccaggctggagtgcagtcgcatgatcgtggttcactgcaacctctatttcctgggctcaggtgatcctcgtgcctcagcctcccaagtagctggaactacaagtgcatgccatcatgcccagctgattttttgtatttttagtagcgatgaggttttgccatgttgcccaggctgtcagcaggaggcctcagttcctcaccatgtggtctcctccagagggatgcttgggtgccctcatgtcatggcagctggcttcccccaaagcaagtgatccaacagagagcaaggagtgacagcgtcttttgtgacctagtctcagaagccgtacaccatcacttctgcggcatcctggaggttacacaggttgggtttattcattgtgggagggaaacatacaaggtgatgaataccaagaggcaaggatcactggagccatcttaggaggctggtgaccacacatgggacatggattgaatatggaaaagttcatgggaaatggtcttctgtctggttcaaatgctgatttggccacttaacaaattttcccaagattaagagccgttaagtttgtaaaatgaggatagccattctttattctcaggatatttcataaggtaaaataagatagtaaatgtaaagcacccaacataggacctcacacatgtttggaatttaacaaatagcatctatttgtgatgattattcttttaaatttagcttaagaccagccttcataaatacacctggcagaatcaatttactatattaagtaatcatttactatattaagttgatcctgaattgtttattatctaaaagtccagataattttgctgaattaatggtacctacagtatttaaactacctatatcagtgcagttgcaggatttgtgttgtttaaagcacacacacaaacacagcttgtatctgctatcggaatgtacctggaaagtcatggtcattatactgttttctagcaggattgtgcatctgtgattcacaagggctattgaaggatacagcactacctcctcatcgcataaacactgtaagaatctgcattcatctaggtactaacttctgtatctttttttcctctaacagatggaagtttactgttctgattttcatgctgaaagagcagcgagagagaaaattcatgaggaaaaggagcaactggcattgcagctggcagttctgctgaaagagaatgatgctttcgaagacggaggcaggtaaggaaaagagagaggaggacccagagctcacatcagcatggccgtagaagaggtgcctgtccaaagacgttcctgatttgaactataagaatagctgtgttcgcgccactgcactcctgcctaggtgacagagcgagtcccctgtctgaaaaataaataataataataataattgcttcacttacacttcatgtgatcatgttcccaacacttagtttgtcttacaggaaagcttgacagagacttgtgggagcttgatcaagctccttgcttttagataagcaaggattttgatttgattttaaaatgttgtgttgttttgttttgttttttgaggcagggtctcactcctgtcacccaggctggagtgcagtggcatgatcatggttcactgcagcctcaacttcctgagctcaggtgatcctcgtgcctcagcctcccgagtagctggaactacaagtgcatgccaccatgcacttgtaacaataatgttacgtgtcccaatgacctatcttgccatcgtcacggatgaaatattcgtagcactttaaattcctgaatattctttaaaaaatactaacaaaaattacttctgacttttagaaatttattttgagaaagttttaaaacacagcaaaattcagagaataaaataacagactctactatgtactccttcctgcattgacaactgcttttatttgcttcaagtattttttttttattaaaggaaaaagggagttgtagttagaatcaaagtctcctttgttccccatccatcattatattcctttcttctttaccttgtgctgttaggaatttggtgggtagcttccccatctattttatacttttacatatcacatacacacttacctatatcatatctcaaaaccagataatattgatttctctgtgtttaagttacaaaatgatcactgtaggtattgttctgcagcttactttacataatattatgattttgagctctcttgatatgtgcggatgtaatttattatacttcattgctgtattttgatttataaatatgccacttctttctaatctgtttcctactgatgacagtttggttatttcctgattttttttaactgtaattatttactttcactagtctcctagtgccaatagtatttaaaactaaaattagtctggtttttatgaaccttggcagtgtagtttgagtcttttttcccctacttctgtggactgtctgctcagtgttgtcatgtttcggggttgtagaacatcacacagcgtgttgcttttcgtcctggcaggcagtccttgatggagatgcagagtcgtcatggggcgagaacaagtgactctgaccagcaggcttaccttgttcaaagaggtgagtcccgtgtgatcctggattttcaggaaatagctatcctatgaaaaagatgcttgaagaaaaattccacttcattctctacaatggattccaaatcaaggcaccaaaaatatagcacccgtcagtctcattaccacagcactcccatctccatccattacccaccgaatccagaccagacccttcaccctgccagaaggtgcctggcacggccacactttttcttttttttctttttttttgagacagaatttcgctgtgtcgtccaggctggagtgcagtggcgagatctcggctcactgcaacctccacttcctgtgttcaaacggttctccttccacagcctcccgagtggctggaattacaggcgtgcaccgccacacccagctaatttttgtatttttaatagagatggggtttcaccgtgttggccaggctggtctcgaactcctgacctcaactaacctgcctgtctcggtctcccaaagtaccgggattacaggcgcaagccactgtacccggcctacagccacacttttaaaccgtgtctccctctgttctcttacagacattagccagactgaatcatccccttgaacttgtcctaagcttgtatttgcttgtattatgcccttcacagagacgcccttttcttatgcatattcctgtcttcctccagtctctttccagtgacctcttaccccatctttaaaatctatttcaaactccatctccatgaactgtttccattttgaacttccaaagtactttattcctctatgttggtacctgtctgctattttataggtgtttgtgtgttctaggtagatacttaagtactttatttttatttctatttttattttgagacagggtcccactctcttgcccaggctggagtgcagtggcatgatcgtggatcactgcaacctccgcctcccgggttcaagcgattctcctggctcagcctcccaagtagctaggactacaggtgcacgccaccacgcctggctaatttattttagtagagacagggtttcaccatgttggccaggctggtctcaaattcctgaccccaggagatctgcccacgtcggcctcccaaagtgctgggattacaggcgtgagccaccacgcccggctaatttgtattttcagtagagacagcgtttcaccatgttggccaggctggtctcaaactcctgacctcaggtgacccacccacccaggagaggtctcctagaacagaatgtaccttctcagaagcagaggcaatggtctcatttattcagcagatacttttgagtcctccaggatgtgcaagaggtactgcttatgctgggagtcagagagcaaaggcagccccggatgctgacccctcttctctggcaatggggtgattagaaagctccctgctttggaaaccatgctttatgatcaatacatacctcttcagaaatgcttcttaaggctgctgaacacaatctcaaatattcatacatgttactacatccaagtaatgtacttagaagcaaataaaggttgcctccaaaaacaaacattttgagagccaaaccaaagtctaggctgagtccaaaaaaccaagacggtttgcattggtccagaaaggtcagaacagagagatgcccgggagccagaaataatttcttgcatccatcacagtttgtatggatccaggacctagctagggtcagggcttatttcgaacatgctctgattgaggcttgaacctcagtactactccaaaactgggggaaatgatagggtgcattcttccatcattcctccttgttaactttatgtagataactcctgttcattctcaaggcccctctcaagttaattggtcgcatctaggaggcctttctgcaccaagatctaaactaggggcccttccctttctcccatggacacccttgcacctaacactcacctggcctaacactcgtgcctaacacttttgccacgccactgctgccacatctctcacctggcttctccaccacgtctgtctcccggcacacagcagtgtctttatacatcccagaggattcaaaagtgtctgctgaacaaatgagatgattgcctctgcttctgggaaggtacactctgttctaggagacctctcctgggctctgtggatttctttctccacattcccttcctcttttgcttatatcctcattcatcccttttcttctcgcagatatcctagtatttactagaacatgcattgtcctgtacctagaactgaaaccatgtattttcgcataccttgaaactgggatacagtttaaatcctaaaagaatgcaccaatgcacctgtaatcccagtacatgggaggctgagatggaaggatcagttgagaccaggagttcagaaccagcctgggcaacatagtgagatcccatccctacaaaaattttaaaaactagccaggtgtggtggcacgtgcctgtagtcgcagctattcaggaggccgaggcaggagggtcactggatcccaggagttagaggctgcagtgagctatgattgtgccactgcactctagcctgggagaaagagcgagactccatctgtcaagaaaaaaaagtaaagaaaagaaaaaaatcctaaaacaggccaggcgcagtggctcatgccagtaatcctagcactttgggaggccaaggtgggcagatcatgaggtcaggagttcgagaccagtctggccaacatggcaaaaccacatctctactaaaaatacaaaaattagctgggcgtggtggcgcgcacctgtgatcccagctactcaggaggccaaagcaggaggatcacttgaacctgggaggcggaggttgcagtgagccaagatcgtgccactgccctccagcctgggtgacagcgagactccgtctcaaaaaaaaaaaaaaaaaaaaaaaatcctaaaataatagggaagcaggtatcacttggagagatttttctctatgtgcatcgtgatgacttcagttaaagaccaaacacctgtgctcatgtcccactacgtgttgaatacgaagttgaactgatgttaaaactcgccatctgttcttcaagtgaaacaaacacaactgcctgcaaaatggaactaatggaattatcatacttattcccaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaa

SEQ ID NO: 37 - DNA, 289690 bp, Homo sapiens
  source 1..289690: mol_type = genomic DNA
atggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcaggtgaccgcgcgggacggggcgcccagttattgcgggggtgggcgtgagggtcgacaccgggctccccggcttggagagagggagggcctccgggagtcctgggttggaggtgggatggggggccattcggggcctggttggaaggtggggcgagctcgggctaggaacgaaggttgcaggactgaacctggtgtgcccgagagggtcctgattcctgaggggccaggaggcacgacgagtggataggttttggggggaaatcgaacaaggttgagatggattccattttttcaaatccttccttagtgccttggggtggagtggaagccgggaaatcctggcttctctggactgagtcgaggaaaaggagatctggtgggaaacctcccgagaagagggagtaccttttggcagccctgggcacacgctgggatggggaagagaagtggcatttcaatgagaggagtgaaaagaaaactcctcgagagagccccgaggggatgtggctgagattgtgggttaaatcacacagagtgtgagaagtacaaggagtttggtaatgttatggggacacggtggtgctcagtctcatttactttgtggagcatactaatgagtctgaagggagacactagacatgtccctcctgttctttgccaattgcattctacatcaccaggacacaaaatagctctttaatgtcccgggctataaaaaaaatttttttatagggctattagaagactggattctcaattctggattgaaagataaacgtggttaatttgggtagggaatgggaaaggtattgatgtcagctgacttcatagttttgaagaagaccttgaaacctttggaggttttacgatttggtctttgcccagaaaatactgctatgacatgatgagtctcacctaccaacagttgtgcagacttgtgcctaattctctcggagtcataggatgttagagggatgctaggaggactagacatcatcttttccaggggttcttaacctgggaagacttggaagattcttactcatagtaggtgatgtgcactttttggtggaggagagtcaatagttttcatctttgttttttttggaggagattcaagtcccagcttgttttaaccaccttattttatagatggggaatcagaagtccagagaagatggtgacttgggtaaggccacccagttagctaatagtaaaactagaactagaagcctggtcttctaattcctattcctgtgctgtctccattacaccactcttggaaatctctgcagtgctaaaagacttcctgtgctctgctccctgcttttcaagcctctgcctgacttcctgtgttagggacagagctgtacttaagcctagcatgtttgttgtatgcttcttggtctcctttgcagagtttaccctgttacttctgttgatttaggtaaagtgaccctcttggtgtttatttttgaattcttttgttttgtttgcctgcttttattttccattagaactctgtcaggcagagggattgtgagaagtaaaagctcagggccatggcaaaaaagacaggaatgtgggagacttcaggtgaggtgagctaatattggatgataaggagggaagactggatgtaggtgctggtgagcaggttctacttggtgtgtgtgtgtgtgtgtgtgtgtgtgtgtgtatgtattcatttatcatttctgtcaatcctagttaatagtgagacccccgtccctttccctcatttactcctggggcctattatctgttggttgccttcaaactggctaaagatagtgatatttggaaatggagcagtgtgtagggacttcgcaggggtgtgcagaggaaagagtggttaggtccttgggggtacaaattggcagctgagagttatccctccgagaatccttttttcacttcttgtattttattttctttctatacattctcttttttttttttttgcccaggctggagtgcaatggcacgatctcggctcactgcaacctccacctccacctccacctctgggttcaagggattctcctgcctcagcttcctgagtagatgggattacaggcgtctgccaccatgcccagctaatttttcttatttttagtagagagggggtttcaccaggttggccaggctggtctcgaactcctgacctcaggtgattcacccacctcagcctcccaaaatgttgggattacaggtgtgagccaccacacccggccttctatacattcccattgttgtaggtccattcccctatgtcatacaggtattcaaatcattgatttaggccctgccttcaactagctgaatggttctgcagaaatctttcattttggggcctctgttttccttagttgtaaaataaagtatgtgtacaagatgatttcccttgtaatccacccacctcggcctcccaaagtgctgggattacaggtgtgaggcaccgcacccggccaagttctaagttaccttctaaaagttataagtccagttcactgtccttaaggtgcatgcaatctatgtggggagacaaatgggcgaaaagttttttttaaagaagcgtgcatttttaaagaagtgtgagagtattacatgaatatacttaatgtttattcattgaactaacatttattaagcagctgctacatcccaggcactgttttaaccctaagagatataatagtgaacaacaacaacaaaaaacccttgctgtcatggaactaatattgaatggaaagagacatctaataaatcaacaactataattgtgtggtgataagggctaaaaagaaaaagcagggaaagggagagatggaaagggagagaatgaagatggttacggaagggctttaagatagatggcctatgagtgaagtgaggtaatgggccattcagatgctttcggaaagagggttcaggtagaggaggtgagggtgcacaggcattgagaaagactgcttggtttgtttggaaacaggagaccaatgtattaatagctggagcagagagagcaagggcaggtagtcttaggagatggtatcagtggtttagaaatatctataggccctatgtaaatacacactttaaaaatcttagccgggcgcagtggctcacgcctgtaatcccagcactttgggagactgaggcgggtggatcgcctgagatcaggagttcgagaccagcctggccaacatagtgaaacccgtctctactaaaaatacaaaaaattagccaggcgtggtggcaggcgcctgtaatcccagctactagggaggctgaggcaggagaatcacttgaactcgggaggcggaggttgcagttagctgaggttgcgccattgcactccaggctgggcaacaagagcgaaaatctgtctcaaaaaaataaaaaaaatcttatcgtagccagtgttttgggtatgtgggtttgtcttaaagtacacgtcttttttttctttttttttgagatggagtctcactgttgcccaggctggagtgcagtggcttgatctcagctcactgcaacctctgcctcctgggttcaagcaattcttatgcctcagcctcctgagtagctgggattacaggcatgtgccaccacaccccgctaatttttgtatttatagtagagatgaggtttcaccatgttggccaggctggtctcgaactcctgacctcaggtgatcgcctgcgttggcctcccaaagtgctgagattacaggcatgagccactgcacctggcctgttttcttaacacgttttctaactccttttgtgaagccttccctgacagcttagttcacaccattccgatcctactcttgcctcttggtatattgatgcttaattgtgtgtcatcttttattgtcccttaattgttttattattcttgtttcactgctaagattgtaagcttctaaaagataggaactatatttcctttgtatttatccttcgtaatacctaacagttttgggtacttggtaagtgctcaatgcctgttaaattgaaattgaaatttaccttttacagatagttaaggattaagaaaaattgtgaaattccagagtgagggtatcatcacagaattttccaggcactttgaatgtcaaaggattaaccgctttttatagaataagttcatttactggggtcattcccaaggctgcttactaaatggagctgtagtgctaagcgttagattccaaagttgaatcttgttaagttgtaccactaagcttttggagtaaatcatcacttaccaaaatggagtttaggaaacgccagagagtctgtgatgcttttgttataatccttaggctcagaaggaaccctaggagaaagagaggaagggtcggtgctttcaaaggcagtatacagaaacttgatgtaggtggaagaggagtcagtgcagccctggaaagagtacagaaatagagaaacgtgaaccagagagtaggagggaagtgacaaactcaactggaaagctgatgtacagtttgagaaatgtagttaaagagagtacttggaaatactgtactcaaagtttgtgggaagttaaatgagttaaatatagggctattagaggttcatttcactttaagtttaatatgtatgaaatttacgctctatacaatgtagtggggaatgaattcttttggtcagcttttctagtgaacaatttgattcataaaaattttatttttgtgcagttttctaagagtttagctgctgtataaggtaagatgtaccttattacttatagctttcagcagaattctttgtgtcagtgaaatgttgatatggtataattattatatggccaagtaaccgcttctcaccatagagtcataaatccagtttagccaagtgggttcagcagttattcctattagcagctgattctagtagtaagatgactttctttcaggtttcagggaaggggttccagatagcctgaagttgctttgtagatgctgtgtttattgaagtagtttatcttcccatttgcttatttatgggcttatttcctcataggtggatgtctctttgtgccctcatttggtatttggtgctgaaactaagcatggtgctaccattcaagaagagttataaaaatattgtgttttttttttcttgcaagtaatttcatgaacaatatttcactgaaattactgaatttttcatctctccctgtcccagtgtccttgggctgccacagcaaaataccatagactgggtggcttaaacaacagacatttatttctcacagttttggaggctgggaagtccaagatgaaggtgccagcagatttcatgtctggtgagggcccaccttctggcttgtggatagctgtcttcttgctgtgtgttcacatggcctttcctttgtctgtgccctgggggagagagagtcagtggtctcttcctcttcttataagggcactcatttatcatgtagttcccaccctcatgacccaatctgaagctaattctagaggtcctacctccaaataccattacactggggttagggcttcaacatacgaaatttagagggacacagacattaagcctgtaacactaccagagtggtaaatattgtagatggagaaactgaggaacagtcatgtaaaacttgttgcttttttccccatgtcttacaaggaagtctgcagatgtaaaactggaaatgtatttgagaaggagaaagtcagatctgatttcaaagtagaattattcttcagggtgactcaagagattagcttgagttgagtttgtctcccaactccctcccattttctagctactctgtcatttttttttcactatcacgctgacatgtgaacacaacagaagctaactagaaatttaactttcattttgctgtaaagcagactggtgcagacaggcctcaagtttacaggactgctgagaaagaaattgagttatgctactttgtataaacaagaatgttgctagtgaatctctagtttaacatctctcaggccttcagtttgatgtcaggctttaataatttgtagaaaaagacagtcattttagtaagcagatttctttgaatttttgttgatatacatttgtaaagcatagtaaacatctttattctggggcaaatgtgcacttccttcaaaggcaggagggaagaaccacagacatgattggaaggaaatggcagtaattggagcatgagcagacagatggagtgagggatggtgagtacatttggtgttttaggtggcccctaggagtattgagtttcttcttattctcctctacaaccccaatacaagcaggcagcttacatggctaaggtttcattatctaatccatcacagatcagcttgaataaacccattggctgatgctgatctagttaggaaagtagcaaagctgcttgagccaggattgggacaaatcggatcagaactgccatgtgaatcctggacgcatttctgtaatttgggtgggcaaagtagtttgggaagtcatttactcaagagaatgagcagtcagccatgagttttttcaaacattgtcttagggactctgaggggaaagtgtgtggaggatttgagatatttctctggaggatagccagattgctttgattatttgagtctgaacattttttggtcactaatgctcagaagtgacctttttttttttagtagcatttggagattccagttgtgatcgtttgtcacttttgtgagtgatcccttaatctgagaccgtaggatatatgtcccttctctgtttttattttatttttattttttatttttattatacttcaagttctagggtacgtgtgcacaacgtgcgggtttgttatgtatgtatacatgtgccatgttggtgtggctgcacccattaactcgtcatttacatcaggtgtatttcctaatgttatccctcccccctccccccaccccaggacaggccccattgtgtgatgttccccaccctgtgtccaagtgttctcattgtttaattctcacctatgagtgagaacatgcagtgtttggttttctgtccttgtgatagtttgctcagaatgatggtttccagcttcatccatgttcctacaaaggacgtgaactcatccttttttagggctgcatggtattccatggtgtatatgtgccacattttcttaatccaatttatcattgatgggcatttgggttggttccaagtctttgctattgtgaatagtgctgcagtaaacatacgtgtgcatgtgtctttatagcagcatgatttataatcctttggatatatacccagtaatgggatggctgcgtcaaatggtatttctaattctagatccttgaggaatcgccacactgtcttccacaatggttgaactagtttacagtcccaccaacagtgtaaaagtgttcctatttctccacatcctctccagcacctgttgtttcctgactttttaatgatcgccattctaactgttgtgagatggtatctcattgtggttttgatttgcatttctctgatgaccagtgatgatgagcattttttcatgtgtctgttggctgcgtaaatttcttttgagaagtgtctgttcatatcctttgcccactttttggtgggattgtttgattttttcttgtaaatttgtttgagttcattgtagattctggatattagccctttgtcagataggtagattgtaaaaattttctcccattctgtaggttgcctgttcactctgatggtggtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatgcttttaggtctaacatttaaatctttaatccgtcttgaattaatttttgtataaggtgtaaggaagggatccagtttcagctttctgcatatggctagccagttttcccagcaccgtttattagatagggaatcctttccccatttcttgttttttgtcaggtttgtcaaagatcaggtggttgtagatgtgtggtattatttctgagggctctgttctgttccattggtctatatctctgtcttggtaccagtaccatgctgttttggttactatagccttgtagtataatttgaagtcaggtagcgtgatgcccccagctttgttcttttggcttaggattgtcttggcaatgtgggctcttttttggttctatatgaacttcaaagtagttttttccaattctgtgaagaaagtcattggtagcttgatggggatggcattgaatctatagtttaccttgggcagtatggccattttcatgatattgattcttcctatccatgagtcccttctctgtttttaaaggggagatatttttattactaaccttaatatgtaatcatatttgttatccatatatacttgaaatatggtgtagtaaataaacaccatttagagcttctcattttgggatttgaatcctggcttctccatttaccaaatgaatgagctattcaacatctctgagctcctgctcacacatctgtgaactgggagaattaatgtatactcttataaaccactgtaatgagaactgagattctttaaggtgcctatcaaggaacccagcactacatgtttatttcttgctttccttatatcctgctatacagcactcactaacttcctgcttactgtttaatctgcatggagtggttaatgtgcttctgattgattaagtgccagagttgggaactactagagatgagcagtgtgttaaaggggaaacctcatttgctcattatccagggtggaggagtggaatgaactgggtcattgtggtctctcttgtcagaggaaggggagacaattctttgctaaggagtgaaaggactgctgcagtatcacagtgtctgcaggggggatgtggatttcttagaacccgtgggatctctgttgggagggtgggtgacagattcactggctgttttagtggtacatggaaggcaggaacagtaaaaatgtcgtgtttcaaattttataagttttgttacgtatgttggttcaaaagtggcactttttgttctcattttgtctatggaaattgagctgggatgcctttgtgttgtctcttgtggtcccttttcagtctcttcaaacccgctctccagactgctaacacagtgatctatctaaaagagccaatctggccaggtgcggtggctcatgcctgtaatcccagcactttgggaggctgaggcgggcagatgacttgaggtcagaagttcgagaccagcctggccaacatgatgaaaccctgtttctactaaaaatacaaaaattagctgggcgtggtggcgcatgcctgtaatcccagctacttgggaggctgaggcaggagaattgtttgaacccaggaggtggaggttgcaatgaggagagatcgagccactgcacttcagcctggatgacagagtgagactctgtctcaaaaataaaacaaaagagtcaatttgttactccacgcttaaaatcttttgagagcttgtgttttttctcaggattgtctgttctcttgtttggcctgacttctgcgtaactttcaagctccgtctctttccacattccacctccaagtccatgtccagtggcttatagttttcttagcatgtggtgccacccagctaatgaatacctctgtgcttttgttcctttcccttctacccaaagttcctgcttcatctcttctacccccacatttgtaaggctcaatctttaataatgagtttggatattgattcctcctggatgccttttgtgactattcccatgtctcccacactcctgctgtcttccaagacatcatgtctatagctctgttaaaggactttttagattaatacttgattgaatgtctgccccaccacgcttacccagactgtgagatccttaggaatctgtaggattaagcaccatgcctgggcccaagtagtcaagaaactgtccatttttgttaaattgaactttgtcttcctgcttctcagttggggcctgcagatggctttaattgtttatccagattttccctggggggtctggcccttggtctgctttctatcccctgtgaagactgcatgttgtgtgatatgtgaatgttaacctgatcttttcattgatatcagggttaaaggtgagagaggggtctctgaaaacagaagctggggtagaatttaactgcagaatgtgttgggtaggcatagcaacctgatatttagtttcctgtgttcagatattaattgagtgcacgtgtgtatatgtaaaaagctcctttgtgatagtgtggttaaggagaaaagaggaaccacacaagtgagagaggcaattagagccaacctgttccagttcgctggagcaggctgttgatttacctttttacagtgctgctgcaggattctggagtgtagcagttcgcatgtattaccaccatttggggtgagaactatttgatcagctagggaccttaacctttctcttctcaaccagtgaatttcatcggatactatagctttattttttattttttattttttttgagaccgagtttttgctcttcttgcccaggctggagtgccatggcatgatctcggctcactgcaacctccgcctcccgggttcaaacaattctcctacctcagcctcccgagtagctgggatttacaggcacccaccaccaagcctagctaatttttgtatttttagtagagacagggtttcaccatgttggccaggctggtctcgaactcctgacatcatgatccacccgcctcggcttgcaaagtgctgggattacaggcatgagccacgtgcccggcactgtaacatgtttttatggatctggggaaaataccaagcggagacacttcacaatacatggtatttttcacatcactcatattggatatgtttgaaaataaggaagtctgatagtgttcctttaaatctcagccttggcgatagattcatagaagtattttataagaattctctctggctgttgttctcccctccgacttcactttcagcttctggtttggggtcctgtataatccttgcctgttccagccagtttagtagggacctctttagctgcaaatgattgtacttcatagtgcctctggccttttctattctaaatgaataaagagaattctgagaagggaatgagagagagcagcctgtaatatatcacttccttctgacatgtcctgcacttacgtggcatctagaaatttctgccaaaaattcaaggcacaggacacatgataaataccacttatgaagtagatgacattcttgaattgtcaaatgatggtgatggaataactgcttaaaaacctgttttcccaagggtggaaaacagcctttgaggtttagacttccacatgggtgtgttcagccataagacgtgggttttcttagggacttaggtccccaggtaacaccttggtgtgtgggatttttcccatgtataggctggttccttggtttctccgttgttgaagaagagagattttgcactgggtattggatattttattccaggcatgtggtttttgaggaggcatattgttgatgtattttttttttctggctgcattgatttttgtcagattctaactggaaataccacaagcaaagcatgatttatcatgagggatgggtggtgtggccgtgggactctcctagctctggggattggggtggaggcagaagctatgtgagtaaaactagaggaactacagacagggcctggggagactgggggtgtctgaatgtggcctgcagcagttgcttgagttggaatacttttgggcagaggctcatagaaatttctttcaattgcttttttttttcttttaagaagctttttcccatacaaattggaattgtttgaaggagtgggccttaattgttgccagccagagtgattttcaaagcagatctatatggatttcacttaggggttactttcagggggtatgtggcttgttctgagacaggaggacgttggttccattttcctggaagttgttgggactcctggatggccctgctctatttgtcttgggccattaggcaagtggaaaagcagctacatagttagccctgttgcatggagtttagtttcataattcatcctctcagggatttttatacagtcacacttacagcctaaagtttgttttctccctttttctttcttttccttcttcagttcagtggtccacaaaaattcttgggagggtaagtaataatttcgggtaaaaggcaggaattgtagatctttttttagccccctgccccgattaaatttctccatattcagcttctccttcatctgcaaaagcatctgcaaatgaggtcgctatcccctaatcagactggcttgtcccctaattagtctgaatatgtggctttgacagctttcacctgctgtttcttagtttctaggggataagataggattgtgtgatttcaaagtgaaaactggcaaaattgaaagatgttttgtggtggctcccaacatccacaaagcttaactcattggtttgcttctcatatacaagcttccaggaacatggttactgttagtggctggcacagtgggtttgaagactttgttggaacttcaggaagtttcccctttggcaaagcttacagggagttggtagtacttgtcctgaaagtctgaccctggtcttatgctatgcacaccttgtttaaaagaatgcagagtactgctattcagctattgcttaagcagtccgtttcatatatgtctgcattagttacatacttacataagattttactatgttttgtgttatatttgaactagaagtcatagtttcatacatgactcttattaagctgataataaattggcaaattttgatatcatccaagactttgaggtaatgctggtcatactcaaaaggtctgtatttgggtttagaaactaatttttctgttagctagcgcctctccattcccaggtgctgttcattactcattatagacatcttctgtccctctgctttgttaaaagtctttagctgcttgtcatgatactgaatagatctttttgcagcagcattttagctctgagctggctgtgttttacagtgttggagatcagttggttaactttggcatttcctaccttcatacgtaagcattaaagtgtgttaagtgcatgtagtagcccttcagagaggcgcttatcagggacttctagtgatttttgtcagctgtataaaaatgctatgattaatagataacctgtatctgtgtgtgcatgcgcaattttcttttatgcttactctgcgtttctttctctaggagtggtgtgaaataagtgttactctgtaggctttgctttttttcaataatgagaagcttattttaagaatcccttatttgactttcttgagtttggtgtaggtatcatttaccccttttggattttagctttactatgggttattttttgcagtgttagaagcaagtagtaaatactttggtatccccgagcttaaagaaacctaaaaattttgactcattcagcattctgttttaagttaggaaattatttaattctagtatcccaagctgtattgtattgattgctctttaagaaatgataacaggtggccgggcgcggtggctcacgcttgtaatcccagcactttgggaggctgaggcgggcggatcacgaggtcaggagatcgagaccacggtgaaaccccgtctctactaaaaatacaaaaaattagctgggcgtggtggcgggtgcctgtagtcccagctactcggagaggctgaggcaggagaatggcgtgaacccaggaggcggagcttgcagtgagccgcgattgcgccactgcactccagcctgggcgacagagtgagactctgtctcaataaaaaaaaaaaaaagaaatgataataggtatcatcctgcccatgccccagccccccaccaaaaaaagttaaataactttggacattagaattaaacacattaaaaaaaaaacctatcacactacacttttcataagcagacgttgtgatgctgaactattgtgtagcgttttccaaaccaggatttacgcccagattccctaccggtaagttaattcctaactctaaattcataaatacatatgtaatgaaatgtctccttttcatttctgcttcctatgtgtccctatcccctttaccaaacaagtaaccactgttactaatttgtctgttatcccccctcctttctttttgacacaaatattagcatactctctgtattttttgctccttgcttttctccatttcctatatcagaggctactttttcaaatgtaaaaaggtctattaaagttttcattagtggtctctctctctctctctctctctgtgtgtgtgtgtgtgtgtgtgtttgtgtgatgcttagtgaaggttttaccactctgagattataaaaaaatagaatggccttgcagacagacaaaccttaggtggtgtaccagcatttccacttcacagctgtgggatcttggttaagtgacttaacttatctaagcctcagctttctttgtaaaatgtgttataggattagtgtaagaattaaaaagcgatactgtatgtaatgtgcttagttcagggcctgacacgtagtaggtattctattatgtaatagccatttttattattattactcagtcctattttcttattcttgtccccaagtgctttttgaattctttcttaaaggcaggaacaatctttttcttttagagggtctcactctgtcacccaggctggagtgcagtggcgaaatcatagctcactgcaaccttgaactcctgggctcaagcagtcctctgcttcagcctcccaagtaggtgagaccataggcatgtgccaccatgcccagctaaggaaaaatctgttaacttttgtagccttgtgcccaggatataatataataagaactgagtagtccgggctcagtggctcacacctgtaatcccagcattttgggaagccgaggcgggcgaatcacgaggtcaggagtttgagatcagcctggccaacaggttgaaaccccatctctactaaaaataaaaaaaatttgctgggcgtagtggcagacacctgtaatcccagctacttgggtggttgaggtaggagaatcgcttgaatttgggaggcggaggttgcagtgagccgagatcatgccactgcactccagcccgggtgacagagtgagactctgtctcaaaaaaacaaacaaaaaaaagaactgataaatgtttgttgaaaaagatatattagcccttatacaatctatttttttaaatcttaataatttgtgttgctttttctatagtcaccctccagatttgaagcatggtgactaaaattgctcgtaatactcaacaattacatttatgttattattatttttaagagatattcttagtcactcaggctggagtgcatcactcaggctggagtgcagtggtgggatcatagctcactgcagccttgaactcctcaagcgattctgccacctcagccttccaagcagctgcacccagcttccgtgttatgttttacagtttataaaatgctttcgtgcaggcccttatttattctcttcaacaaccctgaaagataggtgatgattcttcccatgtttcagctgaaaatatacctctctaagcctcatgactaggaagtggcaaagctgatgcttttacccagatcttgtggctctttatccagtgccttttcatggcccttaagactgaaagggtatgactgatgaggaatggagcaaaaggaatttcattggtttggcatgccgtatatttaatattgaaaacattttacctgttacctgacagctgattcatgtagaactgggatgacagttgtggtatgcatgatagtttgtcgttgttttttggctttttttcatctcaaagttattccatctctaatttagatcaacaacagatcaatcagtggattgataatggtgggtagtataaaatcatcagagctgaaggcatctagaaattatctgtaccagccctctgctttagtcatggaaaatagtcagtatactcatttttatagacagtgtatctcaggctcagagagagaatgtgacaacaaacaataaactcagactttgtctttaaggctcagtagaatctttcatttcttagtctttttatttcttggtgtgatttttttctgacagtttcttgtatggagtattttcttcttccttttacattttcttaatgcatatatattcacatggttaatgattcaaaatatgcaaaatgtagaagagtcaaaaatctctccctctcctagctgcctattttatctttttggaagtaactagtattgttagttatctgggtgtccttctagagacagtgcctacgtaatatttcttttaaaaactccattgacagtatgcgtactattctgcactttgctttgcttttctatttggaaattatttcgtatcagtttatatatgtatatatatttttttctatttattagctttctggacttaagattctggtctactgagagaaccatgtccaaatgtcccttgtaaagatgactgattagtacaggacctcaaataatatgattctgtgttttaatggaatcatgaaatcccaggattggagacctaatctacatctcttgttttttcacgtgaataccctgcagatacctgatgttgctaccttttagagatgtctgagtgaaagataggtatcctcgtctctccatgtgccccagtcagctgcccctggtcttttttgcactggtggggcacattgtgggtcagctatcgtatatgtcattgagttagtaattatactcaggatctgccatgagtcattgcacatggaatctaactgcagtgtgagttttattcatgatgacatcttgtataccagatgtttcccagatgcctaggtttatcctgattgagtgtcactgctgtcaggatgctgttcagtgaactaagttttgtgttgaattgtgagaaaggaaggtttagtttctaataggtgttccatctcagcagccataattgccactggctacccttaacccctctgtctgtggaaagccccaggattgagtgaatgctcttcttccctagggtatggcctctccgtaactgagacttgatgggaagtaagtagatttggctcaacaaatagagaatataaacacacgtgtgtgtgtgtgtgtgtgtgtgtgtgtgtgtgtgtgtgtgtgtgtactgaacagtaattggattctgattcagatgtggagttaatgatatcaaacttaggcttgactctagcacagttaatctttatagacttccacatttaaagatatgaaataaaatgtgcctttcggagttggcttttgcaatagccctttttctccgtgagaatattatagaagaggtagtattctagctgtttagagaatgagaatgaggccagtggggttgtgtctcactctctaggtgaatgtcgacctctactcagttctaatctcaccgtgcagtctttgtggtcccaaggctctgcagtaggtgaattaggcccgcgcagtctctgtggcccgagtcacagaggaaggtgttcctttcccaagtagtgaatggaagccggcagggcaccagatgctgtgttgtttcccctgttgctttttccttcacacccggtgtaaagtttccaggcatttgtgcaacctgatagcagaaagcgcctgtcctagcagtcgagagatgggttggcaggggctcaggttactccatgtccctgataagagccatcgatctgggctggtggctgctgataggtgggaactatactgcctgcattctacccagcaggaatgatgtgggtctcagtagtgtttcaggactccgagaaggtacccaggcaatttagaggtctggccagcatctctagggcagcagcacacactaagatgtagattttaccttagaagagatgggttttaggaaatggtggcacacaggagcggaagaagtaccagcataggaaaggtgaagtgccaacccgaggagtggaaatggtattttcttattccacctggtaacctaaaactcagttgcgcagtgacttaaatttgcagaggatatgtacatagataattttaatacactgcttggatggaaatagtcacagaatatatgtgaaagtgtagtggcaggtggctctgtggtaatagatactctgtgaatacctctgtctgagcagttatcacactgtattaaaatatttggttaagagggccctttctgtctgggcacagtggctcatgcctgtaatcccagcactttgggaggccaaggcgggtgggtcacttgagcccaggaatttgagactagcctgggcaacatggtgaaaccccgcctttacaaaaaaacaaaaaacaaaaaaaacgaaacttagatgggcatggtggtgtgtgcctgtagtcccagctactcggtaggctgaggtgggaggacctcttgagcccaggaggcagatgctgcagtgagccatgattgcaccactgtactccaggctgggcaacagagcgaaaccctgtctcaaaaaaaaggaaggccctttctggtaccagaaattctgtctctaatcttacttagctgtgtgtcctttaggcaagttacttagcccctctgtgcttcagttttttatttgtaaaatggagataataaatgaggcttgtactaaatgagtcattacagttttttgtgttatctgttgttatggtggttgttatagcacaaagcacgggcgccagagaccatggcaaacacatgatgactggagggctgcagagttcagtatttattgtgttcactgaaagacttctagtattaactatgctgggtaccatacagaagcaaatgcatgagatattaactgtgtgactgtaaaatatatgacgagagtcagttttttttgaagctgtgtagaaagaatattgatgtgagaagtttcagtatcctatggcagtttcagagaaggaatcttccttctttcctttgggaggcccttcagctttcttggtgttttgaagatagattgtatattttactttaaggtaggacaatacttaactatttcagacaggtatgaatctttcctttttttttcttttttctttgagacagtgtctcattctgtggcccaggctggagtgcagtggtgcaatctcactgcaacctccccctcccaggttcaagtgattcttatgcctcagcctcccgagtagctgggattgcagttgtgtgccaccacgcccagttaattttttctgtttttagtagaggtggggtttcactgtgttggccaggctggtcttaaactcctggcctcaagtgatccacctacttcgggctcccaaagtgctgggattacaagcatgagccactgctcttggcccctattttttgttaaacctctaggagaaaccattttagatcagaatcaatccattcatccatcctttcttcctaatctctcttcctttttctctaaaagggaaaaagtgctaacattttaaacactttggttatttatatttaatgtaatcctctcttattgtgtaacagccctcccccttcttttgcttggagacaaaatttgattgaacaaaatttgaatgtttaccacatgttaaacattgctagatgctggggttagttacagagttaatggaatgttcttataaaacttgagttttggggaaggtttatggaacaactataaaattagaataaaaatttgataacacaatggtttgataagggtgtgagtaaagaaataggaactcatattgctgtggtggtgaaaagtcacataacttccatgaagaagtatttatcaatgtctattaaaatgtaaaatgcacgtattctttgactcaacagttccacttccaggaatttatcctacagatgctcttgcatctgcgtataagaatatacattatagcattatttgaagtagcagaaggttgaagaaacaaaaatgctcgttgacaggaaatctgctaaataaaataaggtacattcttgatgagaaaaaaaaaggtacattcatacagtggaatatcatgtagccattaattaggcagctctgtatgaacatagaacactctttaaatatatcaattgtgaaaatcaaagtacagaagagtgtatagtttgctgttatttgtataaagtaaaaaagtatccgtgtgtgcatagactctgccaggaaacacaagactccccagcggttgcctcctcggaggagcattgagagacagaggaataagggtataggtaaagacttaatttttattgtatataaaaaaatcataccaacaaaatttgttaattgtataccttttgttccttttgaattttgtattacatgcatgtattacttgttttaaaaataaaataatgtattaaaattacacagggataggtactgtgtaaacatagggtttatggtccttaaacttgctaattttcatagaaatgagtcaagttgtgtgttggagaaaaagtatgccaattctgcttaccacaaataaaaaatagtacttgtgtggtggcgcatggtcattttgtcattttgattttgtgtatgacattgtttattctatgtaggatattccagtacttatatttacttattatgtatttatattatatatatttatatgtttgtatattagctatgttttcttacattttttatttactgaaagtgctgatatggaggggtagataagagatgattaaaaatggaaagtacattagaaatggtgaatgtgtatacaagatgaatcattcaacaatacaattataaagggtcaagtgcaaatcataaagtggattgagaagaagcaaaatgagtgagaatcactaccataagcctctcccttgttcttaagaaatgtcccctagctagacatgcacccatgggttacttggatttttttcaccttggaattttatgaacaaatggacttaggagcagcctttcattacagaacctaacttggtggtggatagaggagtgtctgtaccaagccaggatgagtagtgcttctatgggagcataatggaggaattgagggattcttatctggctggggtgggatgggcatttggagaacattctgcagaagctgttgctgcgtattgagtggataagcagggcaggtcattctagacaaaagaaacagtatgtacaagggcaaggtatgagaggaactgcaagtgagtcagtgaggttggggtggagggcatgcgagcaagggatttgcccaaagtgtcgttggtagttagttcatccgcacactgctgttctcttgcaatcatgtaggaccattgttcaccaagctggctgggcactggtgattagattctcctaccacttcagaaacatatccttataagggtagatggaggaatatagtctttgttcattaaggaaaaaaagagaaagcaaaaaagaacaaagaaaatctgtatttggttatgttgtacatatgtagttgtactgacttccagcagactatcttattttctttttctcatctgtctgcatccttcaagaaactttccctctatttggaaccacaggttgagtgccgcatggacacaacttgaatcttatgttctgtttgattatatttgaatttacatgaagcactttctaccatgcaggcatgcattttgctcttcatagcatggaatgctgtaacaatgttgttttgtccattagaggctttcaaaaatttttatcaacatttaagtgcttaatttctacagtataccagggctggcagtaggtaggcaggtgatattttattcacataccctatatatttgcacattttgattgctcgttctgttaattaaggagagaatttctcttttgtagctgaaatgttttatgctttgaatccactcaaagacaaattattctggaaagcttgaactaaacctggtcagatgcttctgagttatgagagagggattgaaataaactttttcagctaaaaataattttgctcacaagttaccaaaaatggctgactagaaatgcttttaagatacttgtctaagctaccataagctaaaggtcaagaaaaaagtttagaacacgttatgagaaacgattggctctactttgctaaagcttttgccaaacctcttattctgtaatgaccacatgagacaaaagctggtgaaagtggtatgccttagattcagtggggacctagagattttttcagtggaacacatgtgctgcctatctcttctgacgacgaactagtacctgtggaaggcactagggttaggtgaaaatgggacacttcattctgaagctgttatacaattgcctatgccaattaattatttaaagcttttatcttctgttgcagagcaatttttgccctcagaatatttgtcagtcctcacaaagtgccaagtgatgggtatttagcatgtggcattgccgtcagtgttctgtcattttgtttagacacttctttgcatctcactgaattgcagaattaagaatcgttcacatttatgggcagcacgtttttgcagtatggtcatttatcattggagtttatattttatgcttccttctagactcttagtgtgctttcacgattatccagaggattcctttgcagcagcagtgtatgccactgattggtggtggtagccttgagaaactagggaggcatgttgactttccttaaggttgcttagtattgtagaataaaatcttgaattagagtaaaattcagagagagctgtttttccccgtaaacatcattcttttgaatacagccagtattaagccaggatgcgttttcttcctaaatttaacacgtatttattgagcatctaatgtgtatgaggttatgagaagggaagttgaatgagcttatgttagaggaactcaacctttcctcagagaatgggagtctgcaggcagaggtggtggtgttgacacttcgaggagagtgagaagttttagaagtagctgctgttcctatgtaataaggattcatcaagaagtgggatgaaagggttgctcagtctcagtaagtgccagctgggattgagttggtcctgatggtttaacttttttttttttgagacagagtttcactcttgtcgcccaggctggagtacaatggtgtgatcttggctcactgcaacctccaccacctgggttcaaatgattctcctgcctcagcctcccaagtagctgggattacaggcacttgccaccatgcctggccaatttttatgtttttagtagagatggggtttcactgtgttggccaggctgatctcaaactcctgacctcaggtgatctacccacctcggcctcccaaagtgctggggttataggcgtgaaccacctcgcccagctgtttcttaactatcagacagtacttggaagcccatgagtgtagctgagtgcacgttacctagtgccaagtgtcaataaactgagatgaatgggttcaggtagaataagggcgtgggagaaaacaaaggacagcaggagcttttcctacgagtttgagatcttgacgttagaagagttttgggtagcaatgatgtgtaaggatccaatggatgagtttggtgtaggtagtgccccctggaaataagtaggttgaagaacttggagtctcagttttgaaagtgttgtcaacttgaatgttgaaacgatctaggcctaagcattgaaactctgggcaaattgggagaaagtcatggaggttggggaagtggaaagaatgatgtataagtgggttaactcagtgactctcaactgggggtgattttgtcccctcagttgacattggcaacgtctggagacatttttgagttttataattgtggaggtcttactggcatctaggggttggaagccagagatgttactttaacatcctaaagtgcacaagagagtctcccacaatgaagaattatctggcccaaaatgtcagtaatgctgaggttgagaaccctgcattaactttaaaagaacagttgttgagtaaaggcaacagttgttgaatgtgactgtttctctccccttctactctgctttgtagaactctgcacatccatttattcttccacttagtgaccatttatggagctccatttatgtgccaaggcaccatgctagatagtcattaggagtatcaaattaattagatgtcacctctttcttaaagtttatttttgttttttcccccttagttatccttgttctgattaaagtttatttttaactgtgaattaattaatatgcaagtatattcttaccaaaaagccaaaaactcaaacgtataaggccagtgaccactttgaccaccacctccaatatctgttcttttcctagaggtacccagtactgtcagcttggtatgtgtagctggacatttgaaggttgcttccctacatctaattttttcccccttttttatgccacgctaagaagtttaattttgaaaatttgtcctaggctgcaagtttcttaagatagggaccaggtgtttggtttttctttttgaattattacaatacatggtacacagttgtcactcaataaatgtttgctgaataatgaatgaaatgaatcaataaaagaatgaatgaggagcaaaaagaatgccaacgcctagtaatggccttcaggctttggaaggctgcaaagtatgtttatgggaagaatgagttaatatcaggatgtgaaagaagaaaagggtgaaggaaaattccaacttgtaggaacagagaaggggttaccagcaggcccagttgataagctggtcagaagacaaagttgaagtttgagaaggaacagagatcttcattgtataggggataagagttcaaggagtgtcttttgaagaaaggaaggtcttttgaagaaagtaattgcaagttagcgattggaaaaacttactaaggtaggagctgcttagaactggaagagtccgggctgggcgtggtggctcatgcctataatcccagcactttgggaggccaaggtggggggatcatctgaggtcagaagtttgagaccagcctggcccacatggcgaaacccccatctgtacaaacatacaaaaaaattagctgggtgtagtggcacatgcctgtagtcccagctactcaggaagctgaagcagggggatcacttgaacctgggaggcagaggttgctgtgagctgagatcgtgccattgcacttgagcttgggtgacagagtgagactccgtctcaagaactagaagagtcctgaagttctttctggagtattggtgtgatagaagcattagtagtttcttttatgttctggagaacttctgtgcacataaatgtttatagatatataccccgtttgtataccaaaggaatcttcattatttttcactgaacaaaacaccttagagaacatttcgtttgttttgccaatcaatctaattcttttaaatgaccacatagtatcccacggtaagtttttttgtttgttttttttaaaatcatgatttgtttaaacatgtcctattgctcgacatttaggtcgtttccagtcttttgctatttgaaacaatgctgcttgtatgtatgttgctgtgtgcataagataagcacaagaagacggattctgagaagtggaattgtgtttctaagggtctgcacattttaacttttcataggtattgctgagtatcagagggacatttttctattatgttaccgtactttcatttttcacaagccgaagtgaaaaatggtatcttggctttttaatttgtttgttgttgttgttgttgttttcttttttcttctgtttttgaggcagagtctcactcttgtcatccaggctggagtgcagtggcacaatctcggctcactgcagcctccgcctcccaggttcaagcaattctcctgcctcagcctcccaagtagctgggattataggcgcctgccaccacgcctggctaatttttgtatttttagtagagacggggtttcaccatgttggccaggctggtctcgaactcttgacctcaagtgatccgcccgccttggcctctcaaagtgctgggattacaggcgtgagccaccacgtctggcccggcctgtttttcttttcttaagacaggatcttgccctgtcgtccaggctggaatgcagtggtatggtaataacttactgtaaccttgaattcctggactcaagccatcctcctgcatggacctcctgagtagctaggactaaggcatgcactactatgcctggctaatttttaaattattttttgtagaaacagggtcttgctatgttgcccaggctggtctcaagctcctggccttaagtgatcccccacctcaacttctcaaagtactaggattacaggcatgagcccctgtgcctggcctaatttgtatatttttagtttaagggaatcttttaaaaaaacatttctacaaatcatttatatttcttttgtcataaactcaggttcaaaagaattgtttttttcttattgatatgtaggaactttttataaattaatgaaagtagtgtttgtcattcatgttgcagtttcccattcagcttgtcacttgtcttttggatttgtttgtggtgtatacatgtatgtgtacatgtatatacatatagtgtgtgtgtgtgtgtgtgtgtgtgtgtgtgtgtgtgtgtgtgtgtgtgtatgttttggggccagagaaaaacatttgaatgtaattaaatatataaagtgtttattttaaaactcttggatcttctttctgagaaggaccttctttactctgtttaaaaatagctttctgtgctttcctttagtactttaatgggaaaaccttgggtttagttttgatgctatcatttattagttttgtgactttgtgcaaatcatataatctgtcagaacctcagtttcctaaactgaaagggttagatcaagatgatctgtaacagtgtaaagaactttcatttctaaaatttcttctttgcttttgagtaggatttaacttttgtgttatgtggagatagggagttggagacaggttaagggaaagatgtcaagaggcaggcaaaagcagaaagaatcaggactgtgaacaaatgaacaaacaaaaaagagccccgagaggatagaggaaaaacgaaggaaaacagatgggaggtagatactgagaactccggtggaatgcttttttcctatcacaggagataaaaaaacattcccgggtaccttgttcattcaccttcccacccttcgtctctctttttttttctttcttcattccatccctccctgatttccttccatttttttctttttcttagaataaagtcaagtgtaatacaaaggctgttaattagcaccaatcatgaagtgcaaaagttaaagcttcaaagtcttattcatgttgcacatatgtagtatttaaagccaagtgccttgaactccttggatacagtgtgtgttggaattgctattgatctattgtctagcaatccctctgagctctgaaactttatgtttaaacatagtgtgttttagcattgttataagaaatacaacttttgggccaggcacggtggctcatgcttgtaattccagcactttaggaggccgaggttggtggatcacctgagatcaggagtttgagaccagcctggccaacatggcgaaaccctgtctctactgaaaatacaaaaattagccaggtgtagtggcgggtgtccgtaatcctagctattcgggaggctgaggcaggagaatcacttgaacctgggaggcggaggtaacagtgagctgagatcgtgccactgtactccagccagggcaacaagagtgagactccatctcaaaaaaaaaaaatatatatatatatatatatataacttttatatttcttgatttggatgttaaatatgtaaagctaatgatgcattcctgtatgttttatatttcatgtctaagacaaaagttccccctgtaaattatgccttcaagaaatctagtttctgtctttggatacatgtcgtctgtgaaacctcgagctaggatttgtaacttcttccctgtctgcctctgtctgctaagcatggacagtagtacctatgcaacagtgtgtgtgcttaaccaaaatcctcttttttcccccatgaacatgggctatctttctgtttatgttttcaatttctttgatcaacgttttgtagcttttagtctacatatctttcatctcctaaccaaaattcttatatgagaagtccctctaaagtataatggtcaattattttcatcacttatttttatgtttttttagagacagagtcttgctctgttgccaggctgtattgcagtggtgttatcacagttcattttaacctccaactcttgggccccagcgatcctcccacttcagcctcctgagtagctatgacaacaggtatgccactatgcctggctagttctaaatttttttttttttttttttttgtagagacagggacttgccatgttacccaggctggtcttgaactctcggcctcaagcagtcctcctgccttggcctcccaaagtgctgggattacaggtcatcacttattttttaagattcattttgtacgttgccattagaccataattattattaattttttcttgttgtcttggttggagaaaaaaaagtaaaaaaatcccatggttactaccatgagcacatttgagttgaatacattctgaccttttagctcatgttcatctcctttcacagacccctttttaccctttcaacctcatggatactccagagctggcctgggacattctcatctgttggcttcctcatgttgcccttgaaaacagacgcctagacttattaaaatcattgttgattatcatggcagtggctgccactgtggctaattggaaaggaagttattgtggtcatcagaaatactgaaggagaaggggatgaaagtacaagtggctgtggcgacttagctatgttactgatagacttggctgttgtgacgaggtgcagaggctccagatgtcatctcataagatttgatcaaatgctttttttcttcctgtcttctggagggtggctcaccttgattgctttctcactttgtgcattttagattgaatcactccatctcactcttgcactcattttatatgaaatataacctaattggccaggcgcggtggctcatgcttgtaatctcagcactttgggaggctaaggcgggtggatcacctgaggtcaggagttcgagaccagtctggtcaacgtggtgaaaccccgtctctaccaaaaatacaaaaattagctggacgtggtggtgcatgcctgtaatcccagctactcgggaggctgaggcaggagaattgcttgaacacgggaggcagaggttgcggtgagctgagatcgcaccattgcatcccaccttgggcgacaagagcgaaactccgtctcaaaaaaaaaacctaattaagaagtatcattggatgttctctatgtgaggtagtgtgtgcaggaaatgtaagatctaggagatggtctgtaagggcttttgattgagttggttagatgatatacaaactcagccaaaattaaataaggtaagttgatggtgtaaaatatggtatagggtcataccttgctattgtattggtgggaaagataaaactatatataatataaaattgtatcagaatttagtataaaattctagatttgctgtacacttggaaaggagaagcataaaggagaaaaagagggagatgcaaaatgttagctaaggcaactgaaaaactttttctgacttttacatctttttaacaaagatgtcattattttatttttttgagacagggtcgcactctgtcacccagtctggagtgtggtggttcggtcacggctcactgcagccttgacttctcaggctcaagcagtcctcccacctaagcctcctaagtggctgggactacaggtgtgccaccatgtctgggtaattttttatttattttttgtagccatgaggcactatagcctaggcactgtgttgcccaggctgattcaaactcctgggctctagcgatcttcctgcctcaacctcccaaagtgctaggattataggtgtgagccactgcatccgacagttattttaatgttaagcctgggaggccaagggaagtgttcctttggccttgggagctgactcagactttcctctatactccctccgcatctcagttccttccactatttacaggatctcctgtggctctctttggcaattagttgcaagaggtcttatatatattgaaatgagatggaatgtaaatacagtatttaaaaatatttgtggaagaaataattgaagttctgtagtgacagggccacactagggagcagagaatgcatagagggattttgaacctttgtaccttactttaggaacagtgttattgatggcaggtgggcagctgagagagttagaggagattttgttggcttttaaatatatctctagacttctgaaggcagcagttcttctattctcatgtatggtttggctggtaaattttaaggtatgaccgcttctattgtgtgaatgtctgaaagaactgtagaatccaagactgaccactgaggaatatgtgttgatcaaaaccatttgagctgtaagcccagggattttgaagggtggatgtctgggtgtgttaagaccaggtagaggagaatgcttattagtttcctaagtctcatattatcagagcccattaaatcaatattagtttgtatcaaatgccagtaaatccctattcttcccttacctatcaaactctgagaagttctttcttaggaaaggtacctgctcttcattttaccacagtatctggacttgtggtgtcagtcaccattttcttcaggacctcaggattgatgtgtggagatctacatctttttggctgataggaaaggggattagacatcctaaggctggttgccctctagctgtgcaaataaacactcttctgacatttcttccttaatcaacaaagcatttataatattatcgtgtaaggaaccatagagcaacctctctttccttggggctatttctctgctagatctcagcagcctcatatttcctggtgacttttttttctctttttaagagctttattcaagtcaaaggtgtcttgcctttacagttgcctttacagcttttttttttcttttttttttttttgagacagagtcttgctcttgctctgttgcctaggctggagtgtagtggcacaatctcagctcactgcaacctccacctaccaggctcaggtgattctcatgcctcagcctcctgagtagctgggattacaggcacttgccaccatgcctggctgattttaatagagatggggtttcgccatgttggccaggctggtcttgaactcctggcttcaagtgacccaaccaccttggcctctcaaagtgctgggattacagatataagccaccgtgcccagccttacagatattttttttaagataattctttcctcacctgttggattcttgtttatcctgtaccgtgggagacatatgggtgaggggaatggtatcccccatagtagattggataatgatctcaggaggtttttattggtgaatcaattattattttctttgttagaagaagaatctttagtaagaagggagaagaaacttttcatttgggagagaaaataaaaacaagctttgctgaggccagaatgggatcatgtgtaataaactatgaattcatcctctttttcctccttccctcctagttgcagttgatctcacaacagctgtttccagctgtcctctggattttgcccaggccccttgggatggctgcagtgactcacacagctgggcttttttccataatcgtctgaatctagctcctcaagaagcaggaggaggaggaggaaaagggtgacttggttgcactggaagagattttcttgttggtgtattagtccgttctcacactgctgtaaagaactacctgagactgggtaatttatgaagaaaagagatttaattgactcacagttccaaagccttaacaggaggcatgactgggaggcctcaggaaacttacaatcatggcagaaggggaagcaagcacatcttaaccatggtggagcaggagagagagagagtgtgaagggggaggtgccacatgcttttaaacgatcactcgagaactcactcatcctgagaacatcaagggggatgtctgtccccatgattcagttacctcccaccaggcccctcctctgacacgtggggattacaatttgagatgagattttgtgggggacacagagccaaaccgtatcagttggatcactgtctcccggcaggctctgggtttggtttattcttgaaagctatgatcctaggagataacattgccggcggagaggaggcaaatgtgttaaatggggaaggtttttgtgtttggagaaaggcaaatgttctttcactcagtgtttttccccatttatttccttccaaaccttcttattcggaacaaactgcatctttccatttcaaatggatgtagcctgtgtatgagatgaatgggtgactgaatgctgaggggaatatcacgtaaaaaggtagatgatgttctctatactctgatgattggttttgatgttttgtaggaagtattagtttcttttcagttcttcaaagtagttgttcctctttctaacagtaagcactgtcctttccctctttcttttctttcatgaaggctgtcctttcccagcttgggacctgctcaaatgagatatctcagtaaagacaataaaaaggatcctttagttatctaaaacattctttacttttgcctccctgggctctacactcatgtttctgaaggggtaacaggctgtagaagaaatcctctagacttgctgtgtaatatggtaatacggtagccacatgtggctatagagctgcactctcaggccgggtgcagtggctcatgcctgtaatcccagcactttgagaggctgaggtgggaggatcgcttgggcaacaaagtgagacccgcatctctgttcttatatgaaattataataaaaaataaaaaagctaggcatggtacctcacgcttgtaattccagcactttgggaggccgaagtgggaggatcacttgaacccaagagtttgagaccagcttgggcaacatagagagaccccatttctacaaaaaattaaaaaattaactgggtatggtgacacaggcttgtggtcccagctacttgggaagctgaggtgggaggatcatttgagcctggaaagtcaaggctacagtgagcgatgatcgtgctgctgtactctggcctgagtgacacagtgagaccctatctcaaaaaataaataaataaataaataaataaataaataaaatgaataaataaaaggatgcactcaatgtaaaatactatacactagatttagaagaattagtacaaaaaagaatgtaagatactatgttgagatttttaaaatattgagtatgttttaaaatcaacatgttgaaatgctaatattttaactgtgttggattcaataaaatatattcttaaaattagtttcacctttttttttttaccatttttaatatggctactacaaaattttaaattacataatggcatatatttctggctctcattatattcctattagcttgctcaaactagaaggggaagttactacaatactggtgtgcttctttctggtagtccttgttttcagaactttggagggacctttaatgatttttttgtttgtttttttgtttttcgagacagtctcgttctgtctcccaggctggagtgcagtggcgcaatcttggctccctgcaacctttgcctcctgggttcaggtgattctcctgcctcagcctcctgagtaactgggattacgggtgcctgccacagcacctggctaaattttgtatttttagtagagaaggggttttaccatgttggccaggctggtcttaaactcctgaccttaagtgatctatctgcctcgacctcccataatggcagtttgggattcataacacagtgcactacaacataccctccctattagttatttctcgctgtgtaacaaattagccctacacttactggcttcaaacaacaaacacttattatctcatagtttctgtaggtcagaaatttgagacaacttagctgtgtagttctgtcccaggatctctcatgaggtttcagtcaagcttttgactgggctgcatttatctgaaggcttgactgaggcaggaggatctacttaaatttttgctttatgctgttagaagcaagtctagctcctcttaaggggaggaaaagcaggacctaccttttgaatggagtagtatcaaatactttgtgagcatattttaaaaccattacatccacctttattttctgctattttcccctgttaacatacctgtgttttaataactgcctctgatgatggtcagagtccagtggctaaagttcattttaccctcagctgctatttcagtattacttggaacaattcgattcattttgatgatgcaaactctgacctgtaatcaaaatggtccttttgaggcgcaaaggtgaatttagctttgcttgggcttttaacacttgtatatgcatctgtttatgtcctttctgtcttatgtgttccttagttgattcttagtagtggaataaagctgtttggacattacatggtaaatatgttaaaaccagtattgtattatgtttttgtatgttatgttttgcttgagattcagagcacttaataaccattctgtatctcatcctacctctgagaagtttgaaagtaaagcaaggtatcctgttttctgcctccaagtagggaaagggaggggagttcatttacatacgaggctgagtggaagatgtgagggaattcagagttgtaaggcagagacatagatgtttccaggagtgggttcatccttactaaccttcatcttgtagctgttttgtttttggcttagcttcgaacttctgaagtttatactgaagcaagaggcaagacgtattggataaatgacccaggagacataatcagtaaaggtaaatttccatctgctttgggtcaaaatggagcttttttataaggaaactaggtatcataatgggaagtggttgggttatgagagggttcaagaatcaagagaataagtattcagttaaaaccatttgatttcattttttttctggtgttttagtaagctttaatcaggtatttcctaaggaatttaaaattatctcttaagtttgagaagtctgccgggctagatgaatggattgttagtttgttgccttggacagagacttaaagaactcttgaatctacattctgttatcttctgtatccttgtcatctttgtcattagttgaatacttaaacatagtttcgaattgttacttgtgtgtgtgtgtatgtgtatgtgtgtgtgtggttatctgttgtctctctaagcagagttaattttcttgaggaccatgccttttatttctttgcgttccctctgctagtaatgatactttgagttgtatatttcagaggatatatcttaagcatattggcaacatccgctggtgtggcaaggtaagagtcaagtggagctcagtggttaagagtttggggtttagagtcctattgactttgctgtttaatagatttattaccttaggcaagtttctcaatttctctgaggctcagttccttcatctgtaaaatgttaataatagtttctacctcacagagttgtgagaactaatgagatattgcaagtaaagcacttagccacaggagtggttacatatattaggtgtgtaaaaaagtaattgtttgatttgttaatttttatttttgattagaggtatccaagttcttgaatcttgaggcctcatttttattagttcatcagtcattatcggaggtgccagaaacctgaatctggtgcccgttcttgtcagcctgagtcggtccacatcataagtaacttcattcagagagttttcttgtttgctttggcaaaatagatattttaggccgtggtttcttccttgcagaatctcagggttcttcctctctccagtgaccagagctgccattgttttcaatgtttggtaggtgacatggtatttggattaccctgttctcctctgctcttctgactgtgactcctaaaagctcacttaaacctggctgatgctgactcctgtccaaaggcccaagtcctcctgcctccctccaattttctgttaaggaattctttggactaattttttttatcttttaaagaaaccttgcaatacccaaacagaccattctttcaactctgcactccttggtcagcatccagaatgtaaatacttgtggccatctgtatattcctctgttgtcaggcctaactgactttatactttttctcttccattccgatcttccggtggctcctcatagactgtcccattttttcctgttgcacagtgagcaaacttccttcatcttcagcctcttaactgcatgttatttttactcctttctcttaactaaatttgttttctttctcaggactttacatcctctatctcccttctagtgggtgggttttttgttttttgtttttgtaatttttaaaatttagagatggggtctctctgtgttgcccaggctggtctcaaactcccaagctcaagtgatccccctgcctcagcctcccaagcagctgggactacaggtgtgcaacaccatgcttggcttagtgggtgtttcggtgttccttgttctcctgtattacagagattagtattctgttgttctctctctcccctctccaatgcttacataaaatcctatacccttgggtgaaattccctgttccttaaaagctcgtgtaatctggctagtctaaccttttcccttatgcagtactgtcatttattgttttgtccctccctcatttaaaaaatgaacaaaaacttgtagctcttggattgtgggctttcttcttaccttaagtattgctattgtcttaagagactccagtgtctgtgtggaagactgatccagcaccttagctagtcttatgtctggttctctaattaatctgtttcattgcctttcttctctttcaccaactattctaaggccacattttggggttagtcaatttagaactgcttaatttctgaaaatttaaagacaagcgtctcattttctcattaagactcttcagttctctcatttaattacccccactgcctcttttctccaatgtcattgagaaagccagtgcattggccctctctgtattctctccctttttgttaactcccctgtctttgctcccttccctgtcttgtttcgactttgtcgtccttctcttaaacagctctttggccaatatcctctctttattttcatttttcattgtatttttcctacctggcaaaactcagtacagctctctgccttcctaatatccaacctttcctagacccttgactcctgcctggtagtatttctgtgtgtgttttttgtttttgtttttgtttttagacagagtctcactctgtcaccaggctggagtgcagtggcacgatctctgctcactgcaacctctgcctcctgagttgaagcgattcttctgcctcagcctcctgagtagctggaattacaggtgtgtgctaccatgcccagctgattttttgtatttttagtagagttggggtttcaccatgttggccaggctggtctcgaactcctgacctccagtgatccatccaccttggcctcccaaactgctgggattgtaggtgtgagccaccgcacatggccagtatttctgtttttaagtgacctcttggggatttgccacagtggctgtttaaacatccctcattgtcctacatttcctttccttttgcttcccttcacttaatcttgcctcttaatttatagaaaccctcagattggagctcctttaccttcgtgccaccaaatttgagtgccacttttcgtcctttctgtagtgagttctacttggatttttcccaagattttaaatctgcccttctatatctttttttcatcaactttaaacaaaataaataaataaaatctagcacatttagttatctttaccctccatctgcttttcactctcctcccttctacaagccaccttcttaaaatagttgtctgtgccctttgagcccattgcagttctggttttctctttaaccacaacattgaaactcttttctccaaaatcaccattaacccccttgcgactacatccaatgaatattcctttgtgtcatctttgtccttggaatgccgctcttcccctggcttctcttgtaccatgctttttagaatttctccctctgtctgccagtgcatttttgttatcccttcctcagcccaccacttaaaaattggtgcttgaaatgattctattctaggtctttttctttttaattcttttaagttatatatatttctccttgggcaagctcatctattgctaaggctttatttatcatctatatgctgacaacttccaaattgctgtctgtagcctagatctctttcctgcacttaggatgtctgtatccacctgctcagtgtgcatctgtgcttggataccccatagttaactgcaaacacaacatctaaaactgattcctccttatctgctctttttaagaagagatggagttttgccatgttggcaaggctggtcttgaactcataacgtcaggtgatctgcccgcctcggtctcccaagatgctgggattacaggcatgagccactatgcccagcccttatctggaatttctgcaaaattctgtccttgtgtaactcagcaaccagtgccaccatttacccagctgctgaagctactgttatagcctcttaaatggtccttctgtctttaatttcgtccctcccatcccacatcattgcgttgcagtaatttttttcagagtgatccttctgaaacaactctgatcatctcactgtcctttagtcccactaaaagactttggtgatctggctcctacctcatctcccaccccttgacccgctcatgcatataccatgcagcttcacttcattccctctataacatgtctccttctaccctttatggcactaacccttacctttgagatctcggtttattggtcttaataaacctttgggaatcttttactgaatttctaagatagggttaggaactctcttgactgctttcatagcaccttgtacttttccctatttaggatttatttcactgtattataagagcctatttcctttgagctcctgccaaactgtaagctcttcgagggtagggactctgttttaatctttattttttctttttaaattcccagtatgtagcacagtacgtgatttatagtaagcttagtatttattgccatttaatggttgtatggattataggattttagaactgaaagaaccttatctgtatggaatatagatcctagatttgcagggtgaatgatcgctgtgcggttcttttgctagagataatcatttcaaacaaagtcatgttcaaaggccaaggtggcccccctttagggttttacctctggctttcactggttaagtagctctagttagtttgtttcaaggcttaattagaccagtgtttcttaatcttggctgcctgttagcatcctctggggagctttaagaaaaatactgttgccccaacctcaccaaataatttacagaataagttttattcttcttccgggaagtttgtcatccattttccaacttgctaaagttgatcaacagtggctttattgttctttgacaaaagaaaaggcatatcagactttgtattatctcatttttagatgcaccagtcagtaagcatttggcagttgggggcccccatctgtgaccattgggagcttgccttatgaacccttagatcctgatctgtgacatagaatgtgagcagaaagttccatctggtgtgattgctgcctcctctcatgggttctctggtttgagtcactgctgttgtatcacacgcttctttatgacaggctgacagattaattccctagaggctgacctgatgtaaataggaaaatttgcttattatcagtagaaggagcaggttatttaattactattcaattttagtgctatttattttttgcttttaggactgaaacatctcctgttcagccatttgaattttgaaaagttgttagttgcttttgataactttgaggaatcagattaatttttaaaatggtttttaaatgtatgagctcatgctaagtgcatttgtttgtggtagtaattgctttctgaaatctgttttctgcaactcagaatagtataatatttagaacttggtcactgtttttagaaggaattctgaaggaattgtaaagaacagcctaaatttgttcttatcccttggtttttctacaaacacaattttagtattgtggcattcagaagttaatgcattcttggtatgttgtttacaagtaatattttacaaatgtaagactgaaatatttgcatcagcgagtattgtggctttgagagatttaaatgctgtatgattacaaatattttattcttgtcactaaaaaacaaaaatggaagataaaacaccaaacctatcataaagatacatgaaaacagtttggactgtttacctttctttttcttccctaggtcatttatgtaacagtcttaaaaaaaaaaaaaagagatctttatacaaaactctattttccagtgaagtaagagtttatggtgactgagtaatgcttggtatagatctggatctgttttcagaattggctggtgtctaaaaatcatgaggaacttaggtgaagcagttgatgaatagtccataagtccacagtcatcattgctagcttgaagatagttaatgttgataactttcttaaacactggggtgaaagggtaaggattgggaatacgtctatacatttagctattctggctgatacttctttcttttgccttttccattatctcatttactttgggcttgttaatccagtggaggccttcttaaagggggtgggcataaataaaatatgcatgttctttttcctttgctaaggacagtatgaaaacattgtctgctttcaagtttggtcttttatgatgaactggctctcagaaaaataacttgacttctttttgaggtgcacgtttttcatttcttccttctcccacctccacagcaggcacagtgagctttccattcagacagtgagcttgtgttgccttttagcccagggagctcagcccacaaaccatgggtctcagtttgtgcttgacaggactttgttaagtgaatcagggagtctgaattattcattctccttcctcatcctgctgttcatatcaaattcctgctgtgtctttggggcatcttgccagtcttcagcataattgatttccttgctttgtgctatgtggggtgtctgtgtctgtgtgtgcacatgggttgtgcctctatttaagcatacctgattgcctataatagtggtatttattaagctcgtgtgggcagaagcacaacagttcagcccaagattactaaaaatatagcggactggctgcttttataatctgagggagaggttagaattggtcttttcattatccaggctgcattttgcattttctttctgagcaacaagggtttgctgcctgaggaattatgaggaagactctatctatctatctatctatctatctatctatctatctatctatctatctatccatctatctatctatctatctagagatggagtctttcctgctttgttgcccaggctggccttgaacttctgggctccagtgatcctcccaccttctgtgatctgattggaacacttgtgaaggagactgtccttttctctttctattctttgaccccgttgtctcctctttaactgtttttctttgagaagatatttcatttagagccatagactgttagaattagggaggacttaaagattatctagtcaagaggttgcaaactataggcctttggtgtggctcccacacatgggattttgtttggataacacagtattttaaaggcctttggatttaacatttaaacattgggaaagctcacatgaaacccagatttgtggcttcacttggcagcacggggcccacattcctacatctgacaatctgcaggagctaaatagtggctgttctcttttggaatgacccgtttgcttcagtattgcacagtctctacctgtgcacttcactctttacctctggtgagtgttacaatcccggtctaatccagtctacccattttacagaagagaggaagagatttgctgaaaacctagtaggtagttggaacaacttagggtttgtgtctcttgacttttagttgattacgattatttctactagtattttacttttgcctttcttactctttttttgttgttcattcaaaatattcattgtgtctgtagcaagagtcaattctgagagtgtgaaaaggaatgtgataaagtctcctttcttgatttggtcttgagggaccaaatgagtctactttggaacagccaccatccaccattactgtgtcacattatgttgtcatcttttcttcgcatcatctggaattttaaaaatttgtctccttgtttactggctgtcttcccaagtacttgagtgtaagcactgtgaagccagtgactgtgtctcatttaatgttgtatctccattgcctgtcacttagtgaattctcggtatttgttgaatgaatgactaaaggaggcatttgaactcagctttgaaagatgaataggaattttctatgcagactgggtaagggtgttccagacatagatactggggtgagcagagtcatggagacatgaaaatacatagtatattcttgtgcttctttcgggctgggtttgttcatgtgccacaaaaagctatttttgatacagaaagaccatctggatttgaaggactctagatctttggttaaaaaaaaattgagaaactaaatgtgtttctgagccaacttcagtatagctttttcccctctgtaagtcttttagccagatgctgggcattcattatcattaatgatttatagacctttaccaacatatttaccacagttttattatataacagatgtgaaacaagggtatggttccaatgtgccttcagtctagcaacacactctgccttgtgcaaagcagtctaatattttgcaagtccagaacaactggcagtatgtagttatttttagagtatataatggactaagtggtgagtttctgagggcatagggcagaggttctcaatattagccaactgtgcgttagaatcacctgggaagcttttaaacatttcagtgcttaggccataccctacccagaccaattaaatcaggaactctgggggcaggacccaggaatcaggtttgtttttttaaacatcttcagatgatgctagtatgcagtaaggttgagaaccattggcctagggggacacaaacaagggaaggagacagatttttgaagcttgttgtaagttgttgaggtataaggagggatccccaagaggtcagtcattaagaagattaggtaattgaagagaattattaaaaaaattatctgagtggaagaggagagctattttagggaatcagtttagaaatgtatgatttttagagcagttgaacatacagagattggaaatcttacagatggtgtcagagataaacagagtgtgcctggtcgttgaggaggaagagagcttggattccaaattattcatcgactctagctttctagtcacatgtaatgagaaaacattgtacttgaagtaaaatggtcatgggtcatagttctagattcccactaattagttgtgttcatttagttcagttaaccaaccatttatcaagtgccgaacactgttggacactggagacaaattagatacaggtcttgccatccaggatttgatgatctaggaaatttttttgtgtagccgtagttaagcagttattaacatctctgggtcattctccatttgcaaaatgtggtgatatgatgttatttctgagattgcttttagctctaacatcttaccacagtgattcaaagtaaaatctaataagaatcagcatctcctaaaagtaattattatagttttcttcaatagaaaaaaaaatccaggtaaaaaaatggccaaggggtctaaactgagacaatcttagaaacttactatatccctttcctgtcttacttttctatcaggttctgtttgattttgacaactatagttaataaggaaggttcaagagcagatgcccctggtagggggcgggtagtagctggtggattagagctaaagtagagctggtaaaagcctcctggttgcagagctgagggcagattgggcaggtgcactactaaggtatggttttgagatctactatttccagcaccttgttgaaaagttgatagctacattcatcacccaggtgaagtctaccataatgaggaaaaaattgcttatcttgccagcagccctcaggataaacttaggagaactggggagatttgtttttctgatgattcttggattttgtagtgcagtcattgtttgctttgctgccttgtaggggaggaagggaagaggctaaggggagagggtgggtgaaacagctgtcaaagaaagaggagtcctgaaaagctatttgtgtttgggagctggagctcaatggtagggctgtggtagttttgtaggccacactctcttgttgctgttttgcttttgggacataacactaataaataggattagtggttttttttttttttaaacgatacccttagcttgttagagttaaaacagcttttgttctaaaacactctatcagagactattaaagaatgatttttcttatataactgttgcactcaacatgttccattgtagggactgtagcatggtttctattcagatatcctggaccctcagacctcaaattaccgtccaaccatttccttttctcctacccacttccctgttcattctgcagttcttgtaatcaccccagcaaatgtttatttagcgcccgtatgccctgtaccatgctggctgttgaggatgtggagggaggcagagagagagagacagtccatgacctcaggggctcccagtgtagtagggagactggtaccaacaagacctataatgtggtaagtgcattaagagaattgagtaaatggggagatggggggaggagggtctaaactagctgggaccggtggaagtcagggaaagggacctgggggatgtaacaggagctatccttctgtgttttaaacagtagaaagaatagagaaatactggtttaatgggtagaacacagggtgggggaattaggactcttccttttcggtcttttgtgttcaaaagtatagcagctttctttgcttcttgctcctagcatcagattatctattcccctggaattatgtgggttggagaagaatggaaaggaatttgcccacctgcatggagagagagggaggcagtagggatgtgggtgtttaaaagcccttggcatgattggctgtaagtacagatggctatttgtgttaccattattgtagctgttatgcctacattccctttggtgtgcctctctacagggataattgtggggtcctgacttataagtcttcctgctgctggataaaatagatgctgatgtgttgtgcgttacagggtatacagtgaattctgtgtgggctgtcttcttactgctgccttgatcttttggggcctcaaacataaggggaaaatgactaattttgtgtgtgcaaattcacattggtgaaaaccagtaaaaccataaaaatggttatattcaattttcctaagggattgacctccaaatgaagctaaaattaactttggtgaatgcttatatttttaaatttttaattctaattttttttttttttttgaaatggagtcttgctctgtcacccaggctgaagtgcagtggcatgatcttggcttactgcaatctcagactcctaggttcaagggattcttatgcctcagcctcctgagtagctgtgaccacaggcgggcaccaccacacctggctaatttttgtatttttagtagagataaggatttaccatgttggccaggctggtctcgaactcctggcctcaagtgatctgcccacctttcctcccaaagtgctgggattactggtgtgagccaccacgcctggctgaatgtttggatttttgaaagcattaaataccaagggctgagtatctagggaaaaggtgatttgtctgtgaaatccaaggaactggctacattctgtgtataactctgagggaaatagaacagaaagaggatgggctttacagttgctctgcatattttttgttgtgggaccttgctcaatctacctaacttttctcaagcctcagttttttcattagtaaaatgaagataataattactaccataacgttgttttggtgattaaaaatttattattccactactaaaagcctttcaaaggcttctttcttagtatttatgtcccaacagaatggaatcacttgctatctttttctcctctgtgcttttttaccatttttcttgtatctctttttacctctctactcagaaaattctccataaagtaaaacacataacataaatacataagcgtgcaaagtcaggttgctccttagatctcagccaaatggtattttgttttcaaggaagcctttcctgagcccgatcccattccagtctggaagatgtcctttcttttaatttgtctgtcccacctgctaaactgtaagttctctgagggcagagattgtcatatttactattgggtcttcctcttttttgtcttgtaaatggtgtatggtctgtatgcaagctgcttgcaaaactcagggcaataccaagagacatagcaccccccacccccgccccaattgatttataaccagaagaaaaccgcttaattttcacctaattgatggtaaagcctggttactttggggataaatttggctttgaaagtaaacctgatgctttgtgctttggtagatatttaacttctgttctctttcatacacaagagttactcctttgctttgagtagaaaaccattagaaaaccagggtagaacttttggcaattatccagtttagtaattgggccaaatagttctaatctcaccacaaccactacttcttagaaaatgatctctttaaacaaaacatggaacatctctgaggatgaaaacctaagggaaggaatagttggagatccccaaatatactcatatagattccccccattctttttcctatttatgggtgttcaagccttggagagatgtgtgtgtgttgatcacataggatcttttacctacatgacctaagtatattccgttgtggcctttggtctattttttttatacatctcaaatgttatcttttaataggtcataatgaatttgtggtggagtaaaggcccaacattccctgtacaagtaaaggcaaaccatagcgccagtaaccctttactagtttataagtaaaggctatctctgttagcctgaattccttgagggcagggatggtctgattgattttccatcctcaatgataagtaaagatattggcacatacttcgttacgtgatggttacctatttgtcgaatgaggtagcatggtgtagtagattaaaggctccagagtttgacagactgagttagtatggcactgacacttgttgaaccacgttttaacctttctgagctttaggatcagctttcgttgtgagaatcaaagacattgtactcttaaattcctgttagtggctattattttttctccattgattctttattttgaaataatttcacattacagaaaagttaccagagcagctaacaacccacaaaacaccccaaactcctggattttcttcactcggattccccagttgttaatatttcactgcatctgcttcattgctcactctgtgtgtttgtgtgtggggtttgtgtacatacataccctttttcattgtgccttttctgagctttttttgagagcaagctgcagatgtgatattccttcactcccaaacacttcaatgtgtattccccgaaataggactttcctatataactggcagagatctccaaatcaggaaatcaatattagtacaacgcgaccatccatccacagacttcgttaacattttgccagctgtcccagcaatgtctttttcctttttggtccggtatcttgtctaggaatatgcgttgcatttagttgcatgtcgcctcagacctcttcagcctggaacagtttctcagtctttacctttctttcatgtccttgacattttgaagagtctagatctgggtccatctgtttcttcatgacagcagtaatatcattttcggcaggaataccactgcaatgatgctatgctcttctcattgcatcatatctggaggcaaatgctgtcccccgcatcccactgtcagtaatattgttaaccttgaacagctggttaagctgatgtctgccaggtttctccacatcagattcatcatttttccttttgtaattgattattgtcttgtggaaaggtattctgaaattatactactatcctgttcctcaacagatatatacctaacctccttagcgctattgactactctttcctgaaccaaccagttttattctgtcaaatgctagtcctctatttctgtgtctgcctgtatttgttagatgtcattctgttacaaagactttccctttttcatttgtttatttctatcaaatggactcatggattactattttattcagtgggctgtagtccatttctataattatactcctcaagcttgagggagcttgaaagtttagccagtgggacctgctttatgctggtttctttgtccttttgacctgtccccatcattcatgggacatttccttattttctgccacaagaaggttttccaagtttattttgtacttttcctaccaaagccttggaatcagccatttccaagaagctctggttcttttaaatggaggatagtaattagaaaccaacatctgggtggtgggtatgcatattgctactagagtgtccttgcctctaggctgtctcagcaaacagctagaaattgtgtgtatgtgtacatacatatgtacataaacacatatataccacatatacatctatatttccatatctctttgtgctatatacgtatatatacatgcatgatgtttgtgtgtgtgttacatattttaaattataaaacaatgcattttatattataaaatcatgaattcacactgataactccattaaatgcagccaacctctttccatatttgtaaatatattctccagtagggaaaaacttggctccccttatccccaatatgtttacttatttgctcagtgtagccagttttccaaccgcgatggctgactccaccacctctgtaccctactcctcatgttctggaatcctcagtcaatgggctcctttggcccattcttccttgtggcttcctaatctccctagagtttcccagctttacctgtagtcttccagtgccccctgacccccaaccactcttatctttggcctctgggcctgctgtcctgtgcatccttgattcctcagctgctcacctacctgtgtccttggctgctgtgctaactcctctgtgacggaagggggacagggctttttttttttttgagggggattttatacgtatacacatatgtatatgtgtgtgtgtgcatgtatatatatatatatatatatatatatatatatatatatagttcattcaggtataatttacatgcagtaaaattcattcttttaaggctacatttctatgaattttgacaaatgtaatatagacatgtaaccactaccacaatcaagatataaaatgcgtccattaccgtagaaagtttcttcaggctctttcacagttagttctctcttcgcatccgcagccactggcatcactgatcagatttctgttcctatgattttgccatttctaaaatgttatataaatggaatcatgtattatgtagctttttgagtatggcttctttcacttagtgtaattcttttgagattcgtctgtactgttttaggtattagtaatgcattccttttttgctgttgagtagcttcatttctcttgggtaaatacctaaggttgggaatgctgcagggtcatataagtgtatatgaagtgtttaagtgtatgagaaactgccaaactgtttcccaaagtggctgtaccactttggattcctgtcagcaatgaatatatctacattctttccactatttggtattgtccgttgtttttttaaaaaatgagagtccttctgataggtatataatggatatctcttcgtggcttcaatttgtattttcctaaatattaatgatgtttagcatctttcatttgcatatttgtcagtcatatctctttgatgatgggtctgtttaaatgttttgcacatttttttaaaatgagtggttcatttgcttttctttttcttttttttttttttttgagacggagtctcggtctgtcgcccaggctggagtgcagtgacgcgatcttggctccctgcaacctccgcctcctgggttcaagagattctcctgcctcagcctcccaagtagctgggattacaggcacacgccactgtggccagctaattttttgtatttttagtagaggcgaggtttcgccatgttggccaggctggccttgaactcctgacctcaggtgttccacccgccttggcctcccaaagtgctgggattatagatgtgagccactgttcctggccgggtggttcgttttcttactgagttcattttgaaattctttatatatgtagcaaatcctttttccgatacacatttgtaaatattttcattcattctgttattacttttatattataaatgtggcttgtttcatatataaaaatgttggattgaattcttgggggctttcctttttagcccttgtgctgtgaatacacaagggaaatatttgtgaaaggatggatctagatgttgagggaggtggagatcttggaggatcaagtgtaattatctctcctcagtgactggaggtacttgttgagaacaggaaggaaggactgagggaagaattaagaggggggggtggtggtggtggtggtcagagtttttggttggaggatttggtatagcaaattcaggggtgggataatggctactagaattgtgtaaaatagaaagataaggagtcagggggatttaacatgaaaagtgttgaacctagctgaaatcaaacagggagctgaaaacaacgttagtaaccatgttgttcagccttttcatttgataggtaggagatagccttaagagaggggatgcgatttattgaagattatatgcgtcatgaagtggcagagttaggacttaaattcagatctttaaggacagtagtgaaggaggggctcagcccatgtaggaaaatacatttgggggtgggagcaggaggtggaggaaaaactagaattctaatggcatatgtttttgttattctttatatccttcacataatttataaatattcttcttgtatctcctcagtattaagtaaaataacagtaacaagtctggaatgacagcagaattagtgattgagctggtaatagtttgaccagaaatcaaattggaatatatgttgggtcaaacagaaaacactagtgatcaagtgggaactcatttttggcacaacatgaaaatttgattttttttttttctgttcctgacatcaaaagggaaaagatactaaagacaataaaagatcatagatctgaattttgcttgttacaattagctttgaaaatactgactcccaaggttaggatttactgggattagaattgcctttgaattgaaagagaatgataaaaggaaatacctagaaaacctgatagtaatagttatttcattggattcctaatctaaatcaggcactgtgttaggcttcttggcattacattttcttaatctttccttaactttgcagaatatttttggtgacattatgttcctattttatcaatgcagaaattaggattcagaaaaattaaatgatatgcttaaggtcatatgactagtaagtgagctgtgttaatccctaggattgtgtggtgaacaaagctttttctcctttccttttaccagtgctaattaaagtgtcatttgtagactgatactagtttgctgtttattaccaattcatacaagataggtgcagaaattgattgtatgcacttagaacttctatagcaatttgacagaatacttttatgagtgttaagtctaacaataaaaaactggggcttgtattttatatttcttgttttttaaaatttcgtttttctaataattcattttactacactttacaaaagtatgattccctgatggattggaaagttaacagaaaaggttgctcctcacagtttgagaagccccgtctactacgttgcctctgtgctttcgagagactgatcaggatgaaatttactttagtatttctgctgagttttgaatggctggggagagaaggtcagagaaaagggaagaggcagtagggaaaagatgaggctgcaggggaggaatctttgggaggactttgcccttaagtggtagcagtaagatgagggcaataagatgaggggggatgccctgcctcctttggttgaaagtagtgttaggattgtggcgtctttctgtagagctctagcctgtttttgttgttgttgttgtttttgtttttgatacggagtctcgctctgtcacccaggttggagtgcagtggtgcgatctcggctcaccacaacctctgcctcctgggttcaagtgattctcccgcctcagcctcctgagtagctgggattacagatgtgtgccaccacacctggctaatttttgtatttttagtagagacaggatttcaccacattggtcaggctggtattcaactcctgacctcgtgatctgcccgcctcggcctcccaaacaaagtgctgggataacaggcgtgagccactgtgcctggcctagcctgttttttaattacacccagtggcaattctggtgttaatagacgagaacgaatgtaggaaaaagaatttacagaaataaagcaactggatgtaggagttcagaaaatctaaaaactccttttctctccttagaaatacagacacactccccttgaagtgttttccctttaaggaaaaggcggcaattctttggcagggccaagagttttgattggctccttctactgctgtttgccacgaagaatcctgaccagtccagttttgtttagagctggtttgggagtcagccgagctgccaagttctctgtgcctaatttgaagtgtattaatgtttcaggagtgggccagatctcttataggcacctcctacagttcagctttccacgttccaggaggaaatgtgaccctgctgtttcgggaaccccacctcatgtagtcttaatttctctccgaatgtgtttgaagtcttgccagcgtagagaggggaagtttaacacactaagagaatacatttttagggagcctgcccacaaggtggtcggtcccctatgccgtggccaaggaaaaggaacccactcatccttcaggttacttaatatatgagattaaggcctcagcccatataggagtaattttctcttcttctggatgtgaaatggtaaaacaggccctttaagaactagaccatttttagttgagaggaaaacattgatcacattggctccagataagagcagatactgtgtgtacttcctggcaaaaactttgtatgtggttcacagcaattcctgccattctggttgtgtctgaggggctgacaacagacagttctaatctaatctcaaaccttttacttgctggactggttcttaatcccagaaaccagcctgaggtcaagaattggttcctaattgccataggtataaaggtggcgctcctattgagggagttttcagtgttcctgctctggttgtcaccagtgtggcttgggagatggtttatgttggtctgtcccccctctatggatataaactaattgttaaacagttactgactcctgtaagtttagacagtttatagcgccagcctttaaatttcattgtgaaatataatcttcagatttattagaacagtttaacggaagaaaataagagaaagagctctaaaaaggtgtagactgtcaaagaaggctcatggaggaagcatcagttagaggactctcacagtactttataattacctcatcattatcaagtattggactaacattgtctttgaacatctctctctgttgcctgtagattataaacttcttgaggatagggcagtttctgttctttttttgtatttgactctggccttcttgatcgatttggtaaatatttattgagatcaattaaaataagatgctttaaaactgagcacaaaggacaagttacatttcagtagcttagtagtgaatttaattctgcaggtcttggtgctgtacttctttggtgagtttgctgggcccagatggctaggcttgtactttccttagacattttaatggcctgtcttggttgtgatgtctctaagcactaggaggacagggaatatggctcatagaagagggtgccaactgagagcctctgtccattctctccacccccacacaactcctttctgtacagtctttggtaggtaataacatttctttaaagtgatgattcctaggtgaaaccggaggccagttttgtgtgtactcttatgttttattaggtgtgtgggatttgaggaagttgtggtgctggaaagaatctgccttgccccatattactggtgaaaaaatagagacctaggaaggataaataatttattccaagccatatggctacttagtggccatcaagactattgtccaggtctccttagtgctagacatttaccacagtaccgggtaagtcccattttttttttttttgaggaagcattagtaaaaatcaattttacagaaacgaatataagcggtttgacttaggattgtgaatggaaacatatttttccttttgaatgctaggagaactatgccagagtttctttttttcctactttttgcatgatttagaagatagaacacatgaaaacagttccctaaaggaggtgcttcatttaaatgcttaaaaaaagcaggccacttcaaatttctaaaaatagcatttaaaaaaccccaaaatgatctaaaaagggattttagttgcatgaagactatactgtttggggggtttctgggctctagggaggatgctagctctctgaatgctttatgttcttatatgactcatcttgttagtggtgaccccagaagggcagtgggagaaatatgttccgaagggtgatttggaaggaagggatgatctggaaggaagggatgagaaggttgcaggcaggaaaactgagctaagtggttttagagagtgttttttttttttttttttttttttttagggagaaaaagaaaaaaggaaaggctgctaggagcttggtcctaactgattccagatgggcctgctacagtacaaaggttttcagtgtgtttgggatggggctgaccaagaaggccccctcagcacttcctgtgcagctctgcaattgtatgcacctaatcagaaacagcccttactgctggagctcaagagcaaccgtctcatgttgtctttgtgcctcattctgtgaactgctccctttgcctgccctgtttacctccctctcctagtctcttttcctttctaatcttttctatatttgttttcagggaatgttaaaaggaggggagatatgtatatataaacataaacatatgtatatgtttcttgtgggttgggagcagagaagagagggaggaaggaatggccaaattaaacgcagatggtgaatatttaggaaaggaatttttttctggacctgggaggcatttgctagaaatggggattgggaacatgagaatgtgaatgagacttggaaaaacaagccactctttatttttcatttttttgaatcctgcacacttgtctgaatggttcaaaatataacattgcatggggatggtttatttacattgtaaactgagtatcactggccctgtgtagctgtgtgccaaagggtgagtgtgacagtgactttaaacttaaaggaagtaggaaggtgttttgcacccacatcccatgtagtattgttgccaggggagcatacctggtgtgctctgacgtgggcttgaatttggccgttttcccacctactgcagtatatcaggcactctgcacagcttaaaagaggatttttttggtgacactcagctgcaggcactatgaattgttcttttgtgccctcctgattccaccagggatatattttatatatatacttgattttctattttgcttctattttggttgcctggttagactgagggtatgcctggtattgactgttagttttttgggtctagctgatgattacagaaactctgccatcccaggggtccatttaggtctttgcaattttattctaatccactcagctgttgtactgatgttgttgcgtaaatgtgagcttattaggatagactatgtaaaaatatactgtgttggcataaaggccttagcagcattgctttgttttgacctcttcatactttgtgtcccttttgtcctctcgtaagcaccatgatcacatttcttcttcttgtttttttagatagggtctcactctgttgtgttgcccaggctggagtacagtggtgcaatcatggctcactgcagtcccgagctcctgggctcaagcaatcctcctacctcagtctccaaagtagctgggactacaggtacatgccagcatgcctggttaattgaagagtgtgtgtgttttttttttttttgagatgggtctcactgtattgcccaggctggtcttgagctcctgaccttgagcagtcctcctgcctcagcctcccaaagtgctgagatttcaggcataagtcactatgcccagccacattttttcttgagctaaatgtacaatatatcctctgatgaaaaattttagtgctgtttctaggtagcgaggatgtctgggagatagagtttggatgctgaaatatttgatttttttgggatatttttgatgctataggaataatgtgtcagggtatttggaattgggatagcataagacaagttacatggtcacccttcttgagtgagtcttagcaatatagcattgcaaccgacggagaattatgttctcaattcaccagtaggatctttctcactgtgattttttaaaatcccccatttgactaggtgtaaagaagagaaggtagctaagatgttgtttgtttttcgagtggctcttatttgccaggtaccagactcatgttatctcctacaatttatcagaactctaggataaatggcctcaagtccatttgcgggtgagaaaactgcacatgcacagtgtcacacagctagctttgtttcagagacagcctcaacccattgtgttctgggcctaaaggtgatacatattcttccacattctgagttatatataaattccaaacccttctcagaaagaaactcctttctaagggtaatgtggtagttaaaaagatttttaaaaaatcactttaaacttatttttattgtcatccttgtcccattttaagcatactaacttcctgcctctgatatataaagagccgatgctggagagaggaaggaggcaaaccattttgtcatgtttatggagagacctcaaggctctaaaagctgcttttatttttttgagacaaagtttccctctgttgcccaggctggagtgcagtggtgcgatctcggctcactgcaacctcgacctcctgagttcaagtgattcttgtgcctcagcctcccaagtagttgagactacagaggcgcaagtcaccatgcctgacgaatttttgtgtttttagtagagacagggttttaccatgttgccaggctggtctcaaactcctgacctcaagtgatccacctgccttggcctcccaaagtgctgggattacaggcgtgagccactgtgcccggccataaaagctgcttttttttttaattaatggaaatttttattgggggtaattgtagattcttatgcagttgtacaaaagctacttttgaaatggcagaaaggcagaagttctgatctagaggcaggcaggtacctctttttatcttctagggcagtgtgcaaggagagtgtatgaggggctcttgagaccccacttcactttactgctctctgctgtctttgggatgtgcacttgtcaagtactcttaagtgctgtgtgcaagaggcacccatttgcagtactgaattcaggccgtaccttgaaatcttgttgatttgcttgagcagagacagtgttcagaatgtagggatagattgccggtggagacagtagtagaccttggaggaaaatcgtaggaattgatggggtgaagcaacaagatatcttcagttgggatcactgtgaagactccctacaatgtctttatttatttacttgttataatgtctttttctccaattcgactgagcttcatgagaggaaggactatgtctgttttccacacctgtattcatggtgcctagcactatgggaccatagtaggtgtacattttatgaaagtttgttgaatgaatgaatgccatgggaaattatggttcctgttgaagaatttaatcctcaggtcaaacctttgtctgttgttttgcatcagaggagtgactttgaacattttcctgataaaagagttttaattccataagcttcttttcttcttgtttactaccttagctcaagatcttctcttaagcttactgacagagtcttgctttatttcagaaaatgtgcttaagacctggaagcccagtctgtgaagcatctggtttaccttgacctgtaaaattatcagactgcttcttttccctcccgttctgtgtgtttaagagaggcgcataattctattttgaggcttatgatagaataggagaataaagcaaactcgatgactctgtttactttaaaaacttgttgctcatctaaattggttgaatgactatcccttcccttaactaaccctttcaacttttcatcctggattgaccttccctaaatttatctttcataaaaagaggccatagatatatttgatctctaacccactgggactcttttttaagtttggcttttggctttttttttggtaacctttttctctaagatcaggaagaaagggataagaaattgtggacaagaaaattggaaaacacttaagaaaaagtttcgggttgtgtgggtgtgtgaaagcatatgtgtatacatatacatgtttttcctttcctgccccactgttctctagctagaatgacctagattttttttattctgggaaaaattgtattatttctggattctgctgtttcttttaagtagttggactggaagatgctggacttataacttacatttttaagttctttcttgtactcttaagaaaagtggtaaatggtacggattttagatgtgtgtactggaaacagtagcactaataaggaaatgcctttgtcctcctgttctttgttgaaatcagcttggatagctgaggatggtggagggttatttattatttttgggctccaatgtcaaaattctcagttttatttaaacactcaacacaattgatatttgagtgtcatgcaattattagctaaggttagtattcacttaggttaggaaacatctcttaccattttcatctcttgtagcacctaacacagccctgggtgcatacgaggcacttgataaaagcttgatgagtttaatttaatgtaatcttgcttaattcatagattgagttgtttgacctattaggtggaagaaaacatcattgtccttttttttttttggtagggtattttttttttttaattttttattttgagacaaggtctcgctctgttgcccaggctagagtgcggtggcacagcctcctgaagtgctaggattataggaaaattcacattttaaatgctactttatgaaagtttctaaaagaaaacaaagaagaatgttttcatgatattctttacttgaactggatataaatgctgactataaaggaaaaaatgatgatttgactacatcaaacttaggaattatctgttcattaaaagacgccattaagaaagtaaagctagatgtggtggtgcacacctgtattcttagctacttgggagggaggctgaggcaggaggattgctttagaccaggagttaaagatcagcctgggcaacaacatagtaagacctcatctctacaattttttttttttttaaagttgactgcgcataatgccatgtgcctattgttccaactactccagagtctgaggaaggaggattgcttgagcttaggagttcaaggctgcagtgagctatgattgcaccactacactccagcctgggcaacagagcaagaccctgtcttttggagggggaaaaattatatgtatataaaagaaagtaaaaaggcaaactacaaagtaggagaaagtatttgtagtatagggatctggctagtctctagaatatctaaataacaactacaaacccatatataaaagaagttcttttaatgaatcttttgaacaacccagtagcaaaatgggcaaaatatttgagtagttacttcacaaaagatgatctccaaatgttccaaaaaatggtcaggatcgttaatcatcaggctaaagcaaataaccacgatgagatattatcacactacctccagaatgactaaaatgaaaaaggcagacattaccaagcattagtgaggacgttcagcatctggaaccctcatgtactggtggtaggaatgtaaattggtacaactttggaaaactggcagttggtagtatctaccaaagctcaacgtaagtgtaccctataaccagtcattccactcctaggcatacccaaccgaaatgtatacatgtgtgcactgaaagacatgtgcaaggatttttaggaatagcctcaagctggaaatggcacagaggcctttcaacattactgaaatatttttcagtaaattatgatatatttataagatggaatacactcaacagatggatcagttttacagatataatgtggagtgaaagaagccaacacaaaagaatgcataatgtgcaattccattaatacaaacttcaaaacaggcagagtgaatttatggtgttaaataaagtcattgtgggctggtgggagtgactttgcaaaggcacaggatgggcttctgtagtgctggtaatgtcctatttcttggcctaggtgttagttacatggcagggggcggggggatggtcactttgtgaaaattcattgagttatgcacttaggttttttgcctatttctgtatatgtaatcgctttggtagaaagtttactttcttctacttgcgttctgtgattgctacagctgatagatagctttcccttcatacacatactgatccttttcctgtcgagcttgtaggatgtgagtgtgcacatacatttttgtgtttatgtgttggggtgttatgtggggatgaaggtgctttttaaagttaatgtaaatttgcttgtcagatattcaacatgctgtttcaaacagccacaggaaagtagaattgatgaataagcttcattgaccactttttaaactaattctccaagaataagaaggacattttcattctacctaataaggcagcagatttggattttgctctgcagacaaaagaacctcttcattgagggtctcagccactaacagcttcattttcagaaggatgtacctcattttggccattattcttatcatggagactatgaggagaacaaatctccataatattaatttttttccccccttttactctgtggaaatctaactcaaagtaaggcattttaggaaaacctaatttgggttaggtagaaaatctaaaagatgttgccttgccttctcttagctggtcatatctctcaattctgaacctggccttagtaaaattcttcaaagttcaagtttgttatgttgtcttatgaccatccctttgtaaatctttgttctccctccatggaatgctcttaccttcctcatttacttaaatgaactcctgctcattctccatggcatcttctaaaagtagcctttccttctgtgtgctgtcaccatacctatatacaccttggctatattgaataccacgcatagctctatttatttgttctttggggccagccttttgagattatcgactggtgtgtggtaagtattcagtaagtattggaagaaagaatggatgattgaaaatattatttgaaagacaataactattttctaaagaataaaatctgattataatatttgacatcagtagatacattttttttccagaaaaggtgattgtttgccttaatttccgagtaaaaaaggatatatgtttacaacagggtgtatgttgtggctgtaggagagaatgatgctaactggttcacatgggtagcagacacgtgaccttggcctctttagcatggtcctctaatcagctgatttaattttagtggaatccctgaagaaatgctctggttctatatgtggaatgtagaaatcataaatctaatgtatagatcctgactgcattagggtttgtggattaaaaccaacaaatagactgtgtaggtattatgacattataactgggccagtgtaggcattatgacagtgataatttttttcatctcaaatattatgaaattaattccagaatgttatctgaagttttgtcatttcatttcagcatgtaatttctcaagccaattttaatttaaaaagatctgagtagaatcattgccgtttgtccagaagtttagaataataggattagaataataaattaataagtattgagtgcctacttagagtttaatactgttagtaatacataaaaagtatgactttgaccttgatgtcaagtgtcctatattttatcgatggcataagagaacacagatgtaaaatgatttctagatgtttttttccaaccctcactatctgaaaataggaagctaagtggaaaaatgcacaggctttggaatccaaacagatctgggttagaatcctggctttttaaaaaaaatgaaataatgagtatataaccatggtcaccttgacatcactggaactctgtttctgtgtttgcaaagtggagtaagaatgtatactaggcagggcatagtggctcacacctgtaatcccagcactttggaaggccgaggtgtggaaatcgactgaggtcaggagttcgagaccagcctggccaatatggtgtaaccccatctgtactaaaaatacaaaaattacccaggcccggtggcgcttgcctgtaatcccagctactcaggaggctgaggcaggagaattgcttgaatccgggaggcagaggttgcagtgagctgagatggcacgaccgcactccagcctgggcgacagagtgagactccattgcaaaaacaacaacaacaacaacaaaaagaatatatactagtgttggtgtttttatttttttgaaatagcgatgacacatataaaactcttggaacgtaataagtgctcttaatgtacgtttgagtcaaagagtagataaatggagctttgttttgcaactttccacttagtctaggccattgctgatagatttcttcataataagtcaagtttagtaattgagttgatgggcactctcagaaactgctttagtctccctcttgtagaataaggtgactgtgcttattatacttaataattattagtgcttttaatactaattaattattagtgcttatcatacttaatacttagccagtggaaccatggtgtccataggaatgctttcacacaaggaatggcttgttaaggtcaacaaggagcgaaataagaaaacaaatatctcagagatgggctaatcatattgtcccccaccccgcactgcaatgtgggtttcagttgttagcatgtgcttcatcctttgctgttttccacaacagttataaagctttttctagatgcctgtgtgttaactagaggcatcttgactcttttgacttctctaattgttctaaattgtttaagttttctgtggggtagatgactgttattatactaaattattcttctttcctgtcttttttttttttttttttttttttttttgctggagagttggtgccctggagttgagtctctgctttgcaaactgaaaatacaattttcctgtgtgtgccttatttttttcattccttttctccctttcctactacaaggctctgacctgcttggagcccttattacttggtcacaattgatactttgtccttcagagtcacataggacatagccactgcgttgattcagtgctcagctatcaaatatggctctgagaaggaattacttctctagaatgcaaagtgggcatctgagccagagaatgaagccctggtccatatttagtcattatttagggagagtgaggagtaacaatttcaaaattagagtttggattaagcaaagaaaatactagtcacaaattggctggtgtatgaggtgagtagagctggatttttaccagaagtagaaacctttgtaggaactgcctgtggttcaagaagttatgtatattttatggtatatctatgattatgaaaggataattttctaaaagtttatgttcttcctctggggattgttaacatctgttaatatccacaggaattttactaataataatgccaacttactcttgattcagtccctttgacacagggacccaaactaatttacattaattttgtcagtaattcttataatatccctgtgtgggagctgctttttagatgaggtatgtgagaatttgttaagtttacatagtgggtcagtcccttggatggaaagttggacccaggatttgtgcttccaggcttagtgtgtttgatcactgaagtgtgcagtctttttacctaattctcctccccatttattcttcctatgatggaggaaatcatatcaaggaaatagcaggagaattccatcttctaagaggttaaagacttttctgccttgaggcgtggagttcccaatccttggcttaggatggaaggaaacagcggaacactgtgatgttcagctgaaatgacccaactgtttttttgcatagttttttgttctctttttaaaaattctcctgttgggaggaggtgaatgtgagaattttctctctgccaatcttatatgtgaggcaggtggcttggttgtttttaatgctcagcagatatcactacttgcttttgggttggggaccagagaggaggaggtgaagcagccacttttgggtggggttgagaggagggtacaatgttggaaggaggacatttctctgtgttttcttagtcataggactctgaatcccaagtagctaaatttagctcaggttcctgttgaaagcatcgtctttttggggcgggtggtgtggggagaacggaaaacctttttgtgtatcctgctccatgaagccaatagggaagcaggaggaggtgaggttaccatggagatggtagctgtgtgcaaggggagagcagcagggtttagaattccaggaaggaagagagagtgatgtcatcagattccatggaccagcccaggaacccctgtgaggttggtggggagttgggtgtgtggggggtggtggagtgggagtttgtgcaggggaattgtggcttcagtaaggtgtggggagtccagttcaagcagagaggtcggtcgtgtggaattgtgctgagctgcattaatgcctgatttaaaaaaaaatctggaaaccattctgaatttgcagagtattttctttgttgaaagaagacatttatttaacaaaggagctcatctagatgtagcaatgtaatatctttttatagttgtatccctgaagtatttgtgtgtgcctttatcccttgtatgtgagggtatttgtgtgcatattttagtatatagttgcctttgtacaataccttttatggtgctgcatgcagttaaatgcttcattaatgcctgctgatggtattttttttatatggatgggtgtatataaataaaacacacttaaaaataatctgaaaagaatatcaaagcagttgctttttcagcagaaaggaaaactgcatgcttcaagacagttgttctgaacatatgcatgtttgtgctgatagtgaagggcaaatgtgtttcttttggtatgactaagaggctgctttttttttttaaacaaatataacagaacctgtgcatccaaatgaatattgcccttcaaaatagtcaccttggttggtgatacaaccattgcgcaaaacctgaggaactctcattcggaatcggctttagagatgagtgatgaggaaaacgttttcaatacctaacactgaatttttttatttaaaaaaatacctacctaggtttttgaaagacactaggtttcttcgaattggctcttcgtgattttgtggtgttgtcaaaaagtcaaatctgtgctcaaatggtgagcttttaccccatttgaagatacttaaagtcatgggtttaggctctgaaggcattttcattttcagatcaagggctctttaaatgtttagtttagcagtggccgtgttttgaatgatggtagcatctgaggaataagaacatagccttcccagggcgacatcttctgaggtgacccatttggatttatttgttcaagtgtgtctgttaaaatcagtgacattaccattgggtaatgtgggaagcagctttagatggtgtgtctgagggcacagactctttgaaatcgggttggttcaagtctgaacccctgttctgcagttcactcactgaccttggacaagttagtctcttggtgcgttggcttcctcatgtgtaaaatgggaatgatagtgctgtgagtaccaacctcacagtgtggtttgaggactaagtaagctaatatataaagctcttagacatttggtgtgttctcagtcagtgcttgctgtgattattgtcggtaataattatatatttctttgaattacagaattctgaggtagaatgtgcctggagatagtatagctcagtagtccctgttctgtacagttggcgtattgtatctgtggggtccacatctgtgcattcaaccaaccacggattgaaaataattcagaaaaaaaataacaatgcaacaataaaaataatacaaataaaaatactaaataactacgtagcatttacactgtattaggtattataagtgatctggagatgatttaaaatctctgggaggatatacataggttatatgtaaatactgtgctattatacatcagggacttgagcatctgtggattttggtgtctgagaggggtcctcaaaacagtcccccatggacatcaagggatgactgtattgaagtcaacctggacctcattccagacactactgaatcaaggagggaaatctgtagtttttagattattcccaggtgattcaaatgatcggtcaagattgggaactattgagtataatctgtttacagtatggccccagcactagaagcttcatttcctggtagatgcagaaatctcagacgccactgtagacctactgaatcagaatctacattttaacaagatacctagtgacctgtctgcatgctaacatttgagaagcactgcttttcttctaccaatgggaataattgggtgataaccgcaggttaaagatgaattatctctccatttttcccattgctggaagggaaacagtgtggctaaaccagtgtatagataatcatacacttaccttccctatttcttggcctaggggtaaatgcttttctggactaaactgctgcgtaacatgtaacagaaagaacagttataattatggctctggctctactgtttactagctatttggcctggatccagtcacttaatctctctgagtctgactctcctcacctgataatggaaataatacccagaaataatgtatatcaattatctagcgcattgcagtgcctgcatatgtcactggcttttccttttcccttgccttcaacctttcattgataaatctgtagtgtagttctagtcccttagaaagggccaccagtggagtctcagtaccatctcatctctgtgggctcttcttgcccttctcccagctatcttgagtatttaattgtacttgcagaaaactaagctttacacaatatatatatatatatagttttctctatctgtttctgcaaaatgccttttacttaatggagactattatctaagagggctagaagatgaagaactaaaggatttgagtaattgagttgatacaggaatcaaagtataacgagatatgacaggcagctcttttatgaattcttaatagttgaccatttgtttaaaaaaatgtaattcctggtttttaaaacttggcatcaagaaaaaaaatcctcggtaggtttgaagttgtttgaagtcttttagattggttccaagcaagaattaacgtggtaattatcagaagatcactgaattggtaagtaatgagcattatcttctttctgaccagggaattaatacaataaaaggaagttcagggacttgctctgaggacactagtagtaggtggcagagagtctaggtcagagagttggcagttgtagccagtagggcattggaagcaacagcagcaggaggaaatagaaaagtccagttttacccagatcttaatggacttagggataggcaggattgtgaactcaaagcatataataaaaattgttacaataatagtttttctctatggggtaggtatactttcaggtgctttgtataccttgtgcctaaacttaacatccttgcaaggtgtagacatgatcacatatattttatagaccagaaaataaaattgaggcccagaaaggtgagtaacttgtcctaagttgttcctctaataaacaccagagctggtttaacatcatgttcaatagcaatgtgagtgaagagactgttataaaactcaattgaaataatgtctatcaattaaaataaaatttattattttgtctataatgactttttttggggtagaattgttaatttaaatttagactgtgatagtcaactcagcctgtcttaaagggacttttttgaatgttgcagaatgatcctttgaaatgtatttcttttatactctgaggctaattaagaggtatcttttgtttttttaaatgccaaagcttgtgaagtcttcagtttagtgaaacaccagtttaaattgaaatatcacaacacaaactgatttgttggtggttatcaattggcatatttagtcataatgagtattcacataattgtgtctgttagtctgttattccattcagatccagatgtagataattatcaatgattgcacagagtgaatcatgtatttagacagatttctaagttacggttggaagaactacaaatgagaggacttgggttccaggcctgtttttgtgaccttggacatgtcacttgaaactcaagggaatgaacctgagtttccattatcaatcaaaagagaataatgttatctatctaacagaattgttatgagtaggaggatgtgcttgacaccaatttctgcttcttagactagctctgtaaccttgagaaagacatttaaaaccttgtggtacattggttttcttatctgtaaggtcagtctgtgctatgtgaatatggttgcaaggtaaggagggtgcaagtaaagtagctgaattagaattagatgatccctatgggtcccctcataatctgtggtcctgtactagtcagaactgcctgtgtgttggtatgtggtgaagtgttacatacaactaagatactgtttcttcttattattattgttaacagggccaccccattaaggaacaggcactgtgtaagatattgcatgtattacctcaatccttgtaacaatcctatgaggtaggtagtattctcatttaaagatggaagaatttgaggctgagagatgaattagctttccacagccatagagctagttggttaccagagacgtagatcagtgtgattctaataactgtactttcccccatacctcactacacatgctactgtgacaggccaaaactaggacatgggcttattatgccacaaactgcctgtaccaaagaatgtaatgacgactgagtagttatgttcttcaccaccaaacacttaacagttaaagaaggggagaaagacagtttcacttcagtgttcctgctgaagtagtaaaaattattactattactaattctccatcctcggttatgaatcttttaaataatctctttggcaaaatgggtaatacaaataaagcacttctgctgcatactaagtatgacagttatctaaaggaaaactgcttctgtgattgagttgccagctgaacttttttcatgggatgccatttttatttgaaagaacaactgatagactatggtattcggacgttttattaaaaatgaatgaggtggccaggcgcagtggctcacacctgtaatcccagcactttgggaggctgaggcgggggatcatgaggtcaggagatcgagaccatcctggccaacatggtgaaaccccgtctctactaaaaatacaaaaattagccgggtgtgctggcatgtgcctgtagtcccagctacctgggaggctgaggtgggaaaattgcttgaacccaggaggtggaggttgctgtgagctgagattgtaccattgcactccaggctgggcaacagagcaggaccctgtcttaattaaaaaaaaaaaaatgaagcaagcctgtcattttaaggaaaactgatatttgtggccagtgataaaatttgaactttcaagcaaaaactagagttttggaaaacttgtatcctggcctatgagcttgacagctctgaaccttaaaagacttttcagatgagattggtggtgatattagtgaatgtgaattttttgatgttatataatgagatgtgtcaacagttggaagatctttataacttagtgaacttgtattttataaatgaacaacacataatgttacaaaatcatgcataggcaaaaaaaatctattccaagtacaagatcaatgaatttttatattaacagtatgaaaaaattcattgataaggtttcacatgccacattgcaactaacctttggtacagtattaaagaagaatatctagagataggcgaaaaggctattaaaataccttgcctcttccagatacatatccatggaatgccaaatttctttcttatacttcagaataatattgaaacagattgaatgcagaagcaggtatgagaatccagccatcctccattccatctccaatccccaggccacagtctggtactggcttgtggcctgttaggaaccaggccacacggcaggaggtgagcagcaagcactactgcctgagcaccacatcctatcagatcagtggcggcattagattctcataagagtgcataccctactgtgaactgcgcgtgcgagggatctaggttgcctgttccatcgaatgcctgatgacttgaggtggaacagtttcatcttgaaactatccccaccctaccccaccccccatggaaaaattatctcccatgaaaccagtccctgtgccaaaaagattggggaccactgttctattaagttggatgttaaaaatatttgtagaaatgtaaaataatgatactcttctcactggtttagtttacaaactaaaccattttcataaaatattttttaggctaatataatggttggtttattattgatacttttaaaggaattaacatatttttaaaagtactcagttttagtttctcataggaaaatcgcagtagttataaccacagaagcaaaagctctttggagtctttggtaattttttaaagtgttaaggtattctgaaatcaaaaaagtttgagaattgcagctctagttctctaatctttcatttcagtagtggttgaaacctcttaaattggttctttaagtcatgaatggatcttgacccacaaattgaaagagcgtgggctagagttagaggattacattgtgaagggaggtgggattttgctgaattttgcttgagttgatgtttgagaacgtgccaaggtgtgaagtaaattgagtaaagtttctatctggaaattagctatttgtggtcatcctccaaaccccattcaagtcttacctactgtgagtctcctctttgtaatttctttatgcctttctcacttgattatcaaccatgtacactggttctctctgggccatacatttacattttattacatggttcatattgtatttgtttacatgcctctttcccttactagactgtgagttcttttgagaaaagaatccctagcttattttcctttgcattcctaccaagttgcagacacataaacgtccctcagtaaatgtttgctgaaggagtaaatgagaagaaaaagagaataaccaagtggggcaaggcttgggatatttggaacctaatcatgtaagcaatggagggccattactatggaagtggtatgagtggtgttttaggtagttaaccctggccctggtaagaaagctgggcaggggtggatggaggctagctcttagctggaccagccaagagactattagagtaatttaagcttgaagtgatccaggcctggattaagatgagtgctttcgccatagataataaggcatacatcctgaatcctgaggagtatttgcaaaaacagaaacaataccatccatactgcttgacagttgttgtgtacttatgctgaattctgtgttaagagctttatgtatattgtttcgtttaatcttcacagcttccctgaggtaggtgttgttattatctccatttttttctagttaagtacaaataatacatgttcatttgttgaacagttagaaaatacagataagaaacctcctccccccacaaagacatatatcactcataaatccaaatttaacaccaagacatatgaccactataaacattttgggatatatccttccagacataaaaaaacatatatattgtgtgttatatatgcctgaatatgaggaaaccatgaatataaggccttaatgctgtttttccattgaaaggaagggctaacctattaagcgtttagggaaataggcaaatatctacttaaaatatttatttatgtaatttagaaacattttatctttttgggaaaaaatgtgtatatgctctactgcatcagtatctgtattgttgcttagaaccactttgaatcttcagttttccagagtatatattgagatacagcacttttttgtgtctatatttattgtagtcactgatgattttatctcaagctgtaagtacttattcaaataacaacaggaagtttcttcatttgtactgtggtgtatactgcattgcttttaaaaaaaatgttaatggaggttaaattcatataacataaaattaaacttttaaaaaagtgaacaatttggtggcatttaatacgttcacagtgctgtacaaccactatctccatgtagcttacatttttacatcaccctcaatggatacatcacccgtatccattaagcaatcatcctgtctttccccttccctgctggcaaccaccaatctgctttctcttttgatgaatttacctgttctggagattttatataaatggagtcatataatatatggccttttatgtctggcttctttcacttagtactgtgtgttttcattgtttatccatgttgtagcatatatcagtacttctttcctttttataactgaatgatattcctttgtgtgtatatagcacaatttgtttatctgtttatcccttaatggacgtttgggtttccatcctttggcttttttttttttttttttttttttgagatggagtcccactctgtcgcccaggctggagcgcagtggtgtgatctctgctcactgcaagctctgcctcccaagttcatgccattctcctgcctcagcctcccaagcagctggaactacaggcacccgccaccaggcccagctaattttttgtatttttagtagagatgggatttcaccgtgttagccaggatggtctcaatctcctgacctcgtgatccgcccgccacagcctcccaaaattctgggattacaggtgtgagccactgcacccagcccatcctttggctattgtgagtagtgttgccatgaacatctgtgtacaagtattggttttgagtacctgttttccagttctttgggtatatacctaggagtggaattgctgggtcatatggtagctctatatttaactttttgaagaactgccaatctcttttccacagcagctgctccattttacattcccaccagcaaagtacaagtatttgtcaatttatttttaatgaagaacacaataagacagggaaagtaaagaggaagtatgtgtagcctttgagtctattagagctctgtatctcagattttgctgatggacttattaaatatttatttagcatcacttcagcactaaatgaaatttagctcagggaaatgaatctaatctgtttcaagtagtgaacagactaagaagtgatgatcagaggaatgaaggaatggaaatttaaatagactaaagttccttgagggcaaaggccttattcatctttgtgtcctcagcatttaacaaagtacttggtgtattataggtttttttggggggtctccaagactaccctaggtccagtgaattatctaggacttatggaactcagatgtagtcatacttatagctatgctttatactagtaaaaggctataaagcaatgtcagcaaagaaaaaaggtgcatgcggtgaagtccagaggaaacctgactcaagcttccaaaagtcctttccaagtggagtcacaggacttgcttgattcctccagcagtaagttgtaacagtgttgtctaccagggaagcttgttacagacttagtgctgagattttttggctggggatggtgaagggggctgttcacataagcaccctaaccctagcacaaatcaaaattccagactcccgaaaggaaagcaggcattaacagataagagccactctgatcagttctggggatagaacccttgtgaaatcttcagttctcagatactagctaaggccaaccttagcagtcagacctgctacgttaattctttttcacatagatgttcagtttctttaaaaaatatgttcttaggtctgtgaagaaaaataaacaccatagtagaaagccagcagggactttaatgtaagacagacctggatttgtaatatgggggaaaaattgtatagtttttctgagcctcagtttccttactataaagtgatatatcacagggttttagtgagaattaaaagtgataatgtttataaaacactaggcataatgtctgtcttatatatagtaagtagctgtcagcattttttttcagctcacttgtatcagtccaggtccagccaggagagagagactacacagtactttggacagggcatttaatataaagaattatttacctccaggcgcagtggcttatgcctgtaatcccagcactttgggaggccaaggcaggcggatcacctgtggttgggagttcaaaaccagcctgaccaacatagagaaaccccgtctctactaaaaatacagaattagccgggtgtggtggcacatgcctgtaatcccagctactcaggaggctgaggcaggagaatcgcttgaacccggaaggtggaggttgcagtgagccaagatcacgccactgcactccagcctgggcaacgagcaaaactccgtctcaaaaaaaaaaaaaaaaaaaaaaagggccgggtgcggtaatcccagcactttgggaggccaaggcaggcggaacacgaggtcaggagattgagaccatcctggctaacacggtgaaaccccgtctctactaaaaatacaaaaaatttagctgggcgtggtggcacgcgcctgtaatcccagctacctgggaggctgaggcaggagaatggcatgaacccgggaggtggaacttgcagtgagctgtgattgtaccactgcactccagcctgggcaacagagtgagactctatctccaaaaaaaaaaaaaaaaagaattctttaccataagaggagactgaaataatgagaaattgactcctaggaagaaaactctaaataacagcagatatagatctgctgtatctataataagaaatataataatatgattgatgtgtgacaaaatagaattagtataatagcagctaagcagctaccccgggaccgagatatcatacccaaagagccgtctccctcaataccaccaaacacttcctggccgagagactgaaatctgaggggctttggtggagaaggcatgactttgactctcagaatggcagagaagtaagtccctatggacttataccagcagaacttgctggaaatctgtccttttgaagttgccaaaaactaccctctaggatacttgggaaagctcttcacaaggagttgtctcaccagaggcactttgctgccatatgacaacatgaaaaggtttactgagggaagctactagctgctggctgctgtccattgtaggagctaggatggagggaaactgcttatcctgtaagaacctgctaggcaagcacaatgggacctggaagcgaaatgctttcctcctacagtgtatctcctgtgtcctctatgggtaaagcttgacatcatgcatgctttgcaaaggaaaagtatttaaagggcccaggttcattttcacacagccggcaaaaaaggtaaatttggagctgataatcaattaattgataaccagtatatagatggaatggatgtttaattctaaatcctcagaaaacaggaagaagatggcaaatggagagagatctaaggaacctcaaaaataagtaagacacatgcaaaaaaaaaaaaaaaaaatgaagttggaccttacatcaataccaaaattaactcaaaatggatcaaagacctaaacataagagctaaaactataaaactcttagaagaaaacttagagtaaatcctcgtgaccttggaattggcagtggattcttagacatgacaccaaaatcacaggcaacaaaagaaaaaacagataaattagactttatcaaaattaaaaacttttatgcatcaaaggacgctattaacagagtgaaaaggcaaccaactaatggaagaaagtatttgcaaaaatatatctgataagggattaatatccaaaatatataaagaacttttacaactcaacaacaaaaaagcaaatggcccaattataaaatgggcaggggacttgaatacacatttctccaaagaaggtatacaaatggtcaataagcacatgaaaagatgaaaaggacatgaaaagatgctcaacatcactaagttgtaaaggaaatataaatcaaaacaatgagataacacttcacactcattaggatgaaaatacacacacaataacaagtgtaagtaagaatacggagagattgaaactcttgtgctttgccggtggaaatttaaaatggttcagtgctgtggaaaacagtatggcagtcccttaaaaagttaaatattgtcactgtgcaaacaccaaagaattaccagtgatccagcagttctgcttctgaatatttacccaaaagcattgaaagcagggacttgaatagatatctgtacacccatattcatagcagctttattcacaatagttaaaaggtggaggcaacccaagtgtccattgacagatgaatggatggacaaaatgtgatttttacgtaccacatattgtaggctacaatacagtgatatgcacataaaattgtgttttatataattttaacacaatattattatttggacttagaaggaaattctgacacgtgctacaatatggatgaaccacaaagatatggtaagtgagataagtgcagtgagctgagattatgtcacggcgcaaataaatattgtttgactattcacgtgaggtacttaaagtagtcacattgatggagacaaagtagaatgctggttggcagtggacggagggagacaggaatggggagttagtgtttattgggtgcagcatttcagttggggaagatcagaaagttctggagatggatggaggtggttgcacaacaatataaatatacttaatgctatagaagtgtatactgaaaaatggctaaaatggtaactttatgtatatttaaccacagttttaaaaaaagatgaaaggaaactgcaaagaatatttatagtatgatcttgaacctcagtactagaaaagatagattaacggggaactttatttttaaaattttaattaaaaaaaatttttttttgagacagtctcactctgttgcccaggctagaatgctgtggtacaatctcagctcactgcagcttccacctcctggactcaagccatcctcccatttcagcctgtcaggtagctgggaccacaggtgtgcaccaccacacctggctaatttttattatttcttatagacccagggtctccttatgttggcccaggctggtctcgacctcttcccaccctggcttcccaaagtgctgagattacaggagtgagtcactgtgcctggccagaattttatttattatttatgtacttcaaaatataattttgtcatgattgaattttattttatttttttaaaatgcaagaacaaagtggatttgtaaagaaaattgaaagaactgagggtgttagccaaacaggaattgatgacagcagagtggactatctggctgtatgaagcatacgttgtcatacctgggctgtgtgatacggccttttgttccgaggctgcacatctgtacagcatgtgactatactgaatactttaggcagttgtaacacaatgtatctaaacatggaaacatgtatctaatgtatctaatttatctaaacatgtacagcaaaaatacagtataaaagataaaaatgatacacaggtatagggcacttgtgaatgcagcctggagaattggaagttgctgtggatgagtcagtgagtgagtgtgagtggatgtgaaggcttcgggcattactgtacactactgttgactttatcaacactgtacacttaggctacgctaaatttttacaaaattatttttctttaacaacaaatttgccttagcttactgtaacttttttactttataaactttaaaatttttttaactttttgattcttttgtaataacacttagcttaaaatataaacacattgtatagctgtacaaaaatattttatttgtattcttattctataaggtttttttaagatttttaatttttttttttttttttttttttttttttactttttaaacttttttttgttgaaagctaagacacaaacacacacattagcttaggcctccacggggacaaaatcatcagtatgctttccacctccacatccttcccactggaaggtggtaatggccagtaacacacatggagctgtcattttctatgataacaatgccgtgtgctggaagacctcaggaaggacctccctgaggtaacttttttttttacataagtagaaggagcacactctaatgaaaaaaagtatgatatagtaaatacatgaaccagtaaaataaccatttattatcatcaagcactgtgaactgtacattgttgtatgcgctagacttttatatgactggcagcacagtaggcttgtttacaccagcatcacacaaacacataagtaatgttttgtgccatgacagttatgatgtcactgtgataggagtttttcagcttcattataatcttttttttttgtggcagggaagagttttgctctgtcgcccaggctggagtgcagtggcacgatctcagctcactgcagcctctgcttcctgggttcaagcgattcttgtgccctcagcctcccaagtagttgggattacaggtgctcaccaccacacccggctaattttgtatttttagtagagatggggtttcgccatgttggccaggctggtctcgaactcctgacctcaggtgatcctccctcctcggcctcccagagtgctgggattacagatgtgagccactgtgcttgaccagcttcgttataatctcatgggactaccattgtttatgcaatcagttgttgaccaaagtattgtcatgtggccttgactgtgtatgtcacaaaaggcagagtttctttggtcactttagaggtattctcattcattctgttcttgaatactagaaacagtttataatatcactaggttttgaacaccttacagtgaggcagaatggccatttagcacatattcctaaatagctgatgtagaggaagctaaggaaattaaaggttggttatttggaaatgtgctactttgtaggatttattcccatagactatataattttgcaataaatagacgtgggggttgggaaggaattctttttgagcttctcctatatgttaaatattgtgccagataagcgtcacctgattatctcattggatgtcacaactttatgtggtagatattatctattacacagttgagaaaatttagagtcagagatattaaggattttgactagtcacatagttagaaagtgacccagccagaatttgaatctgtatcttcaactcccaaggttccgtccaacctttctattgcatgatgaaaggagttacatatatctgtaatataactagtagagtctgaagtgaatagtttatatgatttgagagtcaggagttgtaaattctgggttctctttcatacctacctagtttgagtgactgtgggcaaggcacttctctaagtctcagcttcctcacctgtaaagaaaaggggtttgattggttatttcttagacacctgcgaccactattgaagaaattttggtgtgtttcaaagataatcttcaagaacccagtaaatcctgtatcagattttaccatgaaacatactgcttataccagctgatttttaatttaaaaaaaaggggggagcggtaaatgtggagggagtagtgaatgtaacaaataactgtcattgattgtcttgatagggaggtagaatgagtttttttgcagcgaaagcttagtttactagttaacagttggacctcatgttgggaccatgttgttagatactatcagattcgtatcacttataagtcttcatcttatctctaggtattttgaactcttatggtttggaagcagaatgacgccctgtggtcacttagcaatttctcttcttgaggccaggcacagtggcttattcccgtaatcccagcactttgggaggccgaggcaggacttgaggccaggagtttgagaccagtctgtgcaacagagtgagaccttgtccctacaaaagataaaacaaaattagccgggtgtagtggcacatgcctgtagtcccagctactcaggaggctgggataggaggatcgcttgggtctgcgaggtcgaggctgcaatgagccatgttcatgccactgcactccagtccagcctgggcgacagtgtgagaccctcaaaaaaaaggtatatatttttttctcaagccagagagatttgttgctgggattagtttttgcatgtaatagcatatgggattttacatcttctgttcctgtggcattccttttatgtcccaattcaaaaataggctcaatacttgaaaaacaattaacttgctgcgaataacatagtgaaacatcctgagcaacttgatttgcttttttttagtcagtgtggtctgtttccttctgttattagatacatgcaaggtgatgtgaaattcattttcgactggggagtaagtcaatgaaaaatctgagctcgtacccattacccaagttatttgtagaagacagcttcattttgtatcttcctttgctttatctcgctttcttctctccaaactgcagagtggtaagaattctttttgttccattttcattattcttcccctttcattttgttagacacagaagaaaggcagtgggatggttttgtggatttgtttttttgttgtcgttgttgtttttcttgagactggctaatttttgtattttttggtatagatggggtttcactgtgttggccaggctagtctcgaatccctgacctcaaatgatcctcccacctcaccctcccaaagtgccgggattacagccgtgagccgccgcggctggccagatttgtttttttcattgcttggtttaactttgttgtgtatttccagttttctgcactctgctcatagccaactctcagcaatgatagaagccaggaagaaatactttgattggcagcatgatgtctttcttaagcttctcgggcaacttcactttggttattgttttattggtcaatgcttaggatttatggctagtatattatatcacaagtataactgtatggaaagcagagctttggagcttcagtattgttaagttttctttgtacctctcttaactgtatttttaaaatgctacaaaaaatagtaccttttttctcctctatgtgctatattctgggtaatttcaccagtattttcttgtaattttgccagtattctttctgggaaaatatattgactaatcattcagaaatgatattgataatttccagaaaagcatttagaaaaacggctttaaaaatcactgtcttttcagcatgtatcaattcaacatagtactggaggtcttgtcctaataggtttgaagttatcactcacctccatccccccacacacttttaaaaagatcttctgaagtcctgtagttatttttaatagattttagttatggtatcagtcgcactgtcttgtaattattatgactctcagctcctcaagggcaagaataccagcactatgtttctcaaagcagttgttcaatccactcttactgaataagtgaaggattcttctgcttaaagagattttacagatgtaggtacatataggagcatctaagcagccaaagaagaatataaaagtcagatgctatttttcttgctgtgtatcacttctgtctgtatccactgtacattcacagtccattggcagttgggttttttttgagacggagtctcgctctgtcgcccaggctggagtgcagtggcgcgatctcggctcactgcaagctctgcctcccgggttcatgccattctcctgcctcagcctcccgagtagctgggactacaggtgtccaccaccatgcccagctaattttttgtattttgtatttttagtagagatgggatttcactgtgttagccacgatggtctcaatctcctgatctcgtgatccacccacctcagcctcgcaaagtgctgggattacaggcgtgagccaccgcgcctggccagcagttggggtttttttgatagttacttaaggatttttctgttgcattgtcacatgtccactaaccagaagcttctaaacggttttaattgctgacctcttagttaataaagattcttacggttggtattttatttcttatgtatttctttttatttttgagcagtctctgtgccaagacagagtccgtttctttcattcttaataggccaataatgcttgcttatagacatatcgctactaaaaccttttctttttggacttctaacacatctgatttccatcttgtctgttccagtagcttttcttgtaatttcatctctgctttaaatgccagttattgtttttatgctgattaaaaactcagacttgcatatcattagataatcataatcatctctgaccagacgaggcaaatctttcccactattcgactggcacaaaatagttgcggtttttaccattactttaattttgcaccagcctaatagttgtcatgaagtagtagaagtattgggtatagaatcaagacctaagtctggaggcatctcagccactgtcattagttatttgattatgagcaaatcacttaaagtgtctgaaattcagttttgtcatctgtaaaatgacatttataaaacttgttttatgcattgtgaggactaagtgagatatatagttggttttataagttataaagcagtaagaaacactgacaacagctttattctaagtcatatgtgaattttacacaatgtaaaatttgggtaaaacatgtcctttcaaccttccacaaatcttattcttctccctagaggtaaccactattagaagtttgttatatatccttctttatattttcgatgcatttagttacctttttttttttttttaagagatgggatgtcgctgtgctgcccaggctatctcaaactccagggcttgagtgatcctcctgcctgagccttctgtgtagctagccatttctgcttgagtgttctgttctgctgtcatttaatatgacctgaggtcatttataaagattttaccttattttaaaaaccttgcaggtgggatgttgaaattttgcaataattgataacactattaccttattattaatggaaactgaggttttttttcctagtttttcactaaggcaaacaacactgttttgaaaatcttcgcacatgcttctttgtctagatagagatgtgaagttacaggaaggtatatgcattcaatattttgatagtactgccaaattactttccataacagcatcccaatatacttatattcctactattaggtgtgagagtatctattgactcatctttttgcctattcatggtgttttcatttttgctaatctcatatgtaaaacatggtatctcaaatctaaaagaatgttcgtaggcagcatggtgtgagcacaaaaaccattaagtggaaacaattcaattatccattaacaggaaaataggacagataagtaatttatttgacatgtttatagtttataagagaatactaaatggcaatcatagtaaaatacagttatgtgccctagtggaggtgaatcttacatagtattgagcaaaaatgccaaattactgaagaatacctgcaataggatccatgcctgtaaaattcaaaatcacgcaaaattaatgcatttgtaagagacagatatatacagggagggcttgagagttccaaatagccttatctgagaggtaggaaataaagaagagtgctaaggcaggtggaggagtaaatccatttcctctgacacatctctgtgcaacctgttatgaccaacttttctattgaagtttttgacaatactggcttatacgaatgtgatcttttccttatatttttttcattgttgaactccaggattttatggaatatggttcatatgtgggatgtcctctgggagtgatgaatttctgttaatatgcttttggggtttttgattactttcttaatcagataatccccttctcagacaatcatgaaatgtttattgtaagggaataatatggaatcattagtagggatgagaacctggaaaaatggaaagaacaggggtttgtagtccagcagacacaggttggcagtttgaatttcccattcaatatctatgtgttattgggccagttacttaccttctttcagttagtttccccagtgataggaaatatatttttgtatactgctatattatctcattctttttgcctctatctcttcctcttttccaccatcctggaactgtactgattaggtgcttaataactggggggttatcatcatcattgttaaaatttgtagagaatggtgtgtggaagtaaatttatagaatccagaacaaacaaaaggcacttgtgcatttcggaaagagccttgttcttttgttaaaatctaaactgcatgtctcccctataaaaatcagtatgaaaaatagccaacattgcctataactattattatttttaaataacagatttaatgagatataattcacagaccataaatctcgcatttatgaagtgcttttagtgtttcagtggtttttaatataataatggatgtgtgcatccatcactaaaatctaactccagaacattgtcatctccctccagataaacctggtagccgttagcagtcactgctcatttcttcccgctagtccctggaaccactaatttatattctgcctctatgaataatctgcctattcttgatatttcatacaaatcaaattatataatttgtggccttttgtgtctgttttcaagcatggtgttttcagtattcatctgtgttgtatctgtactttatttttaaaattactgaataatattccactatggatgtaccatacttcatttatccattcatcaatcgacggacattttggtttttttctgctgtttggttattatgaaataatgctgctatgaacattcatgtatattattttgtgtggacatatgttttcagttttcttagttacatacccaggtgtggaattgctgggtcatataactctatgtttaatagaaggactatccaactgtttccagagcagctataccattttacattcccacccgcagtgtagaagaattctgatttctccatgtctttgacaatacttattgttgtctggcattttgtttataaccattctgatgagtgtgagttttatctcaatgtggttttgatttgcataatgacttatgatgttgagcatctcttcatgtacttactggccatttgcacatctcttttgcagaactgtctgaattcctacacattttctggttatttagctccatttatttattacacattcttttgggtgtctacatgtgttagatactgtgctagatctcagggaaaccatgatgaacaagacacagggtctctgcagtaagcttaagttgtcttcagacttccatgcttttgactatcaaatatctgaatatagtcaacctaccaattagtggaaagtttactctattgttatattcaaaagtcctatcaatgaaaatttcttttacgctgttctgctagtaggaatgaaagtacagtgaatggaagaagaggatgaatatctaagtagcaatgttgagcactttgaaaattacaaaagcaatgtatgttctcatttactccttcgtgtgcacgtgcatcttccctcatttaaaagttcccttgaaagcaagggccttatttttaattcatctttttttactccatcagtcgactaacagtgcttggaaaatattaatattagtatatattaactgaatgattgaatgggtcaagtaagctggaaatgagtgttcatgttatatgaccttatactaaattagggtttgcatggcttttattagctatcatccttgccctcaaggatcttgacttagtggtttaaagtgaaaatgagacagatactcaacatgatatacctttaaaaaataaggttaattagaatcataagtaacataaaaagtaagctgcacaagtaagctaagtaaatattaaatattaggaggagtcacttgagtccataggatgatatagagtagtagaggaagtcttgaacagaggtcagatttcatccagatttcaaagaactgaggggataaaacaaaaaataaataaataaaaaagtaaaaactgaggggaaacaggctgatagagacgaagacctaaaacttttctgggttaagaggcagttctcagcagggttggtacttgtcccctttccatccaggggacatttggaaataaaccaacaagtttttggttatcctagtgtttaggggtgctaacggcttagtgtgagttggggctggggatgctgaagtcccacagtgtatgatgaagttaggaattaactctgaccccagtcgcagtagcaccctgcctaagatatactggaaaggaaacagatttagctgcataaggaagaaatagtttttatgaatagtgctcctaagcaaatactgttttttgtttttgccagtgtagaggcttaacgaggagatatatacacttaggtagggtggaatacagttaatggaacattttaggaaccagggcaggaatttatatttgatcagtttggatgattttgattatgcctaacattttctttcatctcatggtttgatatttttcttgtctttctcatagaacgagcctctgactccaggttatcatggattcccagcgcgggacagccaggttggtatctgctgtttgtaactcagatgatgtatgtgtgtggtgtgtttcatcaaagggttgctatgatagagagcatttcctgaaattacttactttgaaaggaaatgtggcttgtttcagcagtgaatttacttttacagatgtaaattaagcatatttttaaattctataagtattatgttattaaaattgtggatattagaagagaaaataatcactcaagcacagtcatgattggttttgtattttcttctccaggctacataataattttttgacctggttttcttgatgccttataattctgaatgctggacttgtctctttattacctgccagttagcccctgcctgcacagagtttttgagtccttgtaatgatctgtagcaagaaaattccattctcctccctgggggaattcagccttatggttttaatcagggaaagcttgcctgagaaagcaaagtttctgccacctttctttgttagatgggaggatgactggaaaagcccaggccctattatgggtcagagcagaattgcttcctacgagacaccctcagtatggtttaggcaagtgtgtaaaatgccttccctatctttttgttgtttgaatacttgagcccatgacgttgaaacagagttaggatagaagaacaggtaaggcttcctcttagagaaatggtgtggcttaaatcacctcgcctctgaaagaaatttgtatctttgatgtttggggatattgacgttcttcaggagatttgaaagggtagctcctagaaatatcttggaatgccattattccttacagggttgtcaaaaaaagctaccattgttatacttgtccaggagatatgagttacagtgctaaacgaaagagttcatagtgtcctttccagaagttcattgaatctcatcagagctcctgaagtggatcttaaaaactaggatggtcggctgggtgcggtggctcatgcctgtaatcccagtactttgggaggccaaggtgggtggatcatgaggtcaggagtttgagaccagcctggccaacatagtgaaaccccggctctactaaaaatacaaaaattagctgggtgtgatggtatgcagttgtagtcctggctactcgggaggctgaggcaggagaattgcttgaactggggaggtagaggttgcagtgagctgagactacaccattgcattccagcctgagtgatagagcgagactttgtctcaaaaacaaaacataaaacaaacaaaaacaacaactacaaaaaaacaaaaactaggatggttgataatcaatagtcacctatttgcaggcctttcagatttgagagtatttgtccaattcttgcacttttggtgctgagttgatatcagagtggccccagataaggcatcgggagaagaagtgttgttagctctgtgttcatcccctactgagttcatcactgttgatattgaagatggaagcttttggtaaaagatagggccatttaccctaaatctaaagagaatgtaaagatttatttgtttttcattctggtttgtgtctgtcctagagcttctctaagctgggaaacttatgcctttgatagtacttttatatcttagtcatatatcagaaaaacattctcatacctggagatccaccccacggagtttctgattgggtaagtgtaagattgggcttacccattcaaatgtttaaaaatcccaaaggtgattctgctgtgtagtgcggttgagaactacagtcctatgggctgctttaaaagcagtgacagtttctgtttcatcctgtacttttcacttaggacatgtaataaaggggtcgtggttagtctcttaatctagtcttgcaaactaatgcagttactttattatttataaaatgttgcttattgtggatttaggaaggtaaagctaattgatgtaaagtatggaaatagacttactgagtttagaagactgaaagggtactgtattcttcttgtggggattatagatcaataaggagctaagcaaaaggagttaataggaatttattaaagcctaaaaaagtagtctctttgattgtacctactttttctttcttttgcagtaggggcccacttctgtaacctgcacattcattactcatgctgtctctgctgcaggcctgttacagaccctttgccatggtttaaagctgctgatttactttgaggcacattctgatggtgacaggtttattttagtttattttcttgggctttaatttgtactctggttggatctttgaattagagatcttagagtgtgcaaataggcaaatattgaatagctgcttgttgtatttgatgaatacagaatccaaatgagtactgctaattaatgcgcctaaccttgtgaactctcactttgcgttttgagatttgggaggcatttatcagcgtgaaacactggtcgctgaacagtctgagctggcggaaatggaacttgtgatctttacgtctcctcagcatggttttggctcagcaaatcgaggaactggggaatggggtgaaggtgaattttaattgtgcttttgtttgctttcccttttttttttttttttttttgttgttgttggtttggtttggtttttgagacagggtcttgctctgtcacccatactggagtgcagtggcatgaacatggctcactgcagccttgacccctggggtgcaagtgattctcccacctcagcctcctgagtagctgggaccacaggtgtgtgccaccacacccggcctgtttgctttccttattctttcactgttccttcctaaatagatgagaaccatctgcagacaagattcttatcagtggctgaatggtgatttaaaaagagataactcttttgattgttttggaccactttcattgtattttctcatcttattctcccaaacaccccttttgaagtagatgaggcaaatattccctctggaaagatgaggaaattgaagcacacagaggtaaagtgacttatccaaggcaacaattcaagtaagtagctaaataagagctgaaatttccccttctgtctgagggtccttttctctgtactggagaattattgattgaccataggaaaatgtggtcacgtgtgaatgtgcccattcactcatttacattattttatttaccatgtgggggcttcgtagacttcttcaagctcaaccacagatgtagaagtctgtgactcctgattaaagattattactactaagtttgttagcaccaagtgtaccaccagcatttcacttttttagtgattcttttgtcatgttatatacagtcccaatagcacattggagttaaacacctgaaggaaaggagcagggaaaaccacccgccacctcttgcatgtttatgcaaggtcacctcagccttctttcttgatctattaagaagctttatgggatgacaatccattgcttttataaagcactctgagcatttcactatactttctaatgtggtttctctatggaagtggaggagacaaacattgttccagttttacataagtgaaaactagttcagaaaagtgagaaattttatctaaggccatgcaggaccaagtgcagtggcttacatctataatcccagcactttgggaggccaaggcaggaggattgtttgagctcaggagttggagaccagcctgggcaacatagcaagaccttgtctctactaaaaataaaaaaaatcagccgggtgtagtggtgtgtgcctgtagtcccagctactcgggaggctgaggtgggaggattgctggaacctgggagattgaggctgtggtgagctatgattgtgccactgcgctccagcctgggtgacagaacaagaccctgtctcaaaaataaatgaataaataaacccaggcaggattttagattgatgatacaatgtagtggtttagattcctagttgactgtttgtgatttgtgcatgtgcttaggcgtgttcccaggccttgattaaggctagaatgttttatggatttgcagtatttttaaagtgggagaatacttatgtgcatcagctctagggtttttatataagaagagcttaagagcagcaatctgattagaagagggccttgttctgcacagcagccttactgtttttgcgaagattatttatatgggatggctcttaggggtttcctagaaagtgatgggggtcctaaggctcctaaggctggcccctcgctcgcttttggtgcaacaactttatgtctgttataaataaggtgaccatataaactttagcattcaagttggggcacttttgagaataaaaagtgatgccaataattagtttcaaacagtcccaggtaaactgggatgtatggccatccttctctaattgaagaaatacagtcagtgttttcttaaccaaagtgatcagaactagtaggccgtgggttaatctaaacaattggttgaagtggggaaatattttaaacttttattttaatatagagcatttttaatttaaacaaatatatgcttactctttagtttcctgatatgaggtcaagatccttatatatagatgtgattgaaatactacttgaattttttgcataaactgtgctcccagagcatcatctgtgagttctaatttgtttttttttttaaagaggaacacggtcttgatgacattcagagcaatttgggtgaaactgtctatctagatttgtatggttttcccttcttgcccggtcttttacagttatcctgcccacatctaatttgagcctaagttttcagtgtcttgacttatttttcacaaagcattcacattagttattttcaaggaaattttctaatttatttcattgatgtgtgtatatatatatatatatatatatatataacatttaattatataattataagaacttacgacttctataaactggcaggtgaataaacacaagtgatttttggtaagcatacaactcagctactgggagaagaaagggcttgggggcaaataggagagagttgtttactagttttaggtggtttaagactgttaaaagcgtccctttattagacttgggaactggagaacattagttaatttaacaagttaattgattaaaagaggcttatactttaatcaaccacagggaagacttacttttgtttcatcaattttgtatctccttagtggttacttgactaaattttgttctattgttttagagtcaactcggtttgggggatgggtagggaagaggattagaacagatacacacaaactagagataatttgttttgcttcattggggtggcctaaccaagtaagggatgttcagcagtgggatacttgcaaaactaagtgttgaaagctttcattatttcatcattaaaaattatttaagctgtagtgtactattttgtttattaattgatgaatacaaatgtatatatttgtggtacacaaaaaacccaactaatatctgctaactgctttacagtttacaaaaccctcctgtgtatatccacttttgatcttcacaatagttcagctaggtggcttgggctttattatcccaattttatagataaaagaataccaaagcacagagactgtcaaatgaatctcccagtcttagttatataggtagtaagtaaagaattggacttgaaccccgattttcagcctccatgtcttgtatttcccttttgtatttgtctgtcagtgtctctctgaatataagtgttcttttgctggtgtgacaagataagatattctggaatctttggagaatgtgggagcatgaagtcttcatatgacttgaaagttcttgagtaacttatttctgtcaagttttctatcttgtttgttaaaataacttatgatctaaattttatcttttcatattttaaatacaaagaaaaatgtcatgttgtcaatttttttgagactctgttgcccaggctggaatgaagtggcgcaatcttggctcactgcaacatttgcctcccgggttcaagtgattcttctgcctcagcctcctgagtagctgggattacagacatgcgacactaagcctggctaatttttgtatttttagtagagacagtgttttgccatgttggccaggctgatctcaaacttctgacctcaggtgatctgctcacctcagcctcccaaagtgctggaattacagatgtgaaccaccacgcggggcccattctttgatgtttaaaatgcttgtcaatgacttctcaaaactatatttttttcttcaattttctaaaattctgttgaaagacacaatgtcccattgattagcagaaacaagtgggaacatcaaaggagatgcttaagttgacaaatataacatagacaattatagatttaaattcagagtggcagccttacttttaataagagggtaaatttaaaatgacctaagggtttcttttcttaacaagtattttctttcctcaagattttttttttcttttttctaaccagttttttcatgggtagaaaatgaactttattttagtcaaatttttgcaatgaactttcaaggctttttttttattgggagctgtggacaacagcaaatatatcttctgtagtgctcatttggcttgattgaagaaatgatgactacttttcttccctcggggatagttggtggaatggaggacatggtaagtgtgttcaggttctagcttagtgcttttgagcttaaaaaaagactgaccccaaggaggcagttgcttttatgtcatgacccagtatacacacatacatatatgttgactataacttagaattagtcttaccaaatgctgcctatcttaaccatgttctaagtactgtgatattttctgtccccttcaaaaaattgtcgattgtgactaacgattgaccaaaattgatttctgctggatttttcctggacccactaatggattgcaacctgtttgaaaaacattgttctaatacttacattccttaaaaatgcaaccttaaagaaacctcatgcctttatttttttgagatggagtctcactttgtcacctaggctggagtgcagtggcatgatctctgctcattgcaacctccacctcccaggctcaagtggtcctcctacctcagcctcctgagtagctgggaccgcaggtgtgcacctccatgcccagctagtttttgtatttttggtagagatggggtttcaccatgttgcccaggttggtcttgaactcctgagttcatgcgttccacccgcctcaacctcccaaagtgctgggattacagccgtaagcttccatgccgggacacaagaaaccccataccttttagcagtcactcccctactttccatctctccacccaagctctaaggccccccagctggagactgaattaaaatggttcagaagtaaaacgttaccccttctgtatctcgcaatctataataattttctttctgatcctctttttttttttttttttaactaaacatgcttttgctttgctcttaaattacaggaagtgtgaaattgctttttttcccccctgttaggttgtctagaaccccactttcagcctttgtgcaaagctttttcaaactgttgcttctgtccaacatctgacctcaggtcacccatcaatagtttaggtccttctgtggtgttgtccttacaccctctagtggatgaaggtctggtatatgctgtagtgtctagtgttcttgtagcacttttctcaatccatgtaatcagctttactattacattttagatcatttcattcttcaaacagttaaaaatcttttcactccaggaaagactgttttatttcttctgctgctcactgccatgctaagtaatatgcttattctgctgtttcatgatttgtccaaattttggcactattctttggcttcctactgttgaagatgagaaattagcaattttattttattttatttttattttttgagacaaggtcttgttgtgttgcccaggcaggagtgcaggtgtgtcatcttggcttactgcaacctccgcctcctgggtacaagtgattcttgtgcctcatcctcccctgtagctggcattacaggcgcacaccaccaaacccgactactttttatatttttagtagagatggggttcctctgtgttggccaggctgatctcgaactcctgacctcaagtgatccgcctgcttcagcctcccaaagtgctgggattacaggtatgagccactgcgcctgcccagaaattagcagttttatagacctctttccttctaataaagccattttttgggtcaaatcaatatttattgatttgtgaatatataataattattatgactatttattttatatccaaacaaaatattattactttgcctgtcttacatatttgtttcccttggagttactatgtagagaaaataaatataaatatgtatttggctgttgctttttaaaaagctctatggccagcgcagtggctcacgcctgtaatcccagcactttgggagactgcggcgggggaatcacctgaggtctggagctcgaaaccagcctggccaacatggggaaaccctatctctactaaaaatacaaaaattagtggggcatggtggcgggtgcctgtaatcccagctacttgggagctgaggcacgagaatcgcttgaacccaggaggcggaggttgcagtgagctgagattatgccactgcactcgagcctgggcgacagagtgagactccgtctcaaaaaaaaaaaaaaaaaaaaaagttctattaagatgtcatttctatacctaaaatttactcaatgtaagtgacttgttcagtgatatttagtaaacgtatagagttgtgtcacagtccagctttagtacatttccctcattccccaaattctttcaaattcttttgcagtcattccctgctccctctccagtcctccctctctcccccagccaaccactgctctgctttctgactttataaaattgcctcttttgtgctggacacggtagctcatgcctgtataccagtactttgggaggccgaggcaggaggatcctttgagcccaggagttcaagaccagcgtgggcaacacagcgagaccatgtctcaaaaaaaacaaaaaaaatggtcgcttttggacattttatataaatggaattatatgatatatgtagtctttggcatgagatttcttacaattagtataatgtttttgaggttcatccaggttgtagtatgtatcactgtgtcattttttatttttttttgctaaataatatttcattatagtgatgtatcaccttttgtttatttgtttaccagttggtagatatttgtattgtttccaacttggctattatgaatagtgctgatatgaagaattacctgcaaatctgtgtgttgacatactttaatttctcttgggtagatttctaggagtggaattactgaggcaatggtaaactcatgtataatttcttctttttaagagaaataagccagtgtggtggctcatgcctgtaatcccagcactttgggaggctgaggtgggtggatcacttgaggtcaggagtttgagaccagcctggttaacccagttaaaccccatctctactagaaatacaaaaataaaataaataaaataaaataataataatcataataaaagagaaatgaggtcgccaatgctggagtgtggtggtgcaatcatagttcaatttagctttgaactcctgcctcaagtgatcctcctgtctcagcctccctgagtagctggtattaccagcttgagacaacgtggcctcatgcataacttttaaagaaaccacagactgttttccaaagtggcttggttttatctaactttttgttataatgagtgtatggtaatagctcattgtggtttaatttgcatttccctaataattaagtaggtaccttttcatgtgcttatcagccacttatgtttgctttggtgagatgtctattcaggtcttttgcccactttttatttggtttttcttcttattgagttgtaagaagtctttatatattctgggtacaagttctttgtcagatttacaatttgcaaatatttgttctcagttatgaggttttgtaatatgtatcttcgtccttctccaataaaagaaaacagaattgttttcatccatatttgctaagtttgcataaattctgaataactattttatgaaagcaactatgaaaacaggcatttgcctctctgctgaggcctggtggttccttcaaagaagatttgcaggtttgtagtggcttcgtgcttggctacagccttctcccgatgcttggtggcaagcatgtttgggcaggaaagctcttcatgtgatgaagagaaattgtgctgctttctgcatgtcctaaggtatatggcagagtgaggatcagctaggttcattggcttttatttttttaaactgtagcttctatataaagctgttttgtggcaatttctctgcagacagacagacagacacccctgcccccccaacagacacagacacacacacatatgcacacaccctccttggctttaggtttaaatatcaatcctgctgttgcaggctaaatgactttaggcaagtttttgttctctgagcctcaatttcttcatctgtgaaataggaataattcctattatgaaaggttgttacagtattagagataacatatgtaaatttcttggcatgtaaatagggctagtaagtcatttttctcatttattttatggaaaagaggccataaggaagctttacaagggaatgattagttctcacattctgatttaagtctattttctcattttccttttgattcttattcactatttgaaatgaattatctgtagatttgaaatttctagctcaggaatctagctgttggacatctccaagaaaaagaggtctttgtgaaggaaatgaaatctgtgtaagtttatttacctgactcttgggtcttggcagcatgcgtataagagggagtcatttttgggactttataacttgagcagaattttgtaaaaactgagccagacattcaaggctcgctacaatttgcttcccatttttccagctctgtttctcattactaccctagtaacatatttcttctgcttttttttttttttttttttttgagacggagtttcactcttgttgccccggctggagtgcaatggtgcgatcttggctcaccgcaacctccacctcccaggttcaagcaattctcctgcctcagcctcctgagtagctgggattacaggcatgtgccaccacacccagctaattttgtatttttagtagagacaggatttctccattttggtcaggctggtctcgaactcccaacctcaggtgatccacctgacttggcctcccaaagggctgggattataggcgtgagccactgtgcccggcctttcttctgctttatatatgtctcttcactgtccttcaaatatctatcttgggcatttatttcttcctaatgcctttcgtttgaaatgtttctcctttaccagcagaatcctaagtatccattaagatccttgttcacaacttaatctcccttatgaaatttttccttattgcctctgattgtttcaaatcgtttaacatgtctgtatgaacatttccataaagtttggatccaagagagtttgggaaatactgcgaggactaggaggaaatcacttaacttctctcaagactcagctttctgtgaatgtgaggataccataggatgtttgaaaggattaaagtcttaaaaatgtcctaggtcaagagtgacttattgcctgatgttgtgaaaataggttgcactaaactctgcctttggctttccaggtaacccagaaagtctcttctcatcttctcatctctgggcccaagtttcttctttttgctttaaggactctttggtggtaatgggtttggtttttgtgggtcctgggagtgtcatactttgagcgttctctcacctcctaaatccttcagggctactgtggatctgtggatagatgaatgatgccagaagtattaaaaatatggctggcttttattctcatcgctcttctgtacctggtttgtcacatcttgccttttatgccgcagtttgacttttccccctagctttgcctctttttgcttagtttagggttgctgggattgttgagctgtgattgttagtccactcatgacccagttgcttaaatattttgttaatggatggatcataatttcactgattgacttttcaatagattgacctgttattttgtatataggcaattgatttgtattgtaatgagaggtttaatgtgaccatcaaaaagaattatctgactaaagatagggccatttacaaaggaaaattatagaatttccattagcaattttcaaaatcgagaaattcatctgactagacttggttagggcagctaagtagttagtagggatattcttgctgtagcggttagtactaccaagcaatcgatggtcttttataatcaattctggctaccattttgtgagttacatttaagaagcttgacatatttattcagtgctttgttcttcaacagacagtcactggcagatgatttagaatgaaaccaactaattaagtataaggtaagacaaaaggcctcatagttggtggacaatatagttacgggtttcagttacagattaaatattttaattttcttaatagcattagctgcatactattatactgatctcatctagggttgattagagagacaggggaatacaacaggtaacttaagatcttgtgttagaaactttggtaccaccagaaaatactctcagcaagtactatgtaatcatgcatttaaacagctctgatctcactggagtctcattactctgcttagcttttatctgctgaatattctttagtgtgatatcctaagccttctgtgatatggcctcagtctttttccttctgttttgtgtaaggtactctgttcaagccacactgtggggtggggtagcgtagctttggaattaaatgtgggtttgaattctaattcctttacttacactatttcccatgtcccatgtttaaatacaggtcgtcctttaaatctcacttcaaatgctaccttctccttgaggttttggctagtgcatttatttgcgagctgactcagtgtcccagggcacatgctttctactttgctttttgtgttttttttggagacaggatctctctctgtccctcaggctggagtgcagtggcggagcctcgaactcctgggctcaagtaagtgatcctcccacctcagcctcccaagtagctggaactacaggcatgcatgtgctaccacgcctagctaattttttaatgttttatttttagtaaagacagcgtcttgctatgttgcccaggctggttttgaattcctgagctcaagcaatcctcttgcctcaggctcccaaagtgttgggattacaggtgtgagccactgcacccggccttctactttttttttaaatttttttattttttatttttattttttgagataaagtcttgctctgttgcccaggctggattgtagcggctggatctcggctcactgcaacctctgcctcctgagttcaagtgattctcctgtctcagcctcccgagtagctgagattacaagtatgcgccaccacgtctggctaacttttatatatatatatatttattttagtagagatggggtttcaccatgttggccagttcgagttggtcttgaactcctgacctcaagtgatccgcccacctcggcttcccagagtgctgggattacaggcgtgagccaccatgcccagcccagcctcctactttgtaatagtactttatcactgcctattgcattatggtgaaaaggtttgaccaacacacagaattctgtaagaacaagagttctctcatgcttcttagttttcttgaatactttgcacaaagtatgtgcccaatatgaatttggtaaagtgtggtaacgggataaattaaataaactcaacttcagcttgttgaaatacagagactactccatttggattttctcttatggacaaagtgggggaaaaagcaaaactgtggtcagactttcactaggtttttattgcctttgccttgccagagcgatatgaaaaattaatacttaagaagctagatatctgatgttcagcaagagagtgcctcttacaagtttaatgggtttggtcaagtggatattaaatgtaaatctgtcattttatggagccatagaaggctcttaagacactcaataaatatacttattgaattagtagaacttttcccatgtatctcctattactacattaggatctttgttcccttagtgtgtctttagcctgtgctctcacaagctttgtggtgtcgtgtggatcacaggatcgtttaagataaagatacttttagctctttaattctggtattctattattggtacagggaacccatacattatcttaatttcagagtaacacacgtctcggcatgggacagggggtgtcctaatgaaaagagggctaacaggtggaatactgactatgtgcaggcactgtataaagcaagtagtttttaaatcccatttgcaggtgaggaaaccaaggctcaaagggattaagtcattgtccaaggctatgtagttgttaatgagtgaatctgggttttaaaataaatgtgttaaattccagggttgatatttgcactgggcatttatttacttttatttgaatttttttttttttgcattttacttgcatgcttaatttttctttgctcagcagcaaacattatgttccccacttgcttcccacttgcttccctatttactaaggggtgatagttatgtgttatgtatctatagtcctgtatagtttacaggtattgctgtaatacctgtaatgggtattgctttcatacccattctcatttgatctttggtaagaccccagtgagtctttattatttgggtgggggggaagggttttaatctccattggcagatgaggaaatcaagatttgcagtttcctgagagatttgccaagggtggtaataagtggcataaaattggctttttaaaaaaaaccaattccttggccacaatttattaaaaaggcaaatggaatggtcctcctagaaaagatttggaagttagccagatgtggtggtgtgcacctgtagtctcagctactctagaggctgaggcaagaggatggcctgaacctaggagttcgaggcttcagtgagctgactgtgccagtgcactccagcctgggcgacaaaagaccctatctctaaaacaatatggaagtgtaagaagttggggaaataaaaggaaaaagaaaaaagaaaaaaaagatatgaaaggcctggagccctttcccccataaggctctgctgactggaagacagtttgaaaaccagtgaggaatgatcaaagaactctggtgtcagacagacctgagttcaaattccagtttggactgatacttaacttcccttaggcttacttcctcatttgtaagatgggatgcttttataggattgctgataagtattagccaaaaaacatgccagaaatctatcacagtaccttcagcttctgtggatgcaaggggagtgtgttaggcagtgtaggctgacccctcaccacgtgcaggactcacactaaatgttgggggaagtcattgctaagacagagccataggacttcaaacccagcacttcatacctgactgaaggttcaggtgtcacatttatcaatagtttaaaacaggagggggcaaactttctgtaaagcatctgagagcatctgggccatatggtctctgttagagctactcaggaactctggcacggtagcagggaagcaggcttagattatagtaaacaaaagattgtggctctattctagtaaaactttatttgtgggtaccgaaattttaatttcatataatttttatatgtcatgaaatgtcatttttcttttgattttttctttcaatcattacaagatgtaaaagctatcttagctggtagtctgtgtgtgggttctacaaaaacaagtagcccatagaccaaagtcctgatttagacatgtctagttttttttttttttgaaatggagtctagctctgtcacccagtctggagtgcagtggcgcaatcttggctgactgcaacctctgcctcccaggttcaagcaattcttctgcctcagccttctgactagctggaaaattagccaccatgcccggctaatttttgtatttttagtagagatggggtttcactatgttggtcaggctggcctcgaactcctgacctcgtgatctgcccgcgatggcctcccaaagtgctgggattacaggcatgagccaccatgcccggccttatcagtattcttaataccaacagagtttcacattgtatttgacactatttacaaactcagtttattccctctgtgtgaatactagccatttctaaaatgaaatgcaattgtgatttaaatttcacatatcattatgctaaatgctgttcactttttgttccatggtcctgaaacaattaacctgtttggagataagctgcagatacaagcacacagagaaggggacttaggaaagctggaggaaggaaaggtctgtcttgcctacatatgggcttaggaaaattttctaactggaaaccttgcctcaagtctgagtcacactagtgggactcttggccctagggtgggaggagaaaagggagggaaggaagtggctatgtcagtttttgtcaacagagggcacccagagcaaagcaagtgttctgtgacacaacagaatctgcccctctgccccagatgaatttaccagacaggcacagaacttcttgcagtggattctcttgtccatctcttcatttgtctgatctgtgtctgcattctcatgttttctcccatgctggaaccagaatattctaaatgcagtgttaataattgttatttgctgactgctttaagtggaagaccaattccctcaatgtgctggggtgaattatcccatgttgtaaggttggccttttgggtggatgtgcagtattagcttctaatttaattcagtatccagtgagcatgtattcctgaaatacttttgatgtgaaagagcacttcatacctgtataacatgttgtaagaagactttgtaagtcttattgcctagagcagtatcctcaaagtgtggcttcaaatccagccgcatcagcatcacctgggaacttacctttattcatggtctctgcctcttccccagacttactgaatcagaaactctgaggatggggtccagtaatctgttttaacatgctttggtaattcttatacacactcaacttgagaaccactgtcatagggtaaaggagtggaagagttaagggcactggtatttatggaagactatgtgccaagtacttggctaggagtttcctcttcattttccacatgagaacagcaagccttaaaagcattaagtgatttgccaaagtcgtacatagaataagtggtagaatagggatttgaaccctggtttttctgactcctgagccatactatagtggctggtaagaaaatgctaagaggcgttgcaatctttaaattaattcttttttaaaagtccttaaaatatttttttaaaacaaaagtaatttgcattcattgaagaaaatttagaatatacagcagatcaaaagaatagaataaaatctgccttaatatatttaactttatcttaacgttttgttgttgattatcttgtttcagcgtaactctgtttgcatatatacacattttaaaattccttaccagatgtcaatcatattgtgtaaacttttgtaaaatgcctccagctcaggcctactttattataaacatcgtttcatgccattagctatgtctgctgcatcatttcatggctgccaagtagtcccttgtaaggttgtaagcttttttatcataattcttgctaaagtccgtcttgttttgatttcatgatatgcttttaggaagaataggatactgagtgctttggtactatgggtaaacaatttgtccagagtggcttaaagtataaaattaaggcagtaagcagattttggttgagaaggggacatggaactggaaaggcaatactaaacatgtttgaggttaaagtgagcccagaaataagaaaacaaattgaagtaaaaaagccaaagtatcaggaatagactgggatctgtgagttagatgggttagaacaaataggaatactgatggtgaacaatttgatggcaccaacagcctgcttttattgttggctttttgacatagaggctgagctgccgaatgacagcatgagaaaaactgggcataagacttccataaatagcagttattatttattgaggaccttcatgaccaggcatcatattaatcatttaatttttataataaccacatgcaattagatacattagttttccccattttacagcagtggaaactgacagtgacatttaaagtaacttggccaaatgctttgattggaaccaaattagttaaaactcccaaacctgtgcttttatgctgtcgtttatcctcattctttttttcatggtgtggcaggtgtttagccactattctgtgtatatgtattgttttactatgtgagctgggacagaaggagactaggtgtgtaagaaaggacactaaagtccactagagtggaggtggacttgaagaacaaaacaaaactaatagcccagtcgttttcgtaggaaaggtgtaaacctgagctagatagtgcagtgagcagaggatgggaatagcaaagtgaatcattgataggaaggagcaggcaggcatttggaaacaagggatggctagaagaatcaaagttccctcattaaaatttccttcccaaaggaggtgatatactctccaagggcactttaaaacagctttattgagatataattcacatactgtacagttcacccatttaaagtgtgtggcttttagcatgtttacaatcattcagccatcaccatcaccacagtcagttttaggacatttttagtattccacaagaaactccattccccgtagttatcacttctttttcttttttttttttttgagacagtctcactctgttgcccaggctggagtgcagtagcatgatctcggctcactgcaacctccgcctcccaggttcaagctatccccctgcctcagccacctaagtagctaggactacaggcgcatgccacctgcctaattttcgtatttttagttgaggtggcatttcgccatgttggccaggctggccttgaactcctgacctcaagtgatccacgcgcctcagcctctgaatctgctggaattacaggcgtgagccactgctcctggccaatcatcacttcttaattcctctatgcccactacttccccagccctatgcaacaagtggtctccacttttctacagattttgcctattctgtatacagtttatataaatagactcaatagaatatgtggtcccttgtgtctggcttctttcacttagcataatgttttcacttagcacaatccatgttatagcagtacttcattttttaattgctaaataatacttcattatgtggatataccacatcttatttaatattttttttttatggtgggaaaacatgtttttatgttgggaaaagaaaggtgaagagactgagacaataaataggattattttccttaatttaaaatgggaggaataggtgactactatgaaaaccaaggctatcaggctttcttgaggaattgcagctaaaggcctaggtgacaggacagttggcatctgctgcttcatgaattgtttgtagcagagtggcagctcttttgacccgaacacgtgcagtattcagggagctcattgtgtaaatcttgtgtgttggccagcaccattgccccctacaatacctcatggggaactggagaggcctttgctgatctaatctggatacatttccctcagttactgcagctctgggtccccagagagtcctctctaaagagctgccagtttgttgagtgctggcatttgtaagattatttcttactatatgattcgtccagtgaagatgacacccatttatgaggtcctgatctattaagcagaaatagcaaccatcattcctgtgtttttggaatgaatgctgactctagggcccctgtatgctttctcagctgtagagtttggagggctcctttagcaagcaaacaatgtgcccttctgggtgccaggtgactttactgttgttctgttgattcctgttaattactttcttgatttaatctccaaggaatagagataccttcataaaatgagtggtatggctcaggatgtaagtctttttaatttgtacaccagaaatgttgtggatggctttctactttgccagaactttcagtttagtttagagagtgaattgtaatcatttgtcttgataccctggccctttggcatgtcagccctaacactgaaacaagaactctgggtagaggacatcagcttggccctcagttcctgagccattgaatgtcagcgctacatttaatcatatcacccccgttttacatttggggaaactgagttccagagaagttagatgacttaccaaatccatagtcttattttcttatagctcttgctagtggcaaagctgagtctgtgatattgagccttcattctcagtggagtgcttttttcccagtgcagagctgtttcctgaagaacatgtactgtcatgaccaaggagtggccaagccctgctgtactccatcagcagtgcaggctttaaggtgtatttgagagtttgacagattgcgattgtgatgatgaaaatttataggaaagagcaagagcactggtttgtgagtttgcacgccactgacttacagaacccagccccttctggcctccccttctcccagcctcccgtgcagtgcactgtgtccagtgagtatcttcatgactacgtgattataattccttgagagccccatgtctatttgctaaaaaataaatatgtgctgctacactaacctaacaagcagtcatcttgtagttcctgcctgaaaatgtttgatcatggttgtcaactctatgcctgctataatttttgcctagcataatgtgaagagaaaagataaaaatccttctctcactgtgcattttcactgtcccctcccctcattcttagtgtatagaattccagaatgggccttgctttctgacattttcctgccccatgaccctaacagatctattcaacatgaccctgacggctgagatagatctaaacccagccccttcacagtggaacacttaagctgggtagtagttccatactgagacccctttcagtactttctcttcctccccttcttttttgttgtgtcttcccctaccaacatgagctcctttttagggagaagttgtatccttcactcttttcccccatcacctaggagttgctcaatatagtcattaaataaattttggcattctcatgctgtttaccattcatgatgggatgggtaagatgcaggaatgctaataaggttgtcagatggccgtgttattcctttatagaagttgttttatggtccttaataataatttatagtaccaggtactatttactgaatgcttgctatgcatcaggtattgtgctaatgcacatatgcacataccatccacttttcattactctttttttttttttttaaatttttcagatagagtctctctgtgtctcccaggctggagtgcagtggcgtgatctcggcttgctgcaaaacctcctgcctcagcttccccagtagctgggattacaggcatgagccaccattcccagctaatttttgtatttttagtagagacggtttcatcatgatggccaggctggtctcgagcttctgatctcaggtgacccgcccgcgtcagcctcttaaagtgttgggattacaggcatgagctaccacggccggcccactcctcattactattaacaaccactctcctggctgggcacggtgacttgtgcctgtaaccccagccctttgggaggccgaggcaggcagatcacatgaggctaggcgttcaagaccagcatggacaacatggcgaaaccctgtctctactaaaaatacaaatattagccgggtttggtggcccatgcctgcaatcccaactacttgggaggctgaggcacgaggattgcttgaatccgggaggcagaggttgtagtgagccaagatcatgccactacactccagcctgagcaacagagtgagaccctgtcacaaacaaacaaacaaacatgcaaacacccattctctctataaggtggacagtagaagccatattttaccaatgaagaaactgggctttagagaagagcaagtcacagagctggaaagtggtagaacaggcatttaaatctaggttagcttgataccgaagcctatgtttttagtaaccatactgaacctccttgagtagttaatttgctgagcattactgtgaaagagagctaagtcacttatgttccctaggatttataaatgagacatctgtgttagcacagggcattagtaacatgatttagattaaatctggctttgggattaaagaatagagacaaagaggaggcatacggagcctctgccacttaacttcctggagctgatttgcttgtgctcagtattgaggaatctttcctctttgagtgagtgtagagtggttttgggtcatttgtagtctacacagtttctgagagatgatctgtccagcaattccagattgtttagggtgggcctgggagagggtatggcttactcctcgtttctggtgccgtattaaggtgaactagagctgattcatgtactggttgagactgtaaaaggacttccaggtttagtcattctgcaggaggctttctctttggtttaactgtagctcttcatccctcaccctggtttacataattgggactttaaaatttcattgtggctgtaagaacaaagggaatgcacttttcagcagctccttactgaccagtcgtgtggagtccctgtagtgtactcagggagagcggctgcctctctgattctctgcataaaacaaaagtattttgtacatagctttgaaatgggagagagaaacttctgaagaaaaaaagagttgtttggggtaataagattttgaggaggcagacacttcctgcattctcccctggggaaagaatctagctacaattgaagggcattgcctcaactaatttagttaagtggccccgtcctggattaataacttgggcagacttcccaatggatttggcagggtattgggtttctctctccccaaaccctcccttctctctgccctgcacatgtgtgctaacataattacagaaagttacaaggggatggggctgctcttaaaggaggtggctcagaggagagaatgtgattgtgtagtcctgtcatatttccgaaatggcagagttcgagtaaaatggtagggtggaagcaagcaggctggtttctctctgtaatggcaaagggggaggagggttggtggcagtgtcgatttcaagcacctagagcacacgagcactgggtactaattttgtgctagagaaatattaaactgtctttttgcatttgtttgtccagattgcattactaaggatctggtcattacagaacaacctttttgattaaggtcagaagttaacagtttttcaagtttggtggtcaagtgttcagaaatatttcacagatttagttgaaaacctgagcagatgcttttgctgttgtttacccccggggatcgggtgacattcttctcccttttcctcttccccacccctttgggaaccaaccaatcacgtagaggaatggatttcagtgcctaaggagtcagccaactccggagctgtagctgagactgaatgtttaactcttaggtatctgaatcacagggaatggcagacattgcagttagcttgttttcttgttggcatctactctcagagcccatccctaagggattgttcctaatgaggcgaggtacattgcattgaacttgaaggaactggcttttagccccaattctgccagtaactagtattgcaaccttggaaaagttattttctctttttagacttgcttctctttatgcacaatgagaggaaaaggagaaaatgggcatgtatggtatatcactatatattccagtggcgttttatcgctagccttgaggtttaggggaaaagcatttaacctgtattgagtgcctattctgaagcagtttgtttttatttgttaccttattaaattcttatgactctgcagggcaaatgctgttaacccaattttacagatgagaaaagtgtaggctagagaggctgtccagcttgcccaaggtcacttaaggaaggcccatctggctctaatgcccagactcttccattccactaggctggctaaaaaggccctagaagtcctgccagcattttcactctgatattctttaactccttcacagcttttaatcctgccctgtaggaggaccaaacattactgtctcctctttcacagccccgctactagagcaagtaaatgacttagggattcctccatcacctgaaagcagcaaaagaagatggtacagcattcaattttctccttcctccataaagaaattcccgtcctttatagccagctctgcccaccccttcctcattccccttttcttagacaggcagatattttcttttctctttccctttggcttgtgattatcaggtaaatatccctggtttgagggaggagcagaattttgattaggttaaaaaattatctttacccatagcctttctatgacatagatactacaatattgggtttatccccacctggaatttctatgatatctatatctataaacctatatagatttatagatatcatagaaattccaggtaggagtaaaccatatatatatcggtatatctctatccatctatatatatatatacacacacacacatacatatacacacatattataatgatataattatatatgtatacacacacacacacacacacacacacacaatagaaataacaggatatatatatcctgttaggcgctcccttaaagagctttatttttttgcttgtaaattatcctagccatctgatttaatagatacaccttacccaagagaacactttctgtttctcttcctgcagatcttactttttttactttttaaaaatagagacagagtctcactatgttgcccaggctgatcttgaactcgtgggctcaagcaatcttcctttcctcctctgcctctcaaagtgctgggattataggcaccagccactgcaactggccacggtttacttttaaattcacagagaaaatagctttttaaaggtgagttcttattaatattttggttacttccaattaaaaaaaaattacagtagaagccctaaaatgtcagatttgccaataaatcattttctgtcatttgttgtgggctaagaaaaatgacaatagacaaaaccattaacaattgaaatttattaagaaaggcactggcctaggtgttttatgtacattatttctaattttcatcttaattctgcatttgttgattacaaaacaggttaagaggggttaaagtacttgctcaaggtcactgctaatgaatggtgatttggcaatttgattgtaggtctgtttcactttcaaacctcagttctttcttcaatgccatgctgcctctgggatatgatcttgagagttttatttgatcattcatgctcatgcctcagctcagatcaccccggaaaacccatatatcttcttttaaaaagggaaatacattttatatgataagtttaacaactgaaaaaaaattaaaagaagtatttcctggtgtttgccaacttttacaatcaggtgacttttactggtgtttattttgaattatttttgttaaagtttggatccatcccttgttttaagtgaaaatgctaaatagctactcatcctcaggtactggagagcttaggggatttcactgtgaattgggtggacaggaagaggtaggccttaaaggttaagtaatatataggtagatggaaaaggtggaagaattttcttgcggtgaggaaatgttattgcttgctccatcacttggtacatcctgtgttcacaccatctgtttgagctcctgagaatgttgatgggaatctaatgaaagatgggttggtattaatgaatgctcatgttcttctcccttcctctcttgaggagttgcttgtgatttagctctgccacactttatgttgggctttcccagtggtgtgctctgagagattcatataagagaagtatacgtagtatgctgtttctgccatccagatcacctcaacaaatagttccataatgtttattatgtgcctgttatatgccagtcagttggcatgaccaactgatgatgctgagataagatgtgtcattgcccactaggcctttacgttgagtacaatttgcagtctcattcaggatacaagacctacaaacatggaattaacaaaaaagaagtatgtatttaagattaaaaaaaaatgagtgaaccaagaccagcaaatgttgttgaggtttagagatgaaaggggttaggatttgctggagcagtaaaaacagggttcattaaaaattttatccagagtatggagtggggaagggctggggtgagatgggatatgggtcatgccactgctagtgaaaggaaattgaaaatggctcattggattagaataaggtacttataccttctaaaattgttgatggagtcataggcagagattgggaaggggagattccaccaattagcattttaagtgaggagtgtaacgataccagcagctaatgtaaacaacaccaataataacaacttaatccctgagatcacaatttttaggaaaaatttcttacatttatttatattttggctcccttgattagctttcctctgattagagaatgtggtatcctgtatattaaaatacctttactcttgttggatttttaaaagatgcaaaactttaagataaatcagaggtcgattaagacaccagtaggccttgttgccatttccatttcccatatgcattgattactgtgtagcagtattcctgatgattgttgaatatttatgaggttctctcccaaaaaagcccaccaagtgaagaactatctttcattttttaagttcctgaaaattacctaaaactcttctgtaggagatggcttttacaaagaagattctttccttctcccttcccccaacccatagtagcttaacttaagtacctgggggagataaagataaatgtgggaaacttcaggatgaaagggacattattagagaccagagaagtcccgggaggtcatatcaggcttaaagtggaaactatgttacaacctaagcaaggagcaactgataggtctataaatagggttttatctcctcctagaaaatttttgtcatggttatagctttccatgtgggggactattatatttactaaaaataaaccgtttcagaaataattaaaataagtcccactgaactcatttatgttattaaaagtaaagtcatagcctgaaaataagtttatagagtttggcatgtactaattttaaggaacattttgatgctgcagccattgcttatatatgggatagaatggtaaagcccaaatggatttgtatggattaaaatagattaccttctcagaaaataatgttatttcagtttttttccgctagttcagaagaccctcaacctcctttgcatgcattcagacacataagttggcattacaaatgaatcatctagggaagtgggagtacttctaattctccaggaatctcacacagtaaagctgcttggatatggctattcagaacagaaaggtatagaaatggacaatggtatcccttccattggtattccttctgggcaacaaaaacccttaagctgtctgagtctgtttctcacacttctgttatcctgattgtagccctttaaattgtggagcaaattcttggcatctgtctgcctgtcagctacctatctctgacacccctggatagcttgttttcttcctatgagtatatgtgaaatttgtaaaaaagcatctattaatttaagtatcctgttagaagcctgcgaaaattcaaattgggcaaacaataaaattgcttaaaccgtgtttctcaaagttaatttgaccatagagtacttttcaaaatataatgaattgaataacacagcatcagtatgactcacgtacaatgtgtgtgtggattaaagtcaccagaagtagtgttaaaaagatgaattaatggcttcaggaagtgacttcattggctttttttcaaactttaaacattttggagaagttaaatcattttaagtataaaagttaaagagattcagttatattttgtttaaagagcaaaaaatcatgactttgttgaaattaagtaaatatttatgattgtcaatcatcaaaatagattacatttgtattgtctatgcctttgggtacaggttaaaaattatcttctttttctgcctaaaaaagaaagtaaggcccggcacagtggctcacgcctataatcccagcactttgggaggccgaggtgggtggatcacctaaggtcaggagttggagaccaacctggccaacatggcgaaacctgtctctactaaaaatacaaaaacattaaccgggcatggtggcttgtgcctgtaatcccagctacccaggaggctgaggcaggagaatcgcttgaatccgggaagcggaggttgcagtgagccgagattgtgccacttcgctccaacagggggactcacatgttacccttatttctcgaagacattgctcggagacattgcacttttcatgatagattgttgcatactaagtagaaactatatttgtatttagtatttttcttttgaatgaagaaaaatattgctagcgttacttttaaaattgttgtattaccttttgacaacttgtaaaatgctaaaacagggttacatatttcaggtgtatctgacttcctaattactttaagccttttactgctgttgttctttttctccccttacaacctctcaactcccttctttccacccatactttaaagaaggaaactgaaattcctgatgtaatgtatattttttcatatatatatgtttaagagactgggttttgctatgtggcttaggctggtctcaaattcctggccccaagcgatcctctcaccttggcctcttgagcagctgcaacaagaagcatgagccactgcaccaaacctgataacaatgattttctgaaagatagcgagatgtgctgggcgcagtggctcactcctgtaattccagcacttcgggaggccgaggtgggcagatcacgaggtcaggagatcgagaccatcctgactaacacagtgaaaccctgtctatactaaaaatacaaaaaattagccaggcgtggtggcgggcgcctgtagtcccagctacttgggaggctgaggcaggagaatggtgtgaacctgggaggtggaggttgcagtgagctgagatcatgccactgcactccagcctgggtgacagagcgagactccatctcaaaaaaaaaaaaaaaatagatgagaaattggatgaaagaggcttggcaagttcactgaattccttgagccccaaacctaagtttctgcctatttaataggtttcatctagtattttttattttgtgactcatatttaccaattggctattgtggtggtaattgtaatgataacaatagtatatattgctctgtttacataatagcctaacatacagatgttgaaccatccacaacttagaatggttctgcttaacagttttctgactttacaatggtacaaaagcaatacacattcagtagaaaccaatgttcattcagtagaaaccatctgagtacccattttttcacttttattataatattcagtaaattacatgagatattcaacactttattataaaataggcattgtgttaaatgattttacccaactgtaacctaatgtaagtgttctgagcatgtttaagataggctaggctaagctatgatgtttggtaggttaggtgtgttaaatgcatttttgacttactatattttcaacttatgatgagtttatagggacaaaatcccattgtaagttgaagaacatttgttctctatttgggtttgacaacatccctgtaatgtaggcattattaactccattttgcaggtgaagaaactgagtgtatccatatttgactgtttctcattatacgaattcaagaatggttaagttaaaattttatttctatcattttggtgtggaatagttatggatagtagatcagagtgatacaccagttgacttcttggcctaaacatttgaaatagacatttcaagattctttgacagtctctgttttggtcatcaaatgtgcacactgttgatgtgcataaagctttctgttgtttcaagtgaaattgaattttgggtagagcacagtggctcacacctgtaattccagcactttgggaggtcgaggcaggtagatctcttaaggtcagaagttcgagatcagtctggccgatgtgacaaaaacccgtctccactaaaaatacaaaaattagctgggcatggtggtgggtacctgtaatcccagctacttgggaggctgagcacaagaatctcttgaatccgggaggtgaaggttgcagtgagctggagtcacgccactgcattccagcctgcgcgacggagcgacactctgtttcaaaaaaaaaaatcgagttttgatttgtaagttaaagtaaataatttattattgaaaacatttaggattaagttcagctgcatataacaatctcctcttccccacacagaatcttaacaagagagagattcatttgtctttcatgaaaaagaagtctgaaattaggcagtccaggctaatatggcgctgtctggttaccaaggatctaagatccttactgctgtttacttctctgactgtaggatgggcctagatgattcagccatcatttccccctttccacaaagcagtttgagaggaagaaaagaggggtgtcccctcccctacctaagaaaacttccaggaagttccatgtaacatttctgcttatatctcattagtcggaattagtcttagggccatatgtagctgtagtggaggatggaagatgtagtccttttctggggaagcgtgtacagtaatatgctaaaatgaaaactggggttttgttactaaggaagaagagaagagaggatattgggaagccactaacattctcagctccagggcctatcagagtgacccagccttatctcccacatgatacagaagaccattctgcggcttccctgggagattttcaaccagtctttgccatgttttccaacaagatgatttttttcttgaaatgtatatacttttatgcaaagattttttaaaagctaaataatacaagattatggtaaggatcactgcagtttccattttaagatcaagtttgagtttttttccaaaattgattagtttgttggaaatggaaattcaaatggtatagaaagttttttggttttttgtttgtttgtttgtttgtttgggacagagtcttgctctgttggccaggctgggatgcagtggcgtgatcttggctcactgcagcctccacttcctgggttcaagcaattcttgtgactcagccacccaagtagctggactaacaggtgtgtgccaccacgcccggctaatttttgtatttttagtagagatggggtttcactctgttggccaggctggcctcctgacctgaagagatctgcctgcctcagccccagaaagtgctgggattacagacatgagccactgtgccaggccatagaatgaggttttaagtaagaataaagtatgtgtgaaatatttaaatatctgaccattggtaaaggaaaaagtgtgattttttttcttttgttttttgaagcctgggtaagtcattagattatacatttcttagggatagagaactcacttttataaaatgtatgattattgtattttgaataaataacatttacataagttaatattttaaaagtagaaaatggtcatatcgtgaaaagttgctctcccattcctgtcttgagttcccagtgtctttcccctacaggcactgggtgttttttacttcttgtgtataattcctcctttgatcttttcctcccatttaaaaaaccactggttttaaaaccattgctaaacctttcttttttccacttaatgacatatgcggtatgcatggcttaatgataaggatactttttgagaaatgtgtcattaggtgacttcattgtgaaaacatcatagaatgtacttacacaaacctagatatatacctgactatatattatatatggtacagcctaatgcctttaggctgcaaaccagtacagcatgttactctactgattactgtaggcaattgtaacacaatggcaaatattttcatatttaaacatatctaagcatggacaaggcacagtaaaaacatggcattatcatcttacgggaccaccatgacatatgtgttccatcattgactgaaacattgctatgcagtgcatgactctattagagtatttcataatggtattttaagagcttcctcatccccctcccccaaggctatactgttcagtgtttcactgtatggataagccataattcattaaacaggagagtcatgtcttacttacatatctatacctgctctgtaaacgcattcattcatattcaagggactgaactcttgaatttgtgcagaatatttctcttcttcatggctgagtatcctaaccagctgagaggattttcccttctttaaagaccaaggtatttaagattcagtcatttcagaaataaatccttctaaattgtgttgtataactataaaatttatttcttcttaacagtaaaatagtgggcatttttaaatggttttaacacaggtatcagcatcagtattgtttaggaatataaaagagtaatatttcaggagcttttgctggttttgccttactaagtggcaccattttgacatatatcatctatctattttacctgctttttagattttttttctcttcatctttcttgtttcctatgttggctgcctctaacataatattcctttttcctctggtacttattccccactgcttcccagttccttttcttaatttgctttgtaaatttttggtggacaattagccagataaccaggacagaaatattcctaaaataaaaataaatagattcagagagaaggtctgatggagttttcctgccgatgaaaattttggaatgaatgttttggaattctggatacctagagggcctttttgcttcctggttattaccgtgttctaggacagctctgtctaatagacctttctgtgatgatagaaatgttttatgtctgccctatccattatgatagccactatcctcacgtggctcttgagcacttgacatgtggctagtattaagtaactgaaattttaattttaattaagttaaattcacataaccacatatgacagctggctgcgtgttagacgacgtagttctagactctagttaactaacttatatacagcaagcttgattagaggagagcttgaactgggatgctattattgtgctgagaagaataaatttatagttttggaagggagacaatttggaatgtagattatcagattagcttaaagtaaatgattaaattggaactgccttttcatattgacgttatgattatttcacagtgtagcattttaaagccattgttaccagcatttatttgtggtttgtatctgtggcaaagctgtgagtccttttggtaactagggtgaaattagtagcactctaactttatttataggacttggttagacagttgcctgagtgccagaaactcctgcaaataactttgaccttccctaacaaaaagtcaaaggataaagcgtttcatagtagaagatttcagttgtatctgacatacacaaaacattactttctaatggagaaatctgtaaccaaaaaaagcataaataattaaagattttggtaactgctaggaagaacataaacagggcacagtaacagagagtacgggcttgtggggaaagacctccaactagatagaggagtctggagagttttatttgaggaagtgatatttaagctgagttctaaaagataagaaggagcctggcttgcaaagaatgaaggtggaacgaggagggatttcagaaagagggaattaaggggtatgggggagaggaattgacacaaaatcagtgtctttagaatagtgattgagaggagatatggtatgaagtgaggttggagaagtgggcacatagcaggtcatataggaccttaaagaccatcataaggagtttggaaagaaaaatgtaatgtgatgccgtggaagtaggagagtgataagatctggtgtttgttttacagagtttctctggctgctgtgtgatggtgttttggaagggagcaacaatggaaatggggaaactagtgtgatattcaggaaagagatgatggtggcttgggttaaggtggtttaaggcagtggaggtcaagtgaagtcacacacacagaagttgctgtaggttggatgtgagggatgaggggtgaaggaagggtttctggctttcataattgtcaggtagtaccaggggacttcaagggtggtgatggtggagaattaaggacccaattttgggcatgttgagtttgacatgcttgtgtgacagctaagtagtcatattggagcatggggagaggtctctgctaggggtgtaacttggtagttattaacatgttgatggtatttgaagtgatgggaatggatgagacaacttagagaagatgactcaggattgaaccccaaggaacacttgccttttagaggtctgtcgagggagaagccataaaaagatactgaaacagtaaccagtgatgcatgaaaaaacaaaaaaaatggcattgtagtatctcagaagccagaagaagagaatgttttaagaagattgtcagctttgttgaatcctgctaagaggtcagataaatgtggaagtagtagaccttgataagttgatttaatggagtggagggcttggaaactttgttttgagtagattgaagaaaatgagaagtgaagaaattgagacagatatagacaacaactttttcaagataatttaccctgaagtggtgagcagggaaatagcaggtagctggagggagatgaggggtcaaaggagaactttaaaaaaattagggttcatttaatcatttacttattatagaacattagatttagtggtaagaagatactgtctgaatgcttctcatttaaaatgacatagaaaattagctaagaggttgtgtgtagtggctcatggctgtaatccctgcattttgggaggctggggcaggaagattgcttgaacccaggaattcaagactagtctgggcaacatagtgagacccgccccttctctaaattttttttttttttttttaattagctgggcgtggtggcatgtgcatgtagttccagccacttgggaggctgaggtgggagaatagtttgagcccgggaggtcaaggctgcagtgagccatgatcgcaccactgcactccagcctgggcgacagagtgagatcctgtctcaaaacaaacagacaaaaagtaaaataagaaaattagctgagagtaggtagtgaagagtgaatgagggaggtttgaggagaagcaagaaatagtcattttggggagtaggaaagctttcaagggcagctttggtggattgcttggcatcgttgagtgtccatttgaggtttgtgatcatgaatatatagtgaagtcagtcagcttggttatgtgatttttcttcagcaacattcagctgattgggcataggcactagaaaaggcagacaattggatttaaccaggattggagttgtgtcaggtggcagtgatggagaggacaaatgattgagggtatttgcaagggagagattgtaattatggaacacggcatcaaaattggacaaagagggtgcagaaccggagtgggtagataatggaaaagtggttgggatgggaggacttcatgacgtcaaaaattgtagggaggggataccagagaaagctagttagaagtaagggaagttctttgagagtataattgaaacgtaataaggaaagatgggtcttttaagatgatgcagcttttcttctcttttttttttgagacagagtctcactctgtcgcccaggctggagtgcagtggtgcattctcagctgactgcaacctctgcctctagggttcaagcgattctcctgcctcagcctcctgagtagctgagactacagatgcaccaccacacctggctaatttttgtattttcagcagagatggggtttcaccatgttggccaggctggtcttgaactcctgaactcaagtgatccgcctgcctcagcctcccaaattgctgggattataggtgtgagtcaccgcgcccagccaagataatgcagtcttctgttttaggggtggtagctctgggtttcctaataactgggagtaagagctctaacaaatcacttaattgcctttcccaagaggctagctttgagatggaccgctttctccatgtatatatacatctagagcttagtttagacatcatagaaggtaaccaccattcacagaagtttctgggtctattctctgaatgacatcagtagtagcagtgttttggccagtgcacaagtacagtatgtgtacaccaactcccaaaccctatctctgtcgtttgttgttgttttttacttttttcttgagatgagagttttactatgttgcccaggctggtctcaaactcctgagctcaagcaaaccctcctgcctcagcctcctgagaagctaggattacaggctcacatcaccacacctggcttcatttgttatttaaagtcttggtaatgggcagaggtagagtgcagggttatttatatccagggtaagtttttcagtgattttttttccagtcttgattcagttttgtcagtgaataggtatgatttagtggaaatgatcttggagtcttaaaaacgaacgttgaacttttggctctttattcactagctgtgagaccatgagtatattatgtaaccactttgggcctcaatttcctttgatctgtgaaaaagataacagggcctgtcttacagagatattgtgaagatgcaatgagataatgcatgcaaagttgtggcacataatatgctctgagtaaatagtagcggttggtggtgttacattgaaaccagcaagtgggagaggaatgttcactgttttgtcttccagggtggtttacatcccctaactggaaagtggcagccatatctacgccttctcccatgagtcgctactgctgcatgtggccagtgcctctgtctagaccagcttctcagatttcggtgtgcctgagagttacctggggcttttgttatcatatgattttgattttgtaagtctagggtggggcctgagattcttcaaatctaaggagtttccagttgatgctcattctgctgttgctggtccatgtgtcacatttgagtagcagaattctgttagagattgccctgtgggaatccctgctattttaagctgagaggaagtgagggaaaaagagcctcattctttcgacttttttttttttttttaagtcagcttcatagacaatactcatacatctcatttctctacctcagtgttgttttggtgagtctgtattgtctctaccagtccaggaagtgataggaatataaactatgtatagagggttgcctcagatttcttctgaagaatttttagtgcctgatttctcaggtacatttttgagaaattgtgctggctcccccggtatacctacttccccccgctatcctcttacaaccacagagaaactcgtataaaacaagtagcctgccagcctggccaacatggtgaaaccttgtctctactaaaaatacaaaaatagctgggtgtggtggcaggcgcctgtaatcccagccacttgggaggttgagacaggagaatcacttgaacccgggaggcggaggttgcagtgagccgagatcatgccactgcactccaacctgggccacagagtgagactccatctcaaaaacaaacaaaacaagtagcctcttgaattattggagtcagaggcagagcatctaaaatgtggctccagaccctttctgcccaccagactcacattgcaaaatccagcatttttgagatgtaggaattcaggaagcaaggttagaattattggcaatacccatattgctgtcccagattatctgatttttctttctcagaagcaagcatgccagaaacttcttctgtgggccctcctcagaagactttctttagtgctcaaatggacacattctctcctctgaactaacagatagggtgataagctatcagtcacaaagtctgataacatgctctcctgatagaatgaagtatgtgtgcatcttaatctctgtgtataagactgtgattctttttagagtctctttatagtgtggagtttttacacctttttgtctcttaatgtgaattgtatatagctataaagcatagctttccttatttgactttgataattggaaataaatttttttcttctcctaccactttgttcccccttttttctttctttctttttttttttttgttttgttttaaaggtagaaaaatgtgaacatgcaggagcatgaataaaaaagataacttagcttccctgtgggtttttggtttttgtatgttttcataaaggtaacatacagaagagttttatttctgaccagactgaccacctaattttaaagattatgatcagaaaagaaatagatgcatttataataggaatttacaagcccttcctgtggttccaaagaagtttatggtggttccacccatgggagtttcagaggtagtttgcagagtttttgtgacatatttaaacttttctttattttgagggtttcttttcttggtatttttctcctgctttgctgcagggtatgtcttttatattttattttattttattttttatgtttgttatgttatgttatgttatgttatgttatgttatgttatgttatgttatgttatttttgagacagaattttgctcttgttgctcaggctggagtgcaatggctagacctcggctcaccgcaacctctgcctcctgggttcaagcaattctcctgcctcagcctcctgagtagctgggattacaggcatgcgccaccatgcccagctaatttttgtatttttagtagagacaaggtttctcatgttggtcaggctggtcttgacctcaggtgatctgcccgcctcggcctcccaaagtgctgggatgacaggcatgagccaccacgcccaaccttttatctttatcctatcctaaacttgattaaaagataacactataaaattacagtatgaagatccagaatttcattgtatttattttattgatacttggttaagaatgaatgactgccagtggtcatggtggctcatgcttgtaatcccacactttgggaggcccaggcaggtggatcgcttgaggtcaggagttcaagaccaacctgggcaacatagtgaaaccccgtttctaccaaaaatacaaaaaaattagccaggcgtggtggcgtgtgcctgtggtcccagctactctggaggctgaggtgagaggatcgcttgagcctgggaggcagaggttgcgatgagtcgagatcacgccactgcactgcagcctgggctacagagtgagaccctgtctcagaaaaaaaaaaaaaaaaaaaaaaggattgtgggagaagatggcggccgctgcacaatcccgggttgtctgggccctgccaatgtcacattctgccattactgcaatagccacatccgtgtgtcacagcccactccattgccagcttcatcatgccctcatacctcatgggaaaggtgaatgttcctcaagtcagtgggattgtggccactgggtttggagcaacaggattcctgggccgatgtgttgtcaaccaccttggacgcgtggggtcacaggtgatcataccctatcggtgtgatacatgtgacatcatgcaccttcgtcccatgggagacctgggctagcttctgtttctggaatgggacgcgagagataaagattctatctgacgagtagtggaacacagcaatgtggtcataaatcttgttggacgagactgggaaaccaaaaactttgattttgaggatgtttttgtgaagattccccaagcaattgctcaggtgtccaaggaagctgaagttggaaaattcattcatgttgcacatctgaatgtgaatattaaaagctcttctagatatttgagaaagaaggctgttggagagaaagcagtgagagacacatttccagaagccattatcgtaaagctgttggacatctttggaagagaggatagattccttaattattttgcaaatatgtgttggtttggtgctataccccttgtttccttgggctggaaggcagttaaacaaccagtatacgtcgtagatgtatccaaaggaattgttaatgcagttaaggatcctgatgccaatgggaaaacctttgctttcgttgggccaaatcgatatctcctctttgacctggtgaagtacatctttgctgtggctcacagcaaaggggtacttcctcccgtaccccttgccaccttttgcctatcagtgggtagcaagagactttgaaataagcccatttgagtcctggacaacaagggataaagtggagcgtattcacatcacagacatgaccttgtctcacctgcccagcttagaagaccttggtattcaggcaacaccactggaactcaaggccattgaggtgctgcggcttcatcacacttactgctggctgtctgctgaaattgaggatgtgaagctggccaagaccgtcaacatttagtgcctcccgagcaactcttggttttggtgtcttttgggtcagcccgtgtggtttgagcacccagccaggtggtctctttagagaatcctgtacacagtgaataagatcccaccattaaaacatttgaggttaaaaagaaaaaaaaagaatgagtgtcgagtaataaaagactcttcaaagaatttgaaaaaatgaatctcttatcagtgtaattttaatatagttatttacagtatggtatggggagtgttggtgacttaagatttagggcatgagccatgtaactagagaggaaagttgtgtataaaaactgattatggacatgtaaaagagtctaagtaacactttatggaaagtcaagatttatttttctttttttcttttatttagaaaacaggctatctcagtttcaggcttggaagttctttctcctcttttgtactagaaatgtagtaatcttgccttcagaagaagcagagaggttctatgtagagaaaaagaaaaggtttgggtgaggccaagaagaatacctgccccacctctccaagtttaaatgagctgggagtttaaggtgggaggagagaaaacgttcgtctgcggaaagcatgcgttcagtgtgaaagaaaaggaaaagtgattctatttctaccctaagaggaagaaaccccactatggcaggtaactaagcccagagcacgcacagtgggaatattaggtagggagagtgaaagtacctgcatggggcctaccttgaatgtgagacttgtagaccttacttggagattttataagcaggaaggagctgtttcagcatgtctgagggggagccaaaaccctgaggcagctggaaggtggtttttgtttgctttttattttgttttgtgttttctttaatgagtgggaaggagtggaatattcctcaaaacctgttaccgtttgagaatgttttgtgcacctactgtgtgctaggtactatgcaaaagactccatggccaaaaatggatgagccaagacgagatgttaggtctccactgaggaagatgtgcagaggagaagtggtttgctataggaatacttggagaagtagcccacagaggtggtcaatgccatgttacaaacaccagtccccacagagaaaggagagctcactcacagctggggtttgcttttggatttgaacatggagaaaggggtcggggaagcaaggaacacgtatgggcattgacattggcattagaatatgggggataattacgtgattttctgaataaaaaccattaggacaggtgatttgataatacttgttcaccactgggcataatgaatgaaaactcgcctggcatataggaagtacttaataaatgtttgaactgaattaaaattagaaaacatggtcaccaggaacatggcagacagtttacgtagttatatcattacaacacctctgaaaggagtattaaacctattttttggtagaggaaacagaagcctggacaggttggaaactttccccaggccataatgatagtacttgtagatctagaattgaaacccaagccgtgcaccttagcccgtctgcgtggtgagtaaagtgtctgtaccatgctacgagctcatgatccacttgactccttcagaagccaggctatgttgatgtgaactagggcagtagtaataaaaaagatgaaaagcctattcagttttatatcttaagttttcctgtgttttgaaatcttgcaagattaagaattattagtggtgaaatgacgtaaagaatagtggtgtcaagcacacattgtgagaaaggaatgtgggctctgagcaggttctgtgtgtgtgcttggcttctgcaaggggctccacaattggggcagagggaaagcttggctcacttgccttgatcttagagggcagagatttttgattgcttcattcatgtttaaagaactcatcttaaactaatgtatatctagcactagaaactggtgctggtggtttattactgaccccacccatccctgtcttttgcaataatctttgtgagtggtgattgtgtttctagaagtagaattgcagagagagattccctgaaggcaaatacagagagagtgtgctgtacactctagttcagatactcagagctgggaactcccagagagagagagagaaagagagagagagagagggagggacggagggagggtgagagggaggagagagaacaacagaacagtcagctggagcggaggggggaggagaccagtcttttcttttttttttttttaggattttttaactcaagtgattttggggggtttctccccacctcaaactcttgccccccagttttggcatcttctttcctgtggttcactgaagtgcctttttgcagtccaggatccactgaccgctgagtttgagcagcccgatctgacatgatgtacctctgggtgagtacagagtgctgtgggtgagggtttgcacttgcacatataaggagtggaaagctgcgaggttctgctgttgcacaaatggcctccccacagagcacagactgccacatccccttctgttccaaggtgttaggtttttaaaacctagcggtgattgtgacattgttttttttcctccccctatgttgtttatcttgtcagacttaggcgcaagggctgaactccctgcgcagtaccatcccctgggcttggtaggtttggagaaggcaagtggggcaggtgaagttgtgagctggttgcttcaggaactgcagtcttcctggtggctcaggatcgacttgtgttttgttttgggggtactgaccttgttaagccatgtctttagatattgagagccaataggcggcatgattattaattaggaataagctttcataagcttttatctaataatttttactatccttcacaatagtcttgtgaaataggtcactcactactgttattaaaattgtgtgaggaaagtaattaagccacaaagagtgacttgcccgtagttagaaatcaagtctatagcagttagaatagtaattaataatgagacattataaagcattttatatttgccaggaatgtagtaccttctattactgtaatttaccgtcaatagtagcattgtagtttgggatggagagaaactttctgggactggagaagtttgtaaattatgaaatgtgataacttttagagaaatgtcaggggaaataatagagaaactgctcccccaagccgcctgcaatttttagttgttaagacaagaacatcttacagtccgttgcaaagatggcagtatgtctcttgagcaaacagctgttgtgtgttgctaagggagcctactagatgtgatgctcttggctactaaccagctttttgaaagtttccctttgccctttgcccttcagcccagatgtctggaattgcaggaacctacttggctaacacaggctaaatttataaattatcagaaagcaaatgttaactgcgtttgcagagatggagcttgttcacagaagatgtatatgtatgtgtgtatgttcggaggggctgcttttcgtgcttctcccttcatgtttaaatatgaccttgaaatattattttctcttctctattgattttttttgtagtatttgtaagagctcagaacttttctgacacactaatgtgcattaagtagttttcgcctccctgtaaactagtcatctgtgcaggctctttgcagccttgtgggtgggattgatcagccctgttgacctgaaggatgggctgttctgtcttttgatttgtttggaagaggagttatgaaaggaagcaagttgaattaatctcattttcactcacttatgtttgatgaaagcagacagtgacagtctccttagttatttcctttgtgcttatgttacagttacttgtgtatttatctcaatttttttttttacttattaaccctggaacagagcttccctaccaatgctacatgccagattgagatagaaatatgccaagattactataccccacaacccttggagcagccagctggggcttgggagtcccctggtcactttgatcatgtgcaccctaatttgtttaccactttgtgctataaaaatatttcctatgtatgccatgacacctgaaggcttgggtagcactgcctagagggcaaaaagcaggtcagctctatctcttttattatttgtgtcatctagcccaatgcctttgtttacttcattgaggacgtgcagaaggagctatagcgaataatgcccagatacatagaaggaagccttggtggtcacgcattcagtgggaggcacagaggagctgctgtggactaggaataggagatgagagttttagtgtaggtttagccagtaccaagccatgtgactttcggcagtcatataactattctgagactcagtttccacatgcgtaagataattgaactgaacctcttctgattctgaaattccatgaagtgaattttatgtaacagtagatatgcctgaaaaatgcccagttctgcaaggatgtttaggtctaggtgatcagagaaaactgtcaaacatactgtatcacctcccttgcatgcttggtttggtaccagtaatgggtcaaaggcactctttctgagtattctagaaaaattactggactatgttcagttgtcagtacctctgaattggtgcagatgggcatttttagaacctgtagaattgaagagtaaaagttacagcttatccaagcattttcatttgtgtagttagatgcagctcattaatttgctcctgtgtgtctagaactctgagatagaatgctatcttgtgcgctctctatgctgctttgccagattttctccccgctttcctgttgagtcatcctcttttttagtgaatttggtagcgtcagttggcagcatgaggtggtgaaaagaatacgggtttcagaaacctcactaggtctaaatcccacccctgccatttccaagtgtatgactgttaagttacttaacctctctgagcctcagtttcatttgtcatatagggaaaatagtggcactcaggattgttgtgaagatttgagataatctatgaatatacttaacatagtgaatggcacacaatagatgctcagtaaataactagtacaagccaactttttgctttgaacatttgcataggcagactactcaccactccgaagtgttttctgtatcacgttgagggtatctttgaattcatctagggagaactttgataaacacaaactagttttttgtgaaatatttttcctcttagtttgtatgttaagtactcgtggctcgggagcccttgttaaggttgcctcctgatggagaaaaatccccattatttgttgtaaactttttttttttttttgcgttgcacagtactattaagcattcattatgtcatttattttccctctctcgccatcatcaaaaacagggaaagagacagacagatatgattcctgtactgaggcaacttacttgtttgatgattatgtaatttatatccaataaacataattatagaccacttacttaaattaccagaaaacaggatatgttctccctgtctgtgcagtcttagctggacaggcaccaggccctctcttattcatgctctatatggatgaacttctggattttattttgaactgttgttttttcatagttcaattctgtcttcttaataaatcagttcagccaacatttaatgaatgcccataatgggtagagccagctgttgcaaatacaaagatgattaaagattaaagacatagtgtgccctggccggccttagtggctcacgcctgtaatcctagcactttggaaggccgaggatggcggatcatgaggtcaggagatcgagaccattctggctaacatggtgaaacaccgtctctactaaaaatacaaacaattagctgggcatggtggcacgcacctgtagtctcagctactcaggaggctgaggcagaagaattgcttgaacccgggaggtggaggttgcagtgagccgagatcacgccactgctttccagcctgggcaacagagcgaagacatagtgtgcccttaacaaatttataacaccatggtagagaatctgtatgcacaggtaataatgatttttgaatgctattcgaatctgtctacacagataataatgatttttatatgctattcaattaacatacataagtgaaatccttttatgtgctatttcatcctcacaacattgctaaggactaagtatcattatccctattgtacaggtgaggaaagcaaccatgagagagtatatgacaagcagtaaatggcagacctggaaacgcaatctcatcttttaaaaactatggctcttatttcattttatgctagcttcttttgggagaacctgatttttttttgtttcattttattttattttaaactgtctattgagtgataacatttactcctcagtgcacctgagtgttagctattatcttcattttacagatgagaaagcagatatttcagtaacttgcaaagtcacacagtttgcaattgtcagagttagaatttgaactgtggtttgtccatccctaaaacttgctataccacaattagcctcgtcttgtatttgttcagtggtttccagtttatcagtatagtagtcccccttatccatggcttcactttctgtatctctagttacccaaggtcaatcacacttcaaaagtattatattttgagagagataaagaaaccacattcgtgtaacttttattatagtatataattattcagttttattattagttatcattaatctcttactgtgcctaacttacaaattaaacttaatcgtagtatatatagaattcagtactacccaaagtttcaggcatctacttgggggtcttggaatatatttcccacagatgagggacactacctgtactagcattcagcatggtacaaggctagagtagagaaatgaaaataaggaaacctgaattctgttttcatcacccttcgttacttgagacaattacttaactgtgtataccttgatttttcaggttacgaaaaagatatattcttaggaacattcatggaataatcttagaaaaatgcatatcagtcattttagaaatgaagtagcaagtaactgatggctttatcataaaacttgaaagtcacagactgtgagtcaaaagatacagtttcgggtcttggttgtgccatttgtcagtgtatcatctttctgagcatgtttcctaatctttaaaatgggaccaagagattatagagataatctgtgaaagtttctggaagttcttttgtgtgaggcaaaaataagctaataacaacaccttattcaggtttcacgttagtcatttagtgctttttatcactattttgccactctaattgctctacacaattagagaactagacttaatagtaaattgaattatcacaaaatgtagacaatggctcagttcagataacatttaaggtcagatgccgtgataggtaccgtacttgacagtgaaaagccattaaaagattctaagtaggattgggagtagggtgaagtgaagtttataattagattttttaaaaagatacctacatagattagaggagagtaaaagtgcagagagaagttaggtgattgttgtgtaagagtctgagtgacagggaaggtcatgatagaatgggctggagggaagcggaactgtattgagagattcagaaggtaaaattgacaggatgttataatttagaagaggaccaggtttttgtaggagggaagatgaaagggatcatgggtttggttttggatttagtacttgggtaactttgagatgttcaagaggaaatattgcttacatggccacctaggtctggaaacagaaggaaagacagaggctttcctctattgtgagaaacctgcatgccccgagcgggtctcataatggcttaaaatgataacggtctagggaggaatgtagagcaagaagagaagttaatgcctggagaagaatgaattttcttttcttttcttttcctttttgagatggagtcttgctttgtcacccaccctggagcacagtggcatgatcttggctcactgcacccttcgcctcctgcattcaagcgattctcctgcctcaagcctcccaggtagctgggattacaggcacccacaccacgccgagctaatttttgtatttttaatagatatggagtttcaccatgttggccaggctggtcttgaactcctgacctgaagagatctgcccaccttggcctcccagagtgctgggattacaggacttagtcagtgtgcccggccaagattttcaaaggaagcagggaactaggttttaaagaccttattcttaaggaggaaaaccaggacattaggaaatcaagataagagattgtggcaagacactgaaaactgtccttggatttagcaatatggaagtcattggtgactttagcaagggttattttggtggaatgatgagggcagaagcctgagtttagcaatatggaggtcattgctgacttcaacccctcttccctttctgccatgagtggaaggaagcagccagagaccctcaccagatgcaggtgccagtgccacacttcttgcacaacctgcagaactgtgagccaaataaacctcttttctttatcaattacacagcctcaggtattcctttatagcaacattaaatggactaagacaatagcctagagcaatgggctgtattgtatagcctaggtatgtagtagactagaccatctaggttggtgtaagcacacggaaccttgatgttctcacacaatcagattgctcagtgatgcatttctcagaacacattcctgttgttaagtgatacatgactactatattgcagatttgaggagtgaagcaaggtataaaatagtaatctcaaaaaaatggggagtaaatttactacagagatgaagtaggcctaagatttgtgatcataaatttgatgtatgtggtggcgagtcagttgtgtgagttttatccagcaatcttctgttatttaaatgcaggagaggaataagtacatagttggagctgccaaatgagttagactaagggaaaagaggacaaggaaattaagattttttggagaggactctgtgtagtatgaggccataggatctaaactggcttaggagggaggtagaacataagaaggagtaatagtgaaaaagtggtacatcagcctgtaaactatagatcttaaggaggctggagaattgccacaggggtcaaactactattgtaagcaaacgcttgatggtgtgataatagaatacttgaaatttttgtaggtaatgattgtattagaatatgatgctaggtgaatggctttaggtgaggtggtggaaaaatacagttggtgctaaagacttcaaaaagaaggccaaaatgttgaatctatgtggctgttgaagttatcagagtgataagactaacaatggagatgaaatcagggagccctatttagcaggggacaggtgcagtttgcctggagggaagagaagtggtttggaagcagtattgggaaggaaggaagaggatatctggaaggtccaacactatatggtaatggggagtaaggccgatgcttgcccctgctgaggtatgtgatgagtaagaaaaaagtgtttactgtagaagcaacagtaatctcaggggcagtctggtttccttaagatcaaaagagtaaagagaatatcacagaagagaggtgagtgtgtagaggagtttgctgagaatagcccatgacctccagggcgtgggagggcaaggaagtgcaggagatgggatcagaaaaggcatagagaacagttaccattgtagttgttcaggtatgaggtaaaagggccttgaggtcagggtttgacaatgagaataaagattttaagtagataggaaaggcttacgcatgaatgctaaaatatggcaagcttcagttatttaggaaagccgcctttactatttgttttaatatgacatttaatgttaaacaactatctctttctggtcatgtttcaaatcagaatatggaattttgttgttgtaaaatatataaattaaggactaaatttggaaccaagtaagtaaatacttagtagattttaaattgttcgtttggaggagcagaaaatcagcgtggtcaaagcacacatattgacaagacggagagggagggtggaggattaaacacccaagatatatttcctctggtccttttcccaacaacgacaaaaatatattttaggagttgtagtcttacttcactaactcccctttctccttcttggttctggaaaactgtacagtcgtgtaccacataaagacgtttcaggtagctatgaactgcatcattcatcagtgcagttcaatgcatcagtcaatgcagttgaaggcatcagtcaatgcagttcaatcttacggtggtttcataagagtgtataaataacaattgtatctttactgtcccttctctgtgtttaggtacataaataccattgtgttacgattacccacagtagagtattcagtagtcacctgctgtacatgtttgtagcctaagagcaataggtcgtacataccgtatagccgaggtgtgtagtaggctaggccatctgagtttatgtaagtacactctatgatgatctcacaactatgaaatcacctaacaacacatttcacaggatgtgtgcctggcattaagcagcacatgactatattgcttttaaaagttgtaatccagttgaaagcattacattcctgtttagaattaataggtttttctgaatgtgagaacttggtgctcctcttcacacatttttttttagcatctttcactattattaaataagagaacatatgttacttgtaattgaaggccagcatagaatagacattccacagatattggttgaaaagttaattggatattctaggtataatgaactgtctgggtagcaaagtgttcaactaaaatattgtgtttgggccgggcgcggtggctcacgcctgtaatcccagcactttgggaggctgaggtgggcggatcacgaggtcaggagatcgagaccatcctggctaacatggtgaaaccccgtctctactaaaaatacaaaaaattagccggatgtggtggtgggtgcctgtagttccagctactcaggaggctgaggcaggagaatggcgtggacccgggaggtggaggttgcagtgagcccagatcgtgccactgcactccagcctgggcaacagagtgagactctgtctcaaaaaaaaaaaaaaaaaaaaaaaaaaaaaaattaggtttgggtttcacttaacccaaatctataggctctgtactgtcttcattgtgtattaacttgtacggtgttttacttgcttatttaaatatagaccatctattcagaggttaaataaatcaagagggaggtaagagtcagaagcttatgttgtttatgcggggaaacgacctagctttcattccctaaaataactgtcaaattatttttcctgagtgtgtgagatgaactttaatcactggcaagattcttgtatccatgaaaatcagaaaactgactatggtttcattgtgtttctcatcatacgctagttacatttctgtccctggcctagtcattagcctgccatatgattagacagatgatctttatgctcttgtgtctcatctgtaaaatgggcatgatttttcccagtagaattgttaagtattatttcttagataaattgacattcacataaaatattcttaatgatttatttattctgcttcttgtacagtacttgaaattgccagttaggtaaaaaacatcatggtttttttggcaaggtgggactgaaggtctcactaaacagtacagtagatgccaaaggctgggcaggggtaggtggtcagagcacgtgttgggaagatcagttgttgctgtgtctgtgttctcctctgctatatttaagtaattttagatatttatttttatttttgtgtttaattttattaaattaaggttattaaaaataagtttcttggattcattgaaaatcaaaaccatttttgcatgttgctcaacaagttgctctaatattggatgtttgcagataatattcaaactggagaaattttcgattgttaaaggcagttgggattggaagagataagaaaacaaattcccaagtgcctcctatgataggaggcactgggtctgatgctttcattactattatcttgtttcatcttacaacggggaaggaagattcaaatgcgcagtcttgcttcagagtcagtactcttaaccaatatgttgtaatacattcagctagtctgtgataggcagcatctaagatggtccctagtgatccccacctcctgatattcatacccttgtgtattatcttccccttataggctggacctagtgactcactttgaatgcatagaatatggaaaattgatgagatgtcacttctaagatttggttacaaagagactgtggcttttatcttgggtgcttgccctctctacctttctctcagagcccctacactgttaagtagccttgtgggaaggcccaagagccagtgatgtctaggcctaacagctagtgacctgccagcagccaggtgagtgagtttggtggtggatccttgatagtcaagctttaatgattgcagccccagccaacaccttgactgcagccttgtgagagtccctgaaccagaagcacttagcttacccagctggatttctgatccacataaactgagataataaatgctgttttaagctactgtgattgaaaatgaattgttacatagaaatagataactaggccgggtgtggtggctcacatctgtaatcccagcacattgtgaggccgaggcaggcggatcgcttgagcccaggagtttgagaccagcctgggcaacatagcaaaaccccatctctactaaaaatacaaaaattagctgggcaaggtggtgcgtgcctgtagtccagctacttgggaggctgaggtgggaggatcacctgagcctgggaggtgtaagctgcaatgagctgagagcaagaacttgagcaagagagcgagaccctgtatcacaaaaaaaaaaaaaaaaaaaaaaaaagagataactacagattttggtaccaatagtggggtgctttttggtgaaaatctaaactgggagtgactttgaaactgggcagtggacttttaaggagagtgttagtataagattagaataccttgaacacattataaaaatgggactttgaggcgattgtcacgaggtcttaaaggaaagaaactggaagaaaggggatccttgttatgtagtggtagaaagtttagcaacactatcatttatagttgtggaaagcagaaagtgtgtttcatgaactgagagatctagctaagtaaacttctaaacaaaacattgcagatcccctctggttccttcttgctgcttaaagtatgaggggaaataaataaattgagggaagcactgttaaaaaaggagccagaacttgatgattttgaaaattctcagcctttctggttggcagagggtgatgaaattgagacacggcaaagatcaattcaagagccactccggggagaatggcggtctaaagataaagccaagactgtgcctttaaagcctgctgttaagacctgagaaggtagtgccttagcatcctcttcagtcacactcaaggcctctccgtcaaacaatagggcttctagcctttttagcaggagcccaaggtagaggtagaagagttcctcttggagagatctatgggtatagcttttgtctattgtggtgagatatgcaggaaatccactgtagctaggactgaacaggaaaagaaacagtacaaaatgaaaagaggctgtcggacacccctagcattctgctggcaggaagcaggctgagaaagtgctcaggagctaacacatgccacctttcatcaaaagggaaagatgactcagaggttggaagcaggagcctagagatgaaggcaaaagtcatggagaattcttttcccagtgttgagacctaatcaaggaactttcagtgtttgccctgctagatttcagagtcagtatggatcagtgactcttttgtgccccccaatttcctgcctttcttttgtagaaaaagttatgccatttagtgattgcaaggattttagagaacagaaacccagagggcaagtgagaaagcagccctaatactctgccatctaggctcccagaatgccatgctgttgttaaattgcttcttttggcttttgcttacaagtcataagtaccagatgatatgtgcaaaactgaagcaatcaggagaggatttcccacccccgtatttacccactttctctcatcagtatgaataaactgtcccctcactcatgaagcatttgcattcctatataaggtgaaccttccagttgtatactaggtcctatctctgctagtctgtttaggacatggatccagcaattctcttccctctctctgggatcatcaagttttctgtctttattggattagtcccgtcagcatacagttaagctgttcttccacttatttaaaaataatactcttgacctcactttgccagcaactgctgaatttcttttcctttaaagcaaaactcagtagcgttgtttatatttgattatatctgattatatcagttctcctcttaaacccacgcagccaggtttttattgcaaccacaccactgaaagggctctagtccaagttgccagtaacttgcatgctgctaaatctagtggtctggtctcagccctcatcttacttgacctatctgtagaatattctatcactgatcacttcgttctctaattcactttcttggatacttgacttgcaggacatcatactttcctgattttcttcccacctctttggaagtttgtactcagttttaaagttgtaatattttgagccaagtcctttcacctctttttttgattctctttcatccactctcatggctttagttctcagctaaccaggaaagttttaccagccgggtaaaatgtttttttcctttaacatatattaagttttcttttcttttcatttcttttttttttcttttttcttttctttcttttctttttttcttttgagacagggtctcactctgttgtccaggctggagtgcagtggcgtgatcttggctcactgcaacctctgcctcccgggttcaagcatttctcctgcctcagcctcccaagtagctgggactacaggtccatgccactacacccggctaatttttatatttttattagagacagggtttcaccatattggccaggcaggtctcgaactcctgacctcatgatccacccgcctcggcctcccaaagtgctgggattataggtgtgagccactgtgcccggccctaagttttcttataattaagaaataagaataaagggatagtgaaaaaacaactgcattagacattaaaaaaaaatttcttcctttttttttttttggagacagagtctcattctgttgcccaggctggagtgcagtggtgcgatcacagctcagtgcagtctcaatctcctggattcaagctatcctccttccttagcccctcgagtagctgggtgggactacagatgtgtgccaccatttttgtatttttatttatttttttgtagagacaagtctgtggctgtgttgccacaggctggtcttgaatgcatgatctcaagtgatcttcccacctcagcctcccaaagtgctgagattataggcgtgagccaccatgcctgaccaaaggttcttccccctcctccctgccacccgagacggagtctcactctgttgccaagctggagtgcagtggcgcgatcgtcggctcactgcaagctccgcctcccaggttcacgccattctcctgcctcagcctccagagtggctggactacaggcgcccgccaccacgcccagctaatatttttgtatttttagtagagacggggtttcaccatgttagccaggatggtctccatctcctgacctcgtgatccgcccacctcagcctcccaaagtgctgggattacaggcgtgagccaccatgcccagctgtcaaagtttcatgcaactaattagatattacccctacagtaaccatcaatcacatttgaatgctgtctatatcttttaatcccttttataatacctcatggtttttgtcctttttgcctatccctcctttcttccttccctccctccctcccttccttccatggctgggaatagttaaaaagtaaaagttgctgaaaagtcagaatgtttcaagatgtaggaaaaataaagatcttctaaaatttcacagtgaatcttaggtttataaaagggtccaaggaatacatgtattattacaagataaaatagtttatttttaaagtaacaatttcgtttttctgttttctttttggaatacctctaagaaagaaaaatcataaagtataaattcttacaggtagaactgaactgcttgaaaagaaaagttgggcccagtggactctgatgatacactgggtgttaaattctgtctgtatgttcttggctctcaaatgtatacctctagctagaactctctctagaagctcatatctaactgcctacttgacatttccatctgtaatataatagttacctcaaacttgacatgtccaaagctgagctcctggcctttacttgccttcctctgccctcagacttgctaaacccacagttttcttcttctcagataatgacatctttctgttacttgagctaaaaaaaaccttagtcatcctggactcctctttctccctcactgcggtcctgttaattagcaaatcctttaggttctgcctttcaaaaataacctaaattcaatccatactagctcttcttccttttttttttttcctcagtctcgctctgtcgcccaggctgcagtgccgtggcatgatctggctcactgcaacctccgcctctcaggttcaagcgattcttgtgagtcggctacctgagtagctgggattacaggtatgcgccaccatgcctagctaatttttgtatttttagtagagacagggtttcgccatgttggccatgctggtctcgaattcctggcctcaagtgatccaccgaccttggcctctcaaagtgctgggattataggcgtgagctgccgtgcccatcctactagctctgccacttctatcctggttcggtattccatcttctcttgcccaggtttttgtaatagtctgctacctggtctcgctatctccactattgacactgaagaatttattctaatcacaacatctgacataatcctttgaaaatataaatctgatcatgcacaaaatccactgatgtgtttcgctcagaagaaaagctagagtccccacaaggctccagtcaagcctgctcctaggtacttgtttgactttcatctcctcctgttctcatttctcacagctacttaggccttttggccattcctcaaatttgccaggcactttgtacagctgttccatggtattcatgagggggttggttccagagcctcttaaagatacccaaatccgcagatgctcaagtccctgatataaaatagtgtggcatttgcatataacctacacatattcttctgtatactttaaataatctctggagtgtttatagtacctaatgaagtgtaaattttatgtaaatagctgttatattgtttctggaacacgatttacggtgacaaggaaaaaaagactgtacatatccagtacgaattatttctcctgccccaaatatttcccattcatggttggttgaatccagggatgcagaacccacaaatatggagggcttactgtacttgtttcttctgcctgtaatgcttctctccagatatactcatgtcttcctcctggccttcaaatttttgctcaaatgtttcctattcaataaggccttttgaaagccattttactttaaatttttcatagcatttatcttctaaatattataaaaacaggccatacggccaggcacagtggctcatgcctgtaatcccagcactttgggaggccaaggcgggtggatcacgaggtcaggagattgagaccatcctggctaacatggtgaaaccccatctctactaaaaatacaaaaaattagccgggtgtggtggcgggcgcctgtagtcccagccactctggaggctgaggcaggagaatgatgtgaacctgggaggcggagcttgcagtgagctgagatcgtgcctctgcactccagcctgggtgacaatataaataaaaaataaaaaaacaggccatgcatggtggtttatccctataatcccaagactttgggaggccaaggtgggaggaactccttgaggccaggagttcaagaccagcatgggcaacatagtggtaccctatctctacaaaagcaagtttaaaaattagccagggttggtgggacacacctgtagtcctagctgcttgggagatggcatgcacctgtagtcctggctacttggaggttgagacaagaggattgcttgagcccaggaggtcaaagctgcagtgagctctaattgtgcagactgcactccatcctgggtgacagagcgagaccctgtatctttattttattttattatttatttagatggagtttcactcttgtcacccaggctggagtgcaatgacatgatctcggctcactgcagctatcgcctcctgggttcaagtgattctccagcctcagcctcctgagtagctgggtttaaaggtccataccaccatgctcggctaattttttgtatttttagtagagacagggtttcaccgtgttcgccaggctggtcttgaactcttgaccttaggggatccaccaacctcggcctcccacagtgctgggattagaggagtgagccactgcgcctggcttgagaccctgtatctttaaaaacaaaacaaactccgtgtgtgtgtgtgtgtgtgtgtgtgtgtgtgtgtgtgtgtagtagtagtagtagtagtatgtatatgtatgtaaaataaaaactttttttcccacctgtctcctcttttagagttttttgtctggtgtattcgctgctattatcttcagtgtctagaataatgaatggtgttcaataaatatttgtcaaattctagaggtttttttacctgtgatttttttcagtaacggaatacttagtaactatagaatttatagtggtagaactctagctgacatcagctattctctctcacatcgcagggaccagtgctttgtactattgaggcagtagtgctttaatggcacaagctttggaaccaaattaactgggtccaaatctggttctgatgcattctgtctgaatgacattggataagttaccatgctttctcatctgtaaaatgagaataacataatatctatcacagagggttgttttgagccatgtaacgctctcagaacagttcttggtgcatagtaaatgttcagtatatgttagttatgattgttaccgtttcagacccatcccagcagttctgagtctgttgtactcctgagtggcaatactgagaactgattcagggtctcctccttatcaccaagtctctttctcctttaaaaatatcatgggtatgttaggtctgcctttctacccttcacctccagttctctcttctactgtttaatctttacttacactaatagcattcttttatatatccacattttcccctcttttttttctcttcctttctcccttcctgtccttttagcaagtacttattaagcattactttttgcttccctattctgttctaaatcttgctgtttctttttccttatcttcatgtctttgtttcattatcaaataaaaaattacctaatttatggttgattgactagaattacatttgtatcagggaaaatgggaatgcagtaggtgttgaaataaaattgaaattattttttaaaaagttgcaccagtgactaaaacccttgaaagtactcctactccttcctctaaatctacagaagtctctactttcttagtcagtgattaaatttgtcttctaccaaccaacgtgcaaggtgatctgggggaaaagtatctcttatttaattacattggcattatttgtaattttctgctattttagctatcttgttttttgtttatttttatttcagatggatagtagttcaggtacattactggtacagtgtgctcaaacgttttccccatgattactaggttcttgtgatatctggtctagaaacacagccatcatttataaatctgtgtgtgtgtgtgtgtgtgtgtgtgtgtgtgtgtgtgtttcttttaatgggagaatgtgatcagagttctaaaaaactgaaataaaaatgcatttttagaatatgacttattttgtaaattttagatagattatagaatgactacaataccctttttcagagcagaggaagtgaacccatttaggcatccgtttaaaggagttttgttttgaggctttaagggtctttcatctgtaagatgagctgtggtactgcctattatatattaataaacgttacaaggaaaacagtactctttttgctcccttttctcggtatagtctttttttccgagcacatttcagaaataaagaccactaaaatgctacttaatgtaatctcagttacttgggaggctgaggcaggagaataccttgatcctgggaggtggaggttgcagagagccgagatcgtgctactgcactctagcctgggtgacagagcaagactccatctcaaaaaaaataaaaaaattttaaaaatgctacttaaaagtaccccccaccatatttataagttctgggttcacatttctttttctagtacatatttagcccgttcattcatcagttattaaggccatgctatttgccagcaatttgggtaatgaacagcactataagacacaattaaaagtatcagatttctacctttgtttatcggtgatttgcattttttcagtaactctcattttcctttgaattcttaagatttacctctttgacttaagaagtaaactaaattttaactacagctttcaaaatttgtattagaattggacaataaagctttatttatttatttatttttttactatttcacaaaacaaaatgtagctttcttaaaatttgttagttaaaatgttttctttgttttcccaataaaatgtaaagtttaatatgtgatggctaaactcctagggggataaggaggcgctaggagaataggcaggttggaaaagggtagtcgggacttgtccagattcttgtgtggtagtctgggtagtctgtatatttaccatatgggctacaagacacacacacacacacacacacacacacacacacacacacacacacacacacacacacacccttgtgagcatttattaattcgcagttgatggtgcatagtttggggagtgggtaaaggatatgttacttttgtaagtacagaatcgattctgaccgctcattcattgaatgaaagtttgagtttctactacctgtaggtacctttagggaagctttagaaatgtaacctggaattttgcataaactaaacctagccagaggctcagtggccccccttttcattctctaatagaaaagtaaagagggagtgagtgagtacaaatcaccattaaacaaaagtaatatattttaggtttaactatttaataaacctaaaatataaatattacctcactccctctttcctttacttttctgtttcttttccttttgaatgccggaagactttaatgctcattatcttagtctgctagggctgctatcacaaattaccacagtctgagtggcttaaccaacagcaaattgatcttggaagtccaagaccaaggagccagcaaggcagatttcattctgaagcctcctcttgtggcttgtaggtgactgccatctagtcttgtgctcacacaacctcttctttgtgcatagggacaggagtggggaggggagcaagctctctggtgtctcttttaaggacaatgatcctattggagcagtgccactcccctatcacccccaccttacttaacattaattatttccttagaagctccatctcctaatacaggtacaggggtgggcagggtgcaaagaggtgagttagggcctcaacataggaacttggagttggggggacacaaacacttggtccataacacttgtctttttaattcataaaataatttgagtatttactgtgtgttaatcaccttggtagacttgctactatgtagctgtgcaaactcaaggaaattacttaacctcattaggccacagttcatttatcagtaaaacagagatgttgaacccattaatagctatgatgcattccagcttaatcactattacttccatgttcatttcattcccttattttcctctctccctaagattttcttccctccctaagatatttaagattgttatgtcaaatttcctttctgtttttgaccatccttctttttctttcattctgttcctttatgttttttatgtcttaggttgttttctgcctccatccacccctttcctgaattggacatgtttttgacaacttgtaagtttactagatttattagctctttaaaagtttaggaggtagacggaattttttttttccgctcaacatactgaaagcctttaaattaaacttactctaggtaaattgctttgtaccttttacattgccttgtacatgccttacctttgttgcgtgtttgatttcttttcctgtagtctactgcctttcgctaggcaggtttcctcacagcattatttcttagaattgtgaggagactagtgatactgcttttcatgtatgcctttactaaagcatctaattcatcatatgggcagttaataagtatgaattgatgagatgacagtcgtgtattttttactcttcagggaaagaaagaccttgtgctatcccttccaatttctcccttttgatctgtgacatttggaagtagttatggccgggcgccatggctcactcttgtaatcccagcactctgggaggtgggtggagcacttgaggccaggagttcgagaccaacctgggtaatatggagaaaccttgcttctactaaaaataacaaaaaaaattagctgggcgtggtgacacctgtccgtaatcccagctacatgagagactgaggcatgataaccatttcaaccagggaggcagaagttgcggtgagccaagatcctgccactgtactccaacctaggcaacaaagtgagacttttatctagttgttctgcagtctcagtggcagtggcttttctccttttgtgaatatcaacaacaaactacagagttgactcacaggatgtaaaaaattggggtgacatgcatgggagactgtgttgatactaatatttgcatgactgattgagaaagtttgtcagaaacattgtcactagtactattgtaggaactacgctatgagtggggtgaagtcttgccctagcattagtataaatccttagcctgctgggcatagtcttaagaaacaacccattcagggtcgggtgtggtggcctgtaatctcagcactttgggaggtgggtggattgcttgaagtcaggagctcgagaccagcctggccaacatgacgagaccccgtttctacaaaaaatgcaaaaatcagctgggcgtggtggtacacacctgtaatcccagatacatgggaggccaaggcatgagaattgcttgaactggggaggcgaaggttgcagtgagccgagatcatgccactgcactaggtgacagcaagactgtgtctcaaaaaaaagaaaaaagaaacaaccaattcagtaacaaattttgcagtttaaagctgtttcttttagaattaaaactctctaatctctgcagtgtggtaatgggtattgagataatggtggtgataattataaagttgctgattatcagctactgatttttgaatgccgactatttgccaggcttaatactgctacgggagggggtcagggaagtgctggatagagaaaggtgacccctggctagggctccactcctatggacctaggtgagtagaggcactccagctttcatgcccaagtgttgcatttttcaagaccatcctggcctgccatgccccccatcctgggcctataaaaacccgagaccctagcgggcagacatacaggcagccagatgtcaagagacgaacaccagctgaagaagatacaagcagctggatggtgggaggacgtcaagggagcaagccggcagaagagcacaccgacagacgtcagcaccctggcaggccattgacgggtgggacaaggcggagtttggctggggcagtcggaggagagccgaggccactgagcagccgaactctagggctaaaccatctcccttctggctcccacattggtggaaaaatccttccactcaataaaactttgcactcattgtccaagtccacgtatgatccaattcttctggtacaccaaagcaagaacccgggatacagaaagccctctgtccttgcaacaaggtagagggtctgattgagctgattaacacaagtcgcctatagacggcaaactaaaagagcaccctataacacatgcccactggggcttcaggagctgtaaactctcacccctagacactgtcatggggtcggagccccacagcctgcccgtctatatactcccctagaggtttgagcaacggggcactgaagaagcaagggggaacaagagaacctttcctgtttcaataccaagcattttacagtcattaacatgtcgaattctaagagcaaccccagtaatggacaggccattctagctatgtaaactcttcaaaggcagcacttggtacagtgctgggcacttacttgtcaggatttggtagatgctgaactgatttgaactctagcatcatcttgcttaaaattgtcattctttgcctacccttgccctgcccagctatggatacagaggttttacaaatttgaatctctgtgctctaaattagagagtttaatctgaccttatgttaaggagcttgcctcgccagtagtcagctggtttttcaaataattcgatacctcattacccatgtaccaggggttaaacattacccttattaaattggctagtctactcacctggtcttcttgccttggtgcatggtggcactctagtttctcttggaacctgagccaactctgaaccctcagccattttttgtcagtgcctcttttgagcttactggatcccaattccttttttgctttgagtttgatggtattcctttccatgtggctaggaaaagtgagaccatgccttgtcatcttacaccaaagcccttgaataagaacagctcagattaagctagtctgatatattcttaagacctgaccatttggatcttgacctccatctgcagcacataataagtcttttcccagtttctaccttgaacagcctttattttagtttcataatttctgtacccaggacttcaccatttccctgtatttccattgttgcatattgaggttatgcagtctgaagctcctctgaactgtttttcagaatgcctttccttctgcttcggaccatcagagcttcctagtttcctctattcccttctctcaccttcacatttcttttgttcccctttcctccaaccatagagtacacattacttgggaaaacccgattatataatattttagagcataggtcttggaaacatgtttatgcactgtcaaagttgcgtttccattcatctgtctctccccaggtaattagcataaatgaaaatagtgaccttttagaatatctttcaagggtggtagccaacataccaacccaggatactgctgagtaggagccagctggcatgaagaagcaaggacaagagtaaaccttttaagtgggcagtttcaaaagtatagaactaaatggaagcaagaaaaatgaggggagtgtggatatggtgctaattctaatgtggcaaagattttaaaataatacagaggcaatccagaatacattgagagccccagtgaattgttttctttaaatttcatgtcatgtgtagtcatgtttctcaatggacaaatggttagtggaccaaatgacattttttactcatccctgagtaaaaagtccaacgaatatagttcattagactgctgcttgttgtctccaaacagatcctgaaagttcaaatgactgggagtcagaacctaaaaatataatataccccactgttttggcaggaaattgagacctgcttttatcagccacttatccagaaagcatatgttctatataaatcaagccaaatctatattgtctgcaagtattcctgcaatatagttgatgttcataatgtgatccagatattttcagtatacttctgtgtattttgattatcacatgactttttatttatttgtttgtttgtttatttatgttttgagatggagtctagctctgtcacccaggctggagtgcagtggtgcaatctcggctcactgcagcctccacctcctgggttcaagcaattcacctgcctcagcctcctcagctaatttttgtatttttagtagagatgggatttcactctgttggccaggctggtctcaaactcctgacctcatgatctgcctgcctcagcctcccaaagtgctgggatggcaagcatgagccaccgtgcccaaccatgactgtttttaaatagaaactcctgggcctcctgcgttccaattttattgtttctctaatgacacagcagtgactgcaaaccccttttctgttatactttttcttttgcatatagactactattttgaaccttttgaaagggccttgccacaaaagtccatatttacattctgtatgtttagagccatgatctcaatcagaaatgagagggaggtataaatcagaattcagtgttagagtaagagactgtatagttcaaaaaaatttaaacctctaactcataataaacatttcagaaagtaggttgtacgtgctattctgggttgatgaaagtttcagaagataaaagtaaatatgataaaggtttttaaaatggttaaaaacacaggtttagagtctctcattttctcacagtgactaaaagaatttccactttggtaagtctgcagtagaagtatgtcattagagcttcttcagactaaaagatgagggatgacttgagaaaaatttggacatgaccataaggggcaatatattcttgacccaagattttctcctgaggacttgaaccagattagcttaaacaactgtttaaagaaaaaacaacatcaaaaggctcacgcctagaatcccagcactttcagaagctgaagtgggaagatggcttgaggccaggagttccagacaagcttggacaacatattgagaccctgtctacattttttttttttttttttttttttttttttttttttggtcagccgttggctgggtgtggtggctcatgcctgtaatcccagcattttgggaggctgaggcaggtaaatcacttgaggtcaggagttccagaccagcctggactggacaagtgaaaccctgtctttactaaaaatacaaaaattagccaggcgtggcggtgggtgcctgtaatcccagctactagggaggctgaggcagagaatcgcttgaacccaggaagcaggttgcagtgagccgagatcgcaccacaacaaacaacaaaaccccacagaagtctttcttagtggactagcccctttagtaagacagttggaatgtgttggagctggaatgttttcttgtcagttggttcctgacttgaaagaatcacagtggggtggggtagcctaggaattggatctctggcctagcccttagtagaaaaagggattgaggtttctgtgaaagcagttgagggttagaaataaaggtaaagccctttaaccaaaggaaaacattcaaaagaggtagcattaggaagtagacttggggggaaatacctaaactagaagtaatgattgtttgccaaggaaagataggtgtgtttaaatggaacaataccttaaagaaggaattgtctcatgaccttgttaatttctggcctgttgtttcttaatctttattttgagtctcgaacatctttgagaatttaatgaaatctctggactaggtccccagaacagtgtacgtatttacaacattttgcaacacagttttcaggagatcatgggccttgtgaagctcaaccatattaagaatacattaactagtgcccatacttagtggaaacttggcacgtgccaccacacctggctagtttttaatttttttttttttaaaatagagacagggcctgactatgttgtccaggctggtcttgaactcctgggctgaagcagtcctcccaccttggcctcccagattggtaggattacaggtgtcagccaccacgcctgcctattatcttattttaaaaagattattccaaaagtatctgtgatagatcctttctcacttttgctgtttaaaatgggaagtaacaagcactatggtgttaacctacactttctatgaaggttctacatattagtattggtccttatttgattcaagccaaaatttctatcctaatttttcttaagttccaatagtttatataggtaatataaaaactggtttttatatttgtttatttatttttgagacagcatgtcattcctgtcacccaggtcccattgctcaggctggagtgcagtggtgccattgtggctcactacagcctcaactttctgggctcaggtttttctctgcctcagtcgcctgagtagctgggactacaggctcacaccaccacacccagctaattttttgtatttttagtagagttagggttttgccatgttgcccaggctggtctcgaactcctaggctcaagggatcctcccacctcagcctcccaaagtgctgagattacaagtgtgagccactgtgcctggcagaactggtttttaaaaagtggtgtgatatgctgtgttggatattacgttggcaattaatcatatctaaaagtgtttatgtcttttgtttgatagtcatattttgtttttggctaagaggattcaagggaacttcctctggaggtaaaaaagaaaaaatttaaaaaaattttaaattgtagaactgatggtcaaatggaagatgggagcccttaattttttcttcataaaatagttttcaaagaatgctaattttaaaaagctaatcaaacttacttacagagggcccatctctttaagttctggtaacccttaccaaagcaacaatatttagttagtatatttaagaaacatgaataacaaattaaaaaggctattacaaggtggtttctgcatactgattttgtcctatggtgtgagcaattgtgtgtctagtaaacgcaaagaatacattgtaaagcccatacaatgatttggtaactccaaaggaagaaatacatgatataatcattacaaacattaggtgtcatcactttatggcattctgggtgacatcaaaatataaaactgctggcagatgtactcatattattctggatttcagtgccaagtagattttgttttcattaaactttgttttgagataattgtagattcatgcaaatgtttcaagtgtggtatttgatggaattttgacataggcaaactacttgtgacacaatcacaggaaaggtagtgaatatatctgttaaccttaaaaggttcttttctttatcattttgccacatttgctgtactattctctttttttctgaaccatttgaaagtacgttttaagtgtgtgtgtgtgtgcatgtgtgtgcatataaaatcccttcagtcttagataatttcatatttattttctaagaataaaggcgttttcttacataaccacaatgcagttatgaaatcaagacattgaacgtagatactgttacacattctgtagggctccaagggctctctaattctgtgatatttcttggatggggatgttgagactcctggttagagcctggccagggtagaagtgaaggctcctcacttggcctttcctggcgtgagtgggagtgaagtggtatttggctggattaaggcagcctgcatgttttctgtcttgctaggccaccccttttcttgttctttggctgagaggagcctttcactgggggcttttttttgtcagtgcctgttggtgtttctgggtcctttagttgcaagtctgggctacatgaggcaagaagaaaacccaaggaactcaccaccctgtctagttttcttgcttctttcaacctttgaggagtcatcttatgtttaatatatgaaatgtctagggttttaaattgtacttagtgggagggatagggaaaagtatgtgtattccatcttcctggaagcagaagtctgtagttttgttttatgttaattaaataatagtatgtctatcaaagagatgcatgtgtgtaaattaatgcataaatataaatattccaagataaattgtttgaaattaataaatataaatgagtttgaaaattaatgtatgcactttcaaaaaaatggcgtatatattatgttccaaattgcctttctgtgtttattttaggaattaaaattctaagaatcataagactacaaaggtatttaggaaatacatatttaattatgcagtttgaataaaccttcacgttgtcttttctggtatacccccaaaagtcttttgttattgtttgcttttgattgatggcaggttttaaaagcttacccctaaaccaaccttttgagaaattttacttaaaatatactatttttctagttattaaaatgtaattatcaatctgtagcatatgtagttccagctggatctctgtgtcttctaatttatccccagtgcatatccatcttagacacactggctacagtgtgatagccaatatttggcatgttgttgcttattgtgttaacaattttaatttttttccttgatttgctgttattcatggcatagctgccttttttttagctaaagaacaacacaacagtcctttatctgaaactctggaagccagatatgtattatcatttggaatcttttgggttttagaaagaatatgcaatacatgtaccctatattaggctaaccaccagtatttgggtaagaggcaacactgtgtaatcatactcatctatttgcagctaaatgtttttgaatattcacaccataatattgttatatccacactagtttaggtcacatttgtcactaagtgaatccctcttctatcaaagtgaatccctcttctatcaccatcaaaaaaaaataataataaagatgggggaggggaaaaggatggtgaagaaagaaacttagttttccaggctttttgaacgctggaattaaagatacgggtttttggacctgtgtaggtagggcagtcaccaagcctagtcagaggaaaagcccctgtttagtcctgaactcctcagtgtttaactgaggaattggtgctataggcctggtgttaccaactatgattgttttcaatataaaacaaaagtggctattgatttaatcctgttatatggtgttgatcttaaaaactcattggattcatactaggatttagggtttaatcctgtaaggatcatactaactttcatcttatttatcctaaatccctctttaatcttattaatcatgccaggctttttttccaagggccgagatatacatccatccatccatccatccatgtatgtagtatatattcatacagttatttttccaaagttatctatctttctatgaaagagaagatcagttttctcaaagagagccaaagacccatgaatacttctgcagagtagcattagtattgcaaggatgacatcagttctgtattcttaaacctaagattaaagtaggtcttggcagggcctcctgagagggaatctagtcttagccttggatttcctgagaaggcatatggcactcttctgaaagtgggatgttatttcagtttagaagctcttagtcaaaaaatattggatgaattaattgcaatggagacactgctttctaatagtggaacaaaaagtcatttcttagcttttgacctttgccctgaactggtgctgtgtgcattaggaaaagaaaatacacatttggtcttaagtcactgtttctactttgcacaatataactgattcagaccttgtgctctgtttctttcatttctcaaaggataattgtcagtgaccatcctctccaagcaatcaaagtaatagatcctaagtataagttattatttttcttatttctacttttgggggtgggaagtttgagaattagatcaaaacttttattgattgattcagcaaccagtaaacctgtaccaaatgttcacctttggggcctcacatgattatgttccctctagttattgggtggtggttgtcatcattgttttcaactgatttgcccacattatacagttttgacctggactgagtaacttatgtaaattccttaaattgctatattatagtggtttcaggtcatggggaaaaaaccctggtaggtactatgaacccttctatgtttatttcacttatgacttaattactcagattcctagatataaaaagtgtagcaaaacattgtattatgagttaaaataaaactggctttattttttgatattttatgttcagctgtactttattttttccaagtgaaataggtaaaaaggtcttttatgcatatatgattatgaatgtttactttgcatattaatttaaaaggaaattaagagaatatgtttgcaaaaacagatgaatcattattaatgaaaatcatgtaatgctgacactgatctgagaagcagaagaagtttttaccaggatctaattgtataaatgggaaatttagggttaaggaactcactttaggtgttggagtaattgtatatatgcatgctttgcccgaagtgaggaggggcaacttcgatttctaatccgctttgggggaagttccatatcagagctgcacagaaacattcagtgaagcagctcctttatcataaagggaattttaatttaaaaatattcttgcatcgtgagcagggtaaacgacagctggctacactgggcatttatctccttcaaaccacattaccagtaattgctgcattaaatcaaagtcagaagagattacaggtctgaatggatcaaggggctagtgctaacccaaggattcccacaactgctacattgctgctcttagagccctgtctctatccccagtaggtatgagagtcaggtgcagctgtcagattcctgacagctcatctgtaaggcatgagcatagtgaacacaatccaagaagaggggcaggtacacgctcaagacaccctggccgcctttttggattagctttttattttgaacgcaagagaatggcttcttattgtttttcggtactgttaaagagagaacatgttgcctgctttgtgcttaaggaaatttgctttggcataaaaatcacttcaattttctctcctcctttatttattgatattcccttcttggtcaagggtagtcttctcacttgatttatgttacagaaatgtaacataaatttacaaaaataacataaatatgttacaaaataacaaatatttgcaaaaataacatattttgtaaaatgttacaaatatttacaaaataacaacaatatgttacaaaaataacgtaaatgccctgtgctaggtatgggtaggtgctctcccctgccccccagctgacttttctcctcctaacacagttacctagttctttatatgctttctgcctgctgttgaggccacttattcctcagatatagatttagcttcgtaattcagataattctcaatctcttttaaatgtccttcaattatcagagataatgatgatgacgacgacagcaatgacgccgataacatcaactataatttaataatcagtatatgccaggcctattcatatatcaactgatttagtcatcacagcagccccatgagataggtactattattatcttctttttccagacgaagaacttgaggcagagaggtgttaaataacttttctcaaattacacagctaagaagttatggagctaagattcgaatcaagtagcctggcttaacagaggcctgaactcttacccacatgtgatgttgcttgtgtactacaaccaggtactctgctaggtattagggatactttaaggaagaaggtggactatgtagtacctgccctcctgaagtgggagagacagaaacgatgatatgtctggcaaagtgaggaggatgtatgcacgtgctaaaggggttctctagcagggggctaatctagactgatcagaaggaatttgctaccagtcttccttttcagaagaccttttctgtagtgttttagggaagacggatgcctttcccccatctccttttatcattcccccccccctccaaagaaaataactaacccttcaaaaattcattgcattaagtgggacaagaattcattattttaattttttaacaactcgatggaggtataattgatatacaatgaactgcacctatataaaattaatttgttaggttttggcatatgtatatacccgtgaaatcaccacaaccaagataattaacatatgaatcatctccgtaagttttctcatgcccctttgtagtgctcccaatatgctcttacctccccagcacatctccaagcaaccgcttatctgctttctgtcactattgattagttggcaatttctagtattgtataaaaatggactcatacaataagtactgttttgcgtggcttctttcgctcagcataattattttgaaattcatccatgttactgtatatactggtggttcattaatttttatttctaagtagtagtaattgtggatatatgacaatttgtttatcactattacttatctgttgatggatatttggattgtttccagttttaggccagacaaatagattttttatgagtattcatattcatattctttatatgttcttttttctcttgggtaaatagttagaatagatagatcatatggtaggtgtgtgtttgaatttataagaacttgctaaactgtttccacattggttataccattttacattccaccagcagcatatgagactttcggttcctccatagccttgccaaagcttggtattgtcgaagtcttttaaataggtatgtagtgatatcatactaataggttctaatttcctagtgaataatgatactgagcttcttttcatgcgcttgtttactatctcatttaccatcttcttttaatcaggtgttcattttttttgcccattttttaaaaaacgtgggttgttttgtttcttatggttgaattttgagagttcttgtatattctgaatacaagtcctttatcaggtgtatactttgcaagcattttctctcagttgtggcttgtctttttattctcctcacagtgtcttttgataagcagaagttttaaatgaagtccaatttattgttcttttatggattatgtttttaatgttatagcttagaaatctttgcctaatccaaggtcacagaagttttctcctagaagttttacagttttatcttttacatttttaggtatgtggtccattttgagttgttttgtatttggaaagaagtataaatctcgtttcttttcatccagttgtgtcagcaccatttgttgaaaagactgttctttctctactgaattccgtttgcacctgtggatctatttctggactttctattctgtttcactgatctatttttctctcttgacaccagtatcatacagtcttatagggatgtgagtattatgggatctagcagacttcagaagaaatgataagtgttacaaacatcaggtatagcattcgatttcagtacaggcctagagaaaagatagtcataatctttaaaaaccctttatttgaatagtggaatgaagtggagagatatactgtgttgatagtcagaaagactcaattctctcggatgttaattctccccaaagtgatctgtagattcagtgtatatcccaatcagaatcttagccagatatttgtagaaattgacaagctgattctaaaactcatatggaaatgccaaagacctagaatagccaaaacaactttgaagaaggaaaacaaagttgcaggactaacacagcctgatttaaagcctgcagacagtgtggtgttggtgtcagtattgaggtttacatcttcatgttatgcaatgaaattgtgtcagttaggttttgctgtgtaacaaactttcccacaacttaatagcttaacaaagtgttaatcatttatttgctcagagttctgcgggtcaggagtttgggtgattgttttagtcttggccgcatttgctgagcctcagtggtctaggataacctcactctcatgtctggcagttggcaggttagttgatctgggggctcagctggagcagttcatctgtattccacttgctctcgtccttcacacttcttcacacagtagtgtcggggttccagagagtagcaagagagggcaagcctcagtgaacaggcacctgtcaagcctctgcttgtgtgatatttgctaatatccccaagaccaatgtgagtcacaaagctaagaccaaattcaaggggtggaagaaacaaattccacttcttgatggaggagctgtgaaatattatgaccaattttttgtagttcaccaaaaaggtattatgagttagttgagataaaagttattatggagagaaaaaagttttgttgtataagataatgtatgtgaaattatttttaggtatgtttccctaacagtattagaatatttaaaattatttcctgctctgaaagttttacattttgccccttaacctttatatattgtcttgtaaatttaaagtgaataactaatggctaggcacagtggctcatgcctgtaatgccagcactttgggaggctgaggtgggtagatcacttgaggtcaggagtgtgagaccagcctggccaacatggtgaaaaccctgcctctaacttaaaaacaaaaagtgaataactattgtcctatccatttactgatttatgaatgacacttttaacaaaactgctaattccttgcctcacagtttgtatgccatgtctctcattccaaaacagaaatgcatatcagccattccatggtttactctgttattacccatacttcctttctgtaccatgtgtcatgcaaaggagtgtttccatacttaactatgatttgctattttctggtaggtataatttaaagatttccattggtgtagaaagccttacaattttctcagtaccttagaatcaatagaactcttccatggatatttttaaataggcttttgactttttttgggtatgctgacctgcctgcctttctgtaggtatggcttcatgtatgctatgctgttttatgcacttgaaaagttgttccactgcctcaaagcttcccaccaccaccctaatccatctagaaaactcccgctagtttttttaaagtacattttaagcattaattgcttgtgaaatatttctgggttttcttcaccctgagaaattagatggtggtggtggtggctatagtagcaattgctgctttattttctcccaagccatattggaataagcgtggcatttatcgaatggtattttggtgtgtattattttctactttttctcccctgtattttcagctcttgaatagtttttgctgtttgtaggccttcatgcaatgttgaagatatcatgattgaatgaatattgactgactaacaaattagggatggtctgtatgtggtgattcattcagttacctctgatttgtagtttgaatttattgcagaccttctcttttcatatactgatgagcatatactgtataaactgttttagcttaattcttttttttttttttttttttgagacagagtctcactcttgttgcccaggctggagtgcagtggcacgatctcggttcactgccacctccgcctcccgggttcaagcgattctcctgtctcagcctcctgagtagccaggattacaggtgcccaccaccacgcccagctattttttgtatttttagtagagttggggtttcaccgtgttggccaggctggtcttgaactcctgacttcaaatgatccacccacctcgacttcctaaagtgctgggattacaggcctgagccaccgtgcctggcctttagcttaattatttgtgagaaataggaagatggatggacaggttctatccttagagaattcatctaatcaataaaataagtatgtctaaaaacaaatagagaatgccatataagttcagaggaaagagaaatcacttctagttggaggtaatcaggaagagctttgtggagcagatggcatttaaggtagcatttttaagatttgggcattttgaaatgggtaagaaaacatgatcaaaggcacagaggccaaaaccaaacaaaataaagtaaaaattctccttgatagaggcaactgtgggtagttgaatgtatcaataattggttttgtactttattgccacttggaaatcaagtatcccaatagaaagtttgttaaaatttatatgcaggcattttgtctatttttcattctgaccatgagtttatcaggtttgctaccattctttttactcatattactaaaacagtgctctgaaaactctttaactcttgtttgctaaattcagtcatttatttctaaattctcattttctttaacctttctagatttctacttggcattgttatatattcacctctgatatcaatttatgaaataccttccctagtataaaggatgtgagatcgaagaaaagaaacagatgtcctctgtattcctggcttttgtgaatagtacacgattatgcttaatctttttatcctctgtttctatttctgccttcttgaagcaaggattcctcaaggttctattttcagcctttgccttctatctgtctgtgtctcccctccacctcccatttttcttttgtctctacttttctttttttggagtacatggttgatgtataataaatgttacagactgcatcagtgtgggagaggaatctcaaccccattatggccatggctatttctccttttctctttgatcttcgtgtctaaccctgacctctcctctagctgtaccttcaaccccgagtacctgttataccttctctaccattacttcaaaccagtttatgcttcagatttgtctgtattagcagtgttattcttatttggctagttagctagaattagaacctttctcttataccctacatgtggacagtcttcaattactgtggatgttgtcttcgtcatctcttatatatctataccttctttattcctactgctaatatgtattttttgcattagtcatctgtaacctcttgtaatggtagctgctaattggtttccccacctttaggttgttccctttttcattcttacctgcagccaccagagccattttcacaaaacgttatttatgtagcactcttttcctcttgctcaatctttaaagatcagatctgaaatacgtagcaggatgtcctagtccttccatagtgaacctacctacttttcttgtcatttgccaccacctacccatagtcaagtaaactggtcacacaatcccttagtcagtcagtcttgcatatttctttctctttttttccttttggagacggagtctcgctctgtcacccatgctggagtgcagtggtgcaatctcggctcactgcaacctctgcctcccgggttcaggcaattctcctgcctcaacctcccgagtagttgggattacaggcgcacgtggccacgcctggctaattttttgtattttagtagagatgggtttcaccgtgttgcccaagctggtctcaaactcctgagttcaggcaatccacccgcctcagcctcccaaagtgctaggattacaggtgtgagccaccgtgcctggcccagtgttgcatatttctaatgacatattttgcctgcatatatatcttcctcctccaccccctgtcccatcctcatccttccagctcaagccctagctcttttgctctttttttttttttttcccctcctggcctctagaactgacctatctctttttgaagttctgtcttaccctggtgcacagggtaatatagaatctttggaaccttctaagaatactgtgactaaaaccaaatttatacctcaggcagaaatctcggcaatctttgctaaagcattctaccctgaggcatagctaatatccttaaacatttggcaggattgtggcatgggcagaagggaaagaaaaagagagaagaaaacaggaatgagagaataggagaggaggaaaagaatcttaaatattttctggttaatttgattgactgaacttaaccagtgcttgctaagtcttgagatcccaagggttgtatgtcggtgtacagataacactacagcatcatcaaccatgtcctctggcatgagactgatttaccttatccttagcaaaacttaaaccttacaaatctcatgataatttctaaatatctcactcttaaatacgaggtctatttctaggtctagattttgaataactaggtctgtttctaagtctaggtctgtttctccctgatatcattaaatttctgttcaacagacattctaagtgtgctaagtgttgaaactttttttttttttcttcctgagacagagtctcactctgtctcctaggctcgagttcagtggcacaatctcagctcactgcaacctccacctcctaggcttaagcagtcttcccacctcagcctcccgagtacctgggactacaggcatgtgccaccaggcctgggtagagatggagctttgccatgttgcccaggctggtcttgaactctttgacttaggcagtccgcctgcctgagcctcccagtgggctgggattacaggtgtgacccactgtgcccgacccaagtgttaaaacttatgttgaaaaatgaattggggctgggcatgctggctcacacccataatcccagcactttgggaggctgaggcaggtggatcgcctgaactcaggagttgaagaccagcctgggcaacatggcaaagctccatgtctacaaaaaaagttgaaaaaattagccaggagccatgacatgcgcctgtagttccatctacttgggaggttgaagtgggaggatccttgaacctagaaggcagaggttgcagtgagctgagattgtgccatagcactccaacctgggtgacagagtgagaccccgtctcagaaaaaaaaagtgaattggtattgcatgtctttgctaaagagatgtatggaaatatacatgaaggactattttctgaattcatgttttttattgatcaggacacatgaactttaatactataaaagcatccataatattgtagagtgtaaacttgaaagtggaatagattggcatcatcagccaataactcttgagtttattgtggaaaattagtctttttatttctagaatttttgagtaaatatattatttaaaattttaaggaaatacccagtcttttctgatgagggaggggactcaggagtaatttctgagttgaaaatattttcattttttgtttctatttttaaaatcattttgataaatgggaaaaatactgaaagaatgatgttgagctattgatccatgcatggaatttctttctgttaataactgaggctacattattctgaagaaagaccatatcaagaaaagagagagaaacctttcaagtttataatttgattttttgtagtgtgttttgtcttataggtaaaagattctcctttttttttccatcagtattatttcaaattttggtttgactaagttattagtcttcaaattatagcaattaaaaaaattttacagaaagaaatgggtaaaaggcaagataaagtataagagttataattcaaatattacattattttgacatttttctgaagagctgatgatttaagctatacctgggcatggtttcagcagaacctaggtgagatatcttaatcatatatctaaagattaagattctttattgtgtatatcctctagtctttttttttttcaagagacagggtcttgctgtgttgcccaggctagagtacagtggcatgatcataactcactgtaaccttgacctcctgggtttatgtgattctcccacctcagcctccgaagtaggtgggagtataggcacatgctgtgtgccaccatacccagctaatttttttggggcggggctataggcagggtcttaatatgttgaccaggctggtctcaaactccaggcctcaagcaatcctcctgactcagcttcccagagtgctgggattataggcatgagccactgcttccagcctatatcctctagtcttaaatgagagtttatagttatcacattatgttaggtaaagcaaatgtggtcgtattattattattattattattagagacagagttttgctttcgttgcccaggctggagtgcagtggcacagtctcggctcactgcaacctccgcctcccagattcaagcagttctccagcttcagcctcctaggtagctgggattacagtcatgcaccaccatgcctggctaattttttgtatttttaacagagaaggggtttcaccacattggtcaggctggtctcgaacacctgacctcaggtgatccacctgccttggcctcccaaagtgctgagattacaggcgtgagccaccgtgcctggcctagtcatataaatcagagaccatgggaatattaataatttttaaagtacttgtattgaaagtaaaatctgttttggttcctttaaacttttaacaaattataggagcagttaatgctaatttaaatgtgtatgaacgattggaaatttatctctaaattagtaagcgaaaaccagccaccaccccattccaccgcctggaggtactagttttgtcttaatggctacacacacacacacacacacacacacacacacacacacacacacacgtgtgtatatatatgtatatgtatggcatataatggtatgtgtatatataatgtgtggacatatggcatatattggtgtgtatgtcaaccaatacattacgtatatgtgtatacatatacatacatgtctaacttatatgtgacttaataaaagcttaactaattacacaataaattttttagttttttcattttatttggagcactgcttttcaaagtctaattacatacataatttattgattgatgtacacatagattcatacatgcatgcatacccctatataatttcatttacaaatatagaactataacacattattaaacaacataatatttttctttctttcttttttttttttttttagacagaggctcactttgttgcccaggctggagtgcagtggtacgatctcgggtcactgcaacctcagcctcccaggtttagatgattctgccacctgagcctcctgagtagctgggattacaggcacccaccaccacgcccggctaatttttgtatttttagtagagatggagtttcgtcatgttggccaggctggtctcaaactcctgaccttaggtgatccgctcgccttggccttccaaagtgctgggattacaggcatgagccactgtgcctggcaatttttttcatttaataatgcatcagtcgtatcttttcaccttgtatgtatagtctagaagaatttaaatctttctctggaaattgactaggccttcaataacatttggggatcactttcatgcttaaattatgtcagttgttttaggatttgaattacagtctttcatcttaaatacaacagcatctgggaatttcctctataattaagtcaccaaatattgaactgggttaactcttgaagtttaagttagtcagtcatagttcattattacagccttttatgatgtataagacatatcatcattttccagtcttcatatcaagaagaatcttaggagatttaatagtgatttaagatactagcttataagtgtatatgtggcccatcctgctgtactgctatgtatgaaatgacagaagtgtacagggaggaagaaggattaataattatttgatttgattagaagaggaaatttagcataaggttttattgcagaaacattctttttttttttttttttttaaaaagaaaggtgtcactatgttgcccaggctagacttgaactcctggcccaaatgatcctccctagtagctgggactacaggcacatgctgctgtacccagtcttttgttatttcttaattaccattttaatacctatacaggagactgttagaatatatagtcctctcatatctgtgggagattggtaccaggatacaccctctcacacccctgcagataccaaaattggcagatgctcaagtttcttatataaaatggtgtagtatttgcatataacctatgttcatcctcttgtagactttaaattatctctaaattataatttccaaaacaatgtaaatgctatgtaaataattattataactattgtctttaaaatttgtattatatttttgttattatacagtattgggttttttttattgcttttcacaaatattttgtttgcagttggttgaattcacaaatgtgtaacccaaggataaggagggctgactgtatattataatcccttaaggtatggcaaagcacatctgaaatgttatgaggctttgataatctctgttaagaattgacaaagtagggttttatagttctaatggtgagagagactataaaactgtgtattaagagcaacttttttttttttttttgagatggagttttgctctgttgcccaggctggagtgcagtggcgggatctcggctgcggtggtgagccttcgcctcctgggttcaagcaattctcctgcctcagcctcccaagtagctgggattacagggtgcatgccaccacgcccagctaatttttgtatttttaatagagacagggttttgccatgttagccaggctggtctcgaactcctgacctcaagtgatccccctgcctcagcctcccaaagtgttgggattacaggtgtgagccacaccacccggccaagagtaatttttaaaaaatgtttttccatgtatgagaagttgcttacaatatttagttttgtgctgtagcattgttttgctttttggctttgcctgtgtccttatctatttctcccataaactgtgaattcattgacaacagaactgtgttcatttctccagggcttagtacaatattttgtctgcaatagatgttcaataaatgttttattaattatactgaatagatttattcttgttcttcatgtgtaatgcacatagaatcagtaccagcaaattgaagataatcgagtatagtggtcctcctaatctgttagaactgagttcaggtaaatgtttaaccaagaataccatcaaaatatgctatagccattttgactcttaaaaatctgtttcttctgaacaatcctaaaataaattacagtgaccgtaaaaggagaagaattacactgatgggggcggggcatggagggcatggtaatacttaaattctcacagatgccctcacagttgcatttaatcctcatggtttaatcatccaaaagcatgttacaatattactggctctccacgattagggacgtcatagcccctgaaacttatttagaattatttaccattttgaaattttgaatgcttgttccaaatagaagatttcgtaggatcaatagttacaactggtttgtcttttaataaacattaattttcactttctgctcactctgtgtcctttttctaaggattacttagcagttttctgatttttgatgggccatttaggctctgaaagccaactcttgaacctattgtgctttgtcagacaaacctaacacctgtccatgtttgttactgcttttaatatctgttatagaaatatgtgtgcacatgtgtatttgtatataatggcagggtgggtatagcagctccctaaaaggagaaaagcaactggcttttctgaaaagacctttccacccccacctttttgcagacagccggagttaatccttccaagtttgactggaacagctgagcaagtgtaccctgcatatctggaggcctccagtggactcatgttgcctcagagttggggccactttcttcttttctagtgctgatcctgccagctgtcctaacctctgttaaagcacagcgagggaggtgttaaatgatacaaaaacatacagtgtcatgaaagggatccccttactgcgtgtatcagtgtgacttttttctcccattcctttccgtggcagaaaggttttatactgttaatcctaacacctgtctctgccggagacagtgagaagggtgtgtgtgtgtgtgtgtgtgtgtgtgtgtgtgtgtgtgtgtatgagagagagacagagaatgcgcatgcgtgcacacgggtacatgctccccgcccaagaaagaatagagtagtaataccagtcccatctgcctttctgtgtcctggattgggagtattctctgacgcacttaaagcctggaacatatatattattttggctcctggataccttagacttcctaccgtgtttgtgtgccagtgtgaggagcctgtgttcccttccctggctgtcattctctgcctcttgagtttctggttgagttgtcaatttaaaaaccaacagtaacagcaaatctccagtgtagttttcagtctgtaactagtaactcaaagctttttgcttttttctgaacatctcttctgtgtattgtcaaatcctgttggggtggaggcctggtctcaaccaagctccgacttcatcagctgagccagcatacctatctgcgtagactggaggtcagcgaaggatttttttggtgctacctagttcctttggacaggacagccagcgcaaacaaggcaaaaacttagacactttttgtactgtccttatctgaagattttttcccttttgctatgtatggtgtatattgtatggattatcaatatcctgttgtccaggtaagctaagggttataatttctagatactgtttgatttatgtgaagctttatggtggaatgaaatgcctacaaggctttctgtcttttgacccggtaccattcagagcctagctttcccagtgctttttgctaatttactgtaataagaggatttaatttatagtattggcggccagacaaaggtggttggcattcacccctagaagttctgaaactttggagagattctgtgtgtctgtgtgtgtgtgtgtgtgtgtgtgtgtgtgtgtgtttgtgtgtgtatgtgtgtgtgtgtgttttgaaccaggtgggctggacaatataaatgtaatgtaaaaaacccatcatattatgataaactttaggctttgttttgagcagatgagaggcacagttggcagtttccaaatgttgtattttccagaaaggtaatatataaagtagagggcatctttccccactaagactatttttagtctaacgttttagactattttgtgatgacattagtaacatcttatttgttaacttgttgaaatttagaatcagaaaatgttaggtcattgccaagcatatttctgaatatcttatagtaagaaaaattgaagttaggagtcctggattctggttccagcaatagagttaaccaccaccatgttcatgctcaaataacttcaatttttcttgactttagttttgttgtatataaaatgaaggagttgggccagatgacctctgagctatcatgattttttgaaatattgtgatggaaacctagaataagaaaataaatacagttaatacaattaattctgaattaaagatactacttggtctgtcagtttgttttagtttgttttcatgttcctttaattatttttttctttcaaatagccatttctctaataattagcacctatgttgcaggttggaccggaatgcatagagttaaaagaaataatggactaactagtacatcttattaggtattttgggcctaaaggcccaagctattttggattgggcctgttgggtaagctctctggagtaaacttacagctttcattcaagtctaaagctatcaatattgcaatcatatggcagtggctgtgattatgtttctctttaactatattctaatagaggtctatattatatgttttatattaatgatataactgtttctgttattttggattattcaaattaagagtattttatatttacgataatgaggttttgatatatttgtggatttcacttatctatgaactgtatctctactgacataaaacaatagcttgggctttgtaacagcttaaggctggaagtgttatgagactagattagaaccaggtctttttacaagtaaatattaatgtgctttcaatgagaaacatctgtgaacagtaaatttctgacccacaaccagcaaagtatgggaattatagtaactataacataagtaaaattctttgaggaaaaagttgaaaaagtaaaaatgtttcccaagtgaattgaagtattagacatatatgaaaaaataattacagtatgtaattgaattttttgaggaaggaaattgaccatctccccctcccaattttggggtggattaaagagttcctgttcagaaattatgacatggtttgatgaaagtcttttgcagcaaaattctaatcaatattcataataagatgaattttccacccccaatttttttggttattagtatttagtactgataaatgtagtgcacagtatttgaaactacactttcctggctttactccatttgtaggtttattctatctgaaattaacgtcgtttagaaatggaggtaatgggatattaaaatttaagggtttactctccattctgccacataggaaagctaatgggattaaaaaaaaacaattttaaattgaaggatcccaagctattttacaatcttatttattacttttttaaagtaacagtttttttcagtgcatttataaatgagtagtagatggttggttactacccaaactcttaactacagttataaaatgtttttagcttcttttatatattcttttgcttagttaaatccaagctttccattgcataatgcttgcagtttcatactaatgcattatacagttggacgttatggaggacatgattgaacagtatttcttttaatgaaaggttttacatctatttttaattaagttatttctagaattgctagttttgagttaatgaaacaaagtgagttctcttcaacagaaagttcgaaaatattttaggtacttgacctttcattgctaaatcatgcctattttaagagtgtgccattgaaaatgattattttattagttataattttcgtagaacctagtctggccaaattagtttaaaatcaggcagagtaaggagatacaggcttgcttgtgatttaagggacaatgaatgtagtctccctgcccagacaaatctatttaagaaactgttcctgaagttattcttatagacagtctttcagattaaacatttactgcctctgatcagatggttaaaatgtaacttgttgcaagttaagggtattgtcttttatcacaggttttccttaggcacttttacttaacctgtcatccaagtggtgaatggggcagttggaggaagaggaaacagggtcttaaattattggaggtatagctaaatttcctgatttgagggtttagggtagccaaggacagcttaaggatattaggcatctagaaaattgagagacagaaatttacctatctaaaggacactttttcttttgaaacagagtttctttcttgtcacccaggctggagtgcagtggtgttatctcggctcactgcaacgtctgcctcccgggttcaagcagttctcctgcctcagcctcccaagtagctgggattacaggtgggcatcaccacacccagctaatttttttttttttgtatttttaatagagacagggtttcaccatgttggtcaggctggtcttgaactcccatcctcgggtgatccacctcctcggcctcccaaattacaggcgtgagccactatgcccagcctaaaggacacttttgatattgaggtatgctcaggtcctcaaaatgctgtagagtatattaggctctccatttcttcatgggaagttgaccttggtgttaagcagtacacacacacacacacacacacacacacacacacacacaactatataaatttatttacttatatagtttatacttatatagtttgtgtaattatattaacttatatagtttatacttacatagttatataattatattaacttatatagtttatacttatatagtttatgtaattatattaacatatgcaagtttataattatagtgtatgtaattatattaacatatgcaagtatagtttatacttatatagtttatgtaattatattaacatgcaagtttatacttatatagtgtatgtaattatattaacatatgcaagtatagtttatacttatatagtttatataattatattaacatgcaagtttatataatttatataaattgaatttattttctcattctgaattagtttattgtgtaccaactgttttttgagtacctactgtgtgccagatactatgccagacacagggatattagtggtgaacaagacaacaaagtttcctgtaacttaataatagaggcatggcatattcgtggcatgccgttggataaagagcagtcttcaattttcacagattaatcatgtattatcttcttgacaacccagttattgataaatttgtttacatcccatccattttcatatttgtctgagaaccttttccttaatccctcacagggatgtgtacaatgtacacataatttcagttgtatgtatgactctagttatctggggtttgggatttcttaaagatatgaataagttacccaaagacatgtagtaatttgtgaattaaattttttgatttgcctggcctcactgatgtcttagtttatgttatttgtggttttgtgctaaaggtttgactttggggaacaggaaataaatgaggattgttttttataagcctataagatctaaagcatttgatttcaaatttcacactcacttttttttttttttgaatggtgaatgggttctatatgactgaactctgcctaaactagagaaataaagttagggaaataatagagttagctgtaatttgacttcatttatgttaaggggaatgttggggcaaaggatattaaagtggtattgtattagaggtgcttctggaaaggtatttaatatctgttaggtgtaaattgttatttacacttagttagggttattgtgtgggggcgtgccgtgaagagcctttataccaacaagtttttattattgcaggaaatgctctccctttaatgttgcctttcacttgggtgtcagaggcagcctgggaaagttggagcaagccctgccttgtagacagggactcttagatccacttttatagcagtgctggtatgtgggtggaaggtagggaagctgagttacttctgtatgacaagaacacctaaaaaaaattttttttaaatgagtgggtattattttgtctagaatctgaactattctaataaaattgaaaataaagcctttctcccactctttttgtacatcttcctttcagcttcagatttctgaaagatactgaaaataaaactgaagtaaggccaggcgcggtggctcacgcctgtaatcccagcactttgggaggccaagacggttggatcacctgaggtcaggagttcaagaccagcctggccaacatggtgaaacatatctctactaaaaatgcaaaaaaaaaaaaaaaaaactgccgggcatggtggtgtgtgcctgtaatcccagctacttgggaggctgagacaggagaatcgcttgaacctgggaggtggaggttgcagtgagctgagatcgtgccactgcactccagcctgggcaacagagcgagactccacctcaaaaaaaaaagtgaagtaaatttataaatttgaagatatctccaagtgcgctcttggaagaaagaatgcttttataatattttgataactacataggtgctcttcattctgatgtatccatgtgtgaataaataaatggctagagtaatagaaatcaaggcattattgtttgatttcaacaaacattcatttactgtgtattcagatactgggttaagaactggggatatagtataaaacatgatttctaccctcagactgctcatagtctagtcatagttatgcagaacagtaactccaaccgttatgtaccatggattaggtgctaaggtaaagtatgctcacagataagggtacctaaaccagatgtgggagcaagtagggtcaggaaaggctttctggagtaggggatttctgaagtaagccttgaaggatgaataacccatatagtcggccatattcaagggaaaaagaatagaaacatggtgttcagaagagatgtatgtgctcaaaaatagaaatgtgggagccgtcagggtaaattcttggtaactgaagtgatagaatgagttggaacaccttgagcaagtgtggtcagcaatgttaacttctttgaggtttggacccttttgagaatctgataaatactacagatcctctctgcgtggaaatgcatataagaaaaatttctactggggtgcctgtgttaggaaccatgcactttgggttaagaacctctggtgtgcagtaaaaagagatctgaggatgacaccttgcaagtaacaacaacaattgagaggatggtagaggaggaagaagagtacgatggagaagagggtgaacagggaaagaggaaagttaagaaagactggtatcattttaagttaagagtgagagtttcccaaaggagggaatgccaaataccacagacaaatcaaagaagacataaaatgtccattaaatttggccatgatttggaggtcttcagtgacttcagtaaggtaaatttcaattgagtagtatggaggaaaggaagctggggttctggagattggatgaaacactcaaagagttgagactacagggagaagtacctctttccttcatttgtttatttaataaatatttcttgagtacttaccacgtcccagacactgtcctgaaagctggggatttgtccatggagaaggcagggcctccttcattagctgacatctcatcgtgcccaccctgttccaaagcttcccagcccctgcctgtctctctcctcccaaacacacatacaggaaatgtcctaaaatgattttctccttggtacattaccgggcacattcagccaccaggggactccagttttgctgggtcagacccaggctgctcaattgctcttctctctcttggacaccagggagcaaattgtcctctataataccagggacacacttcaaaatatcattgtgccagtcagacctcactatgagcctgtcattcagtgagtttataaaaatcattgtaacattttttttaagcttgtaccaattctttcctgtaataaatttttaagcctatttgcactgtaaaatattggttctaaatgtagaaaagtagcatgaattcctggcctgaggaaacctttatcctagtcttggactttttgcatgtggggacccctcatttgcccttttctttaaaaacaaaataaaacaaaacaaaaaaactccttggggccttgtctctttccatgatgtatggaggctgcagtcacacctaagtgtcaaggtagctgctgcttttctaaggatgggggcgggggacattgtgggggagatgctatcttcttagtgccccaggctttttgtcaagaatagtgtaataaaccagaggattcagagaatgatacacagtgattctgaggtttatttcaattattagaactgaaaacacagttatcccattagtatgattcaagattttttccaaaaatacactgggttgctcttgcttccagtgaaactcacctgcccattttctgcttactcactttgtctttagaaaatttgactgctttttatctccttctgattggcttttcagttgcaaattcagagagtactatatattctgtgttccaggtcacttctaaaaagtgttaaataagaacaggcctagtacttatctatattactttactcagcgtttttcctaatatttgaagatctcattctttttaaaattattactatggattatgccacaagtatacagatatctgtaaaatgcacagaatagagcctgatatactatgttacatcagtttctccaggttccacagatggtcctgtatttcctgtgttcctttcagaattgttaaaatgattattaatttaggagcgggtgtaatgatgttgtattggcagtgtgccagccaatggtgttatacaacacatttttttaattttaaaattttaaaaattgaattcacaatagagatagggatttgccatgttgccttggctggtcttgagcttctgggcccaagaaatccaccagccttaacctcccaaagtgctgggattacaggtatgagacactgcgcctggccaatacagaacatttttaaaagcctggtactgcatgttgccaaacagtccttatggagacagcaaaaaactatgtattctcagtgtgatttgttattttgaatttagatttctgtagatgtttattttttaaatggagagctcgtgttgttagccgtgggcttgtaaaaaataaaaatagataaaaattaaaaatgggaagcttaattttggaattaatctttttaacctttgggtagtcttttagaaagtatatcctaaaaatacatagcataactaaaatatctcataaatccttcagaatgagctatttattagaatgctgtaaaaaattagaaaatcttaattttatgagacaactgataaactcatcattttataaattgttttatttgaatgtgtgataatataaaatagggaaattatgaagtttatattcagaggttaaagatttttccaagatcactagtaaagggcagaattagaccaacttctggactgaaccacatctttgatgcattttttaattatattattttaataagagaactttaaagaaactcttattgtcagtattctcctaaacctgtagctacagcattctataacaattactatttacaataatgacacaaatttctagggtatatataagaaaggatttacctttttcaataaaggctgaaacatagaaggctggagaaaacaaaaggtgaattttcagttaaccaaaattttattgaagctggaagccttaagcaaatttgcatgcacctttgtgtatctcttaagtttcttaagcagtcatatttgtagacacctttttcagagtctccaggtattttttatagtaggaaaaaaatcatttaaattacctctcattacctgtgtcctctcttttagtcctttgctctcactaggctggtttggtcttccaggacaagcaagttcttgcatattcctgttccttgaaaaaccttccagttagtggtcatgtaatagcttttcacttcttcacatctttcttgttaaatccactgcatctataaactgtacatcagtaaaaatgttttattaatattaaaaataattttgtttcatttcttatttgacattcatggctggaatctcttaaatctgtatgaactatagtaagctgctatgaatgcttccagtgctatataattaattccatcatcgcatccttaaaatatgccagcacatggcgcttgcccctccctacctcctcccccctacacacacacacacacacacacacacgcacacacgcacacacgcgtgcgcacagcgtacaccaaactgccattctccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcaggtaagatttgtgcttcctcggcatgtttcttttctcctctctgggatctaaataaaggtttgagggtggagtatagtaagaagagttttaatcattattgtcttcttagaacagaccagatttattgttatcagctgaaaagtctgtgtctgttgagtccgtttatgtgtgtgttatgtatccgtatcctttcttccccctccctcaactccatagcagattcctgtttcctgtactgtgcagctgtagctcaggaaagaccctgtggggatttgtctacctctttgtcttggttctgagaagagggagggagagaaagactgcagaggtaggaagagattcttgtagactgccaaaaagaggggagcaggattccttttaagaatttcagaagaatttgtgttatagggaaatctgattccttgttcactttggtttctcaggattggctatggaattgtagttttgctgttactctaaactgcttattaaaaatgaaggttagaaaagaatgtttcattttcatgcctttgttactggcaaagaaaattttcagtaggagcattcaggtgtgacagaggcaggtagagccctccttgacaggagaacgaatctgaatgtataaatcacaatcacacaggctttaaaatacatttgaaggagagagagtaggaaatggaagatacctctcctccctctgtctcccctctcgtttttctctcttctcttctctctctcccactcccactcactctctcccccaaccccctcaatccccctttctctcctcatccttttcccctctttctccctgcctctttttggttatgccaggcaatatctaatctgcattttagcaagtcattcctgacaaatggaaaggtgaatgctcttccacagttctccctggcaaggcaatttttcttgttagcatccttctgtacgctccattaccctttttcctttatgtataggttaagaggaaatgatgaggctctgatttatcaatgagaaatcatttacactgtaggacattcaaatcctttagtctcagacttaagatcagtttcactccaggtttctatgctctgtggaaatttcatcactggacagtgctttccttttaaggaggttgccctttttttgtgttctctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagaacttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaagaaaagaaatactgctttattttttaaaaaaaatttacataaaagataaatcctgtttctggattctctttttgcttgggagatgatacttgcttaaccttagagccctcattcaatttttattaactggcaatattagagggtaacagctctcttcttgcttagcaattactgaaggcttttcaatgacttgacttttcattatttattttttaaactagtgaaagaatgatctaaaatggaaatttttatgatgagttttctattgcctcttggaacatttccccttagtttctagaggagctggtaagtgtagtgtgtgtgaccattaagttagagtgcacatgcttatgcacacttaatattgtggtcgtaataattagtatttaaagaagccataagtttaggaatgaagtagaagaaataaatggaaactggaaagagagattctggggtgcttaataattctaataataaaatcacctgttttatcaggatgtgctaaatattgaagaaaagttatgagtttttgcccatcctgaaattatacaactggcaaggatagaatatcaaatttgtgaattttcagtattccagcgtatttgttttgttgtatatactttctgtgttaatgtaatgtacatagttgttagtaatctagggggaaaacaatcaaaggaaataaccagctgggccaagtctttcatttgtcctgtggttgtgttgtgttgtgcctgcgtgtgtgtgtgtgtgtgcacatgtgtgtgtgtgtgtgtttgagccagacatccaatcccaacatttgataatgacctgtcacataagctttctcaatatagaatgtctatactggtggttaggcctgggttttcaaagttaaacggtttattacaatgtaagagcgatgtatggatgtgttttcactgttttgctacttaggttctttgcatcttcagatgataccatctctgtagtccccagtttccattgctcagctgttggaaaagggctttcagtgaatgactttttcatcataccatattagatccttgtcagtatttgcacagtgtatgcgctttattattacatatgctctacttttatagggcctgtttttgttttaattatcaaactactctgtcatttatagtaagtaatcagtgctctgctaaaaagcaaatggcaatttaatcacaaaattctaatatagccgatagacatgcttatgtgatacttaaaacgttaattttatcggctgttcatgtgtatgttgtaggagtatttcactgagatctcttattttttgggcatatagaccagattattgcatctcatatttatgaaaatagcaatatggaatatgaaggaaagataaatcattcttgtactatgtgtaaaattcgaaaaacaaaattgcaaatgacttcaacactaattagtaaaaaataaatgtttagccaaactcaaattcagttatactatctattgttgaaagggaaagtgtactaggcagagaggaaaagattttacagtatggatgtgaaagaaaatttttgtactctactatggtataagactgccagtttctgtggaacacaaagccctccctttcttggacagctcagtgctttgctggcattttcttcaaaatctgttttccatcaggaccaagaggagggaaggtgttaggaataagggaggttggaaagggggttgctgttcctttaaatagtgcagtgagtccatgtggcagcaggccgctctggagtgtattcttttgtaatgaatcaccagttccattgtctgctatctcccctctttgtagctggaaggctgaagtctttcacctgagctgctgccagttcgctcttctgttcctgggtggttgggagaagagaagagggagggtattttatgctttaattaaagacagataagagagcaggtatgttttgctttgtttcattttctcttttcctgtttttgtttgtctggtttttgaaaggagttggagtagagaatctattctgtgattttgctaagcatatcccattttctttgaattctggaggtcctctcagcatttagtctccattttgtggcactgctttaaagtgattccattcggttgcctgccagtcatgctcccttgccactcgaaccttatcccacccttcatccacggagctgcagccacactgtttgttttggcacactttccactttctatgggctttgcaggatttggggagttggaggataggcggggattgtgggttggagactgaatttatgttcctttacaatgaaaaaaaaaagcctcactttttccagagatttggtttctttctgaattcttctacattgctccatatcttcagttataatcatttcttcgctgaggccaagattgtctcttgaaaagtattgcttttctaaaaattacttagctttcttgaaaagataaacagaatttcataaatgaagctatgatgaaatccgagcaatcttgactcattaaattgttttttccgtcttagtcaccccctaatcacacacacttttctctttcttttttggcccccttctctattttttcctttatctttctccttagctttgcaattgagtctaggtaagcttaatatttgacaacctattacttaaatttgtattgctacaggagacatcttcatattgaacagtaatgacattcctcattcctctcagtgataaggcataagctcaaattcctggttttgttcctccagttttctgttctcccctgagaaattccaaactctgatctacacagattgccatatgtaaacaattttatctctctcaaatttgaacttttcatcatgtaattccttacctaggggttgtttcttggacatctgtttatggtagacagatagtttctgggaaccagtcatactaggtgatacagcccccccttacccaccctggtctccttctggtataccattcctctccgggatctgacattattggtatcccacatgttcccttccgaagtcataattcctcactcttttttttcaacatttccaaaccactgtcaaatcttttttgaacatttcctcccaacattttgtatgtgaaatttgccaggcacaaatacaaggctcccctgcagtaaatactttgctcttttgattgtagcacctttcttagtgggctccagtgttcaacctcttctaggcagtgagaaatgctgcattctgccatcacaatgtattgtgtctattccccagactcttaaatgtttctctattactattagaatgattaaattcaggaaactaattcattagaggtcattgccagagtgaatcatttaaaatgcaagtctgattttgtcattcctgtgcttataccttacagttgctccccttcagtctctgaataaaatcctgtgaccctgcatgatcaggaacctggctgtctctctagtctcatctcctgccatccttttctttctgtatttcattctaatgacactggcctctttgctgttctcttaacatgcctaagaccctcctgctcaggacccttctgcttttctccctgcccaaaatgtcttcccactggtacccatatggtttgttctactcttgaatatttcttctcaagggcgacctctcccttaactttcctagctaaaccagcactccctcatcactcctaccttcattctgctttgtcttcacttgtcactgattttagttcttaccgttgattgttatatgtttgtttgttgtctgtctcctccccgaccccaaacagaagctccctgagatcaggatcctcgtcagcagtctgttgtattcccagtgtgtagaacagtgcctggcacatagtcataataaaaatagctaatctttatatatgcttatgatgcattaatatcagataccgttctaagcactttaccctcattaactcattgaatcctctcagcagctctgtgttatctccattgtacaaaagaggaaactaggcatatgacggttaagtaacttgcccaagttcagacagctactaagagatgttgtggggaatgatatccagacagactggcttagaaattgatattcttaaccactgtactctaatgccccttgtaggtattgggtattcagtaaatatttgttgaatgtgtgaataaattaatttagttgagactctgattcatttctgaaatttccatccctgacttaagactttgataaaacacttgcagtaatggaattcattgttgaataagattacttcattcttataatatgtaataaagtatacattattctatgataaaaatattaatattatctaataatactaaataataatgcagagcacatactgtgcattaagcattgtcttaagtgctttacatattttagagcatttattccactcagcagccttatatacttactcagcagtactattaatgtccatgttgtagaaattaggaaacccaaggagtttggctccagcatttctgttcttaaccaccactaataatgaccattataaaaatgtttttgtttttttatacctactttgtgccagtcaattttacatacatagcacatttacaaacataattattcatattatgtatcacttgtcaatcatctttgagataggtgaggtttttcccattttttgcaggagactttgagattctaaagatcaggcagcctggaaacagagagagataggtttcaaactggagatctatttagtcccaaattcgcatgctcttccattattctgtgaacctcataagataaatagttccattgttggccatgataagtagaaaagttttctttatgagctgaaatctgttttcatgattgtcttctcactccttctcattttctcatctggagttgcattgagtggtttcatgtcttctacataaaaaccaaatatttgaagatactgctgaacgttccctttaatcttctgttgccttgcttatttttcctacttccttgaattactcctcatagatatgaaaacatacggtttccagaatgtttactgactgtcctggactagttgcattaatttatatgaatgatttgtcatttatgtctaatcactaagtaaaaatatcaattatgattactttttaagttttattgatgcataattatacatatttatggggtacatatgatattttgatacatgcgtataatgtgtaatgatcaaatcagtaattaggatacccatgacctcaaatatttatcatttctttgtatagagaacatttcaaatctccccttctagctattttgaaatacacaataaattattgttaactatagtcactgtgctgttgaatattagaacttcttcttcttctttgttttggagactgaatctcactatgttgcccaggctggagtacagtggtgcagtcttggctcagatcttggctcactgcaatctgcgcctcctgggttcaagtgattctcctgcctcagcctcccaagtaggtaggactacgggtgcatgccaccacacctggctaattttgtaattttagtagagacagggtttcaccatgttggccaggctgctctcgaaattctgacctcaagtgatctgcctgcctctgcatcccagagtgcttggattacaggtgcgagccactgcacctggccaagaacttatttcttctgtgtttttgtacccagtaaccaacctctctccatcccctgcctccttcccagcatttgctaaacattctacagttatgagtattaagtatcatatctttgttataagttttgttttatgataacatgtttggctttagtcagtttcttttttgttgtttttgagacagggtctcactctttcgcccaggttggaatgtagtggtgtgatctcggctcactgcaacctccgcctcctgggttcaagtgattatcctgcctcagcctcccaagtagctgggactacaggtgtgcgtcaccatgcccagttaatttttgtactttttggtagagacagggtttcaccatgttggccagactggtcttgaactcctgacctcaggtgatacacctgcctcgacctcccaaagtgctgggattactggcgtgagccatcgcatacaactggctttagtcagtttgtatagctcattgaacatgtagtgttgttggcaatttataatttcaaaaatgaagggatattaccttgaactcctaaaaagaataaatagaatattgtttttctctccactataaagcatgccctcagctgattggcaggaatctacctgtcttttagtatctgagtcttgccctgatccctcaaaggttactgtcactgagtaatggaagtcaataattattttatgaaattataaatgaatgcttttatgtccacaaatgatacaactgtattcttttttcctaatgttaattatgattcctcataagaagtttggaagagacaaactgggacttaagtgaaggagattgggttttgaaaagactcttaactgagagcaaagatccacgaactttttctgtaaagggccagatagtaaacaattttggctttgcaagccatgttgtttctgtcacaactacccggctgtgctgatgaagcattgaagaagctatagatgataagtaaatgaatcgttggttgtagctgtgttccagtaaaactatttacggacactgaaatttaagttccatgtaatatgtatgtgtcacaaaatatgattcttttaactttatttttaatttattattattttttttttgagacagagtctctcactatcacccaggctggagtgcagtggtgcgatctcggatcactgccagctctgcctcctgggttcacgccattctcctgcctcagcctcccaagggcaggtgcctgccaccatgcctggctaattttttgtaattttagtagagacaggatttcaccatgttagccaggatggtctcgatctcctgaccttgtgatctgcccacctcggcctcccaaagtgctgggattacaggcgtaagccaccgtgcctggcctcttaactatttaaaaacgtaaaaccatgcttagcttgcaggttatgcaaaagtaggtggagggctggctttgaaccacaagctatagtttgctgatccctgactcagagggatacaggacctcgcaatttcctttatagcatacgtaaggttttcccatatagcttcatgacagagagacagttttgagtggttctagcaggtcatgatggatcccttttataatagaatgaatcccctgatttgctctcttatttccccagccccagaaaatatgaagattcttctccttctttacttcctttctccctccatatgctgtattttataccttattgcttttcatatacattttcatatttttttaaaaacatttttcatgtagttatatactgtataacaacatttgggtcaacgacagactgcatacacaatagtggttccataagattataatactgtatttttactgtcccttttctatatttagacacacaaatacttaggtttgtgttatgcttgcctacagtattcagtatagtcacatgctgtacaagtttgtagcctaggagcaataggcgatgccatatagtctaggtgtgtagtaggcaataccatctaaatttgtgtaagtacactgtgtgatgttcacacaaagacacttgcttaaggacacgtttctcagaacatatccctgtcatcaagtgatacatgactattatttattactttgggccagatgcatttttctcccacatgattaatttgtctttaaaggttcagcttagacttcacctacttcagaaatcttcctgtctcacacagttgtccctctgtgcttcattaacattctgtatgcattgttcgtttagcttatatggtactataattgtgagtatatttctgtgtttttccatcagactatagtttctttcaggattgggactatatcaccagtgtcagcatccagcaaatatttcttttgagttaattaatgatttttaacttgctaattcattgatagtgtcctcttttgaaatgttgaatgggagagttaaattgggtagtcacttgtaacctaatgcttattacttaaatcagttaatacttagcacacatgtagtttgggaaatagatgctttacatggctagaagattgggaggattttggaataaacaactatttgagggacacaggaaactcttgtattgtagatgttttagtgaaagtggaagcctgggtgtatgacggtaaatggcataggagctctagcctcctggggagtcaggcaggaaggacgaagggcatgactcccgcaactggggaaagggcacgacagagaaagagaagtggaaggtgacaatgaaatcttagggattggcaacccatggcaagtataccaaatgtggtatattgagcatagtcatcttcctctctgctttgccttccactcaagatggccaagagttagattctttacatactacttttgaaaacttgtcatcgcagatatatagcagatcctaaccagccattctatgtcattttcaaggctcactattcttttaggtctttttccctccctctctctgtttctttttggatcttttctatatggtaacatcaaatgtacttacctttttttccctgcaacatctagtctgccattaatccaatccagtgggtgtatatgtgttttttaaatctcagattatagctttcgtctctagaatttttatgtaggtctttttcacacctctcatgtctcttagcatgttcatttttttccttttttatcttgaacatatgagacacaaatgttttaatgtcctcatctgctaattctaacatatgtattagttctgggtgagttgtgattaatttatttttctcagcattatgtgttgtagttttcctgcttctttgcatgcctggtaatttttgactggatgccatacattgtgaattttatcttgttgggttctagataattttttatgtctataaatattcttgagctttatctacagcacaactgcgtttcttagaaaaagtttgatcctttcgggtcttgggttgtttgtttgttttgttttgttgtttgttttttgagatggagtctcgctctgtcgcccaggctggagtgcagtggcgcgatctcggctcactgcaacctctgcctcccgggttcaagcgattctcctgcctcagcctcccgagtagctgggattacaggtgcgtaccaccacgcctggctaattttttgtctttttagtagagatggggtttcgctgtgttagccaggatggtctctatctcctgacctcaagatccgcccgcctcggcctcccaaagtgctgggattacaggcatgagccaccacgcccgacctcaggtcttgttttttaagctttgttagacaggactagagctgtgtttagtctctggttaatttttcctggccactgaggcaagactctttttaaaactctaatggatgctccttacatcattaggttttccactctggctgttaagaacaggattattcttggcactgtgtgagctcctagtactgttccctgtatttctttcaggtggttctttccccagcctctggaagtttcacacatagatgtggcagtcatcactcaactgagtacttgagatctttagagctctctttctctctgcaactttctccagtaccgtcccctgtgctgtcttggcttctccagacttctaggtctatcttctcaattcatggaacccaccaggttctgcctgggtccttccttctctgctgcagcctggaaactttatccatgtgataagttggggcagttgtaaagctcaacttgcttgtttcctgactctggaatctctgtccttccttgcctactagacaatgtcttgagtgctgttgtttcatgtattttgtggtttttttagtagtttcaggtaaaaagaaaaatctgtttcttttttttttttttttttgagacagattcttagtctgttggccaggctggagtgcagtggcagaatcttggctcactgcaacctccgtttcccaggctcaagcaattctcctgcctcagcctcccaagtagctgggattacaggcatgtgccattatgccctgctaatttttgtatttttagtagagatggggtttcaccttgttggccaggtcgaactcctgacctcaggtgatctgcccacctcggcctcccaaagtgctgggattacaggcgtgagccactgcgcctggccttaaatctggttcttgttactccatctttattggaagcagaagagtgaacacatacttttaaatgaaaattaagcagtgttgcattgaatatatttttaatttatgagtgaaaatcagttgaacagttcatttcaaggagtattaaggaagaatgcgtaagatgtgtaagtaattataatacaaagtgggatacagtaaattacatgaaaatgatgtcagtaaagtgttgttaaaagcttatatgaggaaagagtttgagaagtttggcagaagtggaaggtgtgaggagaatggctatggcattgctttgtgtgtgtatgtatatgcgttatacaagacattatctgaaactagaatcaaattctttagtattgagtgaggtttagtggtaggatagtttcagagagtctaggactgataaaattaatggggggaaaaaagtcattagcagaaatacctaagcaagaacacaggaaaaacagagtttccatgtttttatagtttggtgtgatttgtggtcttgcggaaaaggagaagcatccttttttcctatgtattacctgcccttgcaaatcttgcagaagagggagaaaattcaaagtactattttttcactgtgttaaacagtgtaaaagataggggcactccggactgtgaaaatgatgaccactgctgcaaacttggtggaaccttagaaaacctcaataagcaatatttagactctttgagtcattgctatttaaatgataatcagattatctacagatttcaatggcaacacattgtagaactaaataagtagatggcattgtttatagctttcttaatttcagttaaaatggtcacctgactgttgttcgctaacatagagcaactgtgaccaaaagcttatctaagtaaagtaatccccccatccacagtgtcccttttcatggtttcaattacccatgatcaaccatagtctgaaaatactaaggtatggtattttgagagagagcgagaaggaggccacattcacgtaacttttattacactatattgttataattgttctgttactattagtattgttgttaatctcttactgtgcctgatttgttaagttaaactttctcacagttatatatgtataggaaaaaaaacagtatatgagggttcagtgctatctgcagtgttaggaatctactgagagtcttggagcatatgccctgtggataaaagaggctactatatatgctttaaagttttccctcctgaggaaccagggggcatttttgaaaaacaggagatgcagggggggaggtttgtttacttttacttagcctatctcttatatgcaatctttaggaagaagaatgtgatttttcccctcatatttgtattgatgtgactgttcatatgaaaaagaacatggagaactttaagattataactcagctgttagcatttatattttggactatgtatgctttctattttttcttattctttcacaataatagtggtaattattatctctatttttttttttttttttttttgagatggagtttcgctcttgttgcccaggctggactgcgatggcgcgatctcggctcactgcaacctccgcctcccaggttcaagcagttctcctgcttcagcctcccgagtagctgagattacagacatgcgccaccaagcccagctaattttttctatttttactagagatgaggtttctccatgttggtcaggctggtctcgaactcctgacctcagtgatccatctgcctcagcttcccaaagtgctgggattataggcgtgagccgctgcacccggcttttttttttttttgccaaaagcaaagaattttttatatatgatcttagttaattccttttttttttttttttttttttgaagcggagtctcactgtcttgcccaggctggagtgcaatggtgagatcgtggctcactgcaacctccacctcccgggttcaagtgattctcctgcctcaacctcctttggtagctgggattacgggcacctgccaccacgctcagctaatttttgtattattagtagaggcgaggtttcaccatgttggttaggctggtctcgaactactgacctcaggtgatccacccgccttggcctcccagagtgctgggattacaggcgtgagccactgcacccggcctatcttagttaattcttgtaggtacccttttaggtaatgatccttattttcattttgcagatgaaaaaccgaaggccttgagagcttaagttactcatctaaggtcacacaaatagtacattcattgcagagcctaaattttaacccatgtttatctttctaaagtttatgctatttctggccctgcccccattttgatgacaggtattacattaagtataatataaagaatacagaccttactattaaactttttctttttttttttttttcacttagtcaaaatttatttgaaggcctgaagacatttagttaactttttctttacataaactctgccttcccccaccaagtctctgtaacccacctttggccaaacccttgagaaatgtctactaattgtcttggagcctttggttcctctggggtaagcacagaattgattaatttgactatctgatgcattttggcttcccaaaattttatcttattaactgcactcccaggctggagtacagtggcgccatcatggctcactgcaacctccgcctcctgggttcaagcaattctactgtctcagcctcccaagtaagtgggactacaggcacatgccaccatgcccagctaatttttgtatttttagtagagacggggttttgccatattggccaggctggtctggaactcctgacctcatgtgatccacccgcctcggcctcccaaagtgctgggattacaggtgggagccaccgtgccaggcctagaaaattattcttgaatgaagctggatagtgtagttgatttaattgataatgataataatgaagtttcaagtgaggaagactataagtaaagagaagaaatagatatgtctttttatgcttttttaaagtatgccctgttggtttagcattgacttgactttcacaggaaatgtggagtgaaaactacaaacattttcattactaaacaactattaaaatatggatggcttgtttttggttcttttgttagctggtttcaggtatccctagttctgtcttccgcaggccacctttcttaagttgagataggttttcctgttcagtaataacagtctgtttataatagcatttctgatgactacttctaacataggactcccatttcttctccaggctggcctcattgtgataaaggattcaatgttgtaatcactggtttacatttcattgccattcctgattgaaggatcagagtccatggcctgccttattgatccatttgctagagatcagtggggtaacgggaattattttcctctttagactgcattctgatcttggctactattgcattcatgaagaaggagggagatgaaaaattaggcattctaactggtaaatacttgatgttttcttttgtttctgagagtagttagacccttgcaaatcttttctgtttgtaaggatttaaaataatgtttagcatatagtgctgggtgtgtttgtagatggcattaggactgtgacttacagcacatatttagggtttttttttttgagatggagtctcgtccgtctcatcctgtctcccagtctggagtgcaatagcgcgatctcggctcactgtgacctccgtctcctgagttgaagcgaatctcctgcctcagcctcccgagtagctgggattacaggtgtgcgccaccacacctggctaattttttgtatctttagtagagatggggtttcaccatgttggccaggctggtcttgatctcctgacctcatgatccacccgcctcggccttccacagtgctgggattacaggcgtgagccactgcatccggccacatatttagttttgatccttctctgagttgctttgcttcctgtaatttaaatgtgtctaatttattaaagcataagtatacaggcagttttaaaaattgtagtaaacacttcttattttccttttaatcttctctaattttcttttaataaatcttcgagttcttaaaagttttttaaagaaacataaatgtttaatagttatttaacgtttctcaaatatatacaggaaactggaattaacagaactcatttatggttgaaatcttgttttgcagaaaataaatcattacttctgggtcaagatggtagatagatgctttcatttgcctcacatctcttacaagactcccctgaaataacagtatagaagtacaaaaaataaatcagcaatagcaaatagaaaaaggtgaaatgtagcactaatatacaagagagttattaaatttctggaaaagctaaaacaaatgagaaccaatagttggatgaaatgaagaataagcagatgcctgttggtgaatacaaggaggctgcttgctagtgttatggaagccagtctgtccagggggaacccatgggagctctctgagcaaaaatgaaagagacagaaaacagaggaattcagtgtttatttaggggataactcagttacctggcattgccaaaccctttccaaccccttcccagtggcagtagtcagcaagtactatgccatcccctttctctagcattaacaaaggaaaaacaaggccggatgcggtggctcatgcctgtaatctcagcactttgggaggccgaggcgggcggatcacctgaggtcaggtggagaccagcctggccaacatggtgaaaccctgtctctactaaaaatgcaaaaattagccaggcgtggtggcaggtgcctataatcccagctacttgggaggctgaggcaggagaatcacttgaacccggaggtggaagttgcagtgagctaggattgtgccactgcactccagcctgggcgacagagtgagactcactctcaaaaaaaaaaaaaaagacaacccaaaggaaaaacaaaacataaaacagtgtttgtctccaaagaagttgatcagaatgtttggggaaatttaattttgtgtgtgtgttagatattggcacctcttcctttagtctcatatttagggggatggagagggagggcattctgcactttgctagtggcttacactaacacaaagcctgccagtgacatgctcttctctgtcttatactgagttcccattagaattttaattccaaagagagatgtaatcagaaagcaaattcacagaggaaactcatactagctaacaagtccttttacctgggttaccagtacgtgaggatcattagaagtcttagaggaacttttagcatgaaagagaccagaaaaaacaaaaagaaaacctgaacctaggggcaaaagataatgcaggaaacagaagagaactttaaaggaatcttctaactaaaatactcataaatactcatttataaaaccaatactaggtataatgaagagcaaacaattagagaatgcaaaaggagatttagaacattattgtcaatggaaagcacacagtagaaggatagccaaatagagttggagatgctcccaaaaagtagaggtttaattcaccaaaatggaaaatacaagacacaagtcatagactctgttcttagctagtgttctctagaaaacaacctgaaacaaaaaccttacccactaacactttattggggagtaccatctcaggaaagcaggagggaaagaagagtgagacaaggcagaaaggctggccctctctttgtaataggccttgctgattgcttggttttactggaagtcttcaggaaggttgtgtagagctattgcttctctgtcctttccatccaaagaaggtgtgaagaggtgtttatggtttcctcccatttcctgctcctcccccttttggtcaaagtttgccatacaaacagttaactcacttgaccccttccttcagcggcctcaggagaggaggccaggtcctacagtcctatgggtagatcaggtgtgtactgagtatgtgttgccaaagcttgggggtggtcagagcagtcagtaatccctaatggcagcctctggcctgggaacctctgccttttagggaactattaaaagaaggtcagtcctcaaaggactgacagagtgaaggataggatactactgctttttttttttttttttttttttttttttggagacggagtctcactctgtcccccaggctggagtgcagtggcgcaatctcggctcactgcaacgtccacctccacctcccaggttcaagcagttctcctgcctcagcctcccaagtagctgggattgcaggtgtcctccactacaccccactaatatttttagtagagacggggtttcgccatgttggccaggctggtctcgaactcctgacctcaggtgatccgcccaccttggcctcccaaagtgctgggattacaggtgtgagccaacacgcctggccaggctactgctgcttttaatcataagctcttcttacctatttgatttgctatcatgtgcatgtgttaatttgataaagataaaaaataaaatttaaaaagaaaaaatgaattaccaaaaacactctggaaataactatcaaagatattttagaatgcatttagaaaacagaatgaacttcaaatatgaaaaaatagaatctaattagtttatatcaggaacatcttggactgctagaattgatcctttctcctttcccactctttcttgctcactccttgttagcctacagtaccctggggttgaaatctagtagtcttcttctccttcatacccgttgccaggttctgccaagtctgcctttggattgtcattgctcaggccccccagtctatatctcgctgtggctattgtatgtagttcatagctttagtgtaagtcccttcaaagtttgtggtatccttctaatgaatctccttgtcttccctacctcatatcacctttgtttcctgatgctgagtgttggtcacttcctgtaccaccatatcatttttgttataacagaactttgtgtttgcttatatactctactgggttgaaacatcttttatttctttaataaatacttattgagagattttaaggcagccactgggatacaaagatgaattagatctggacaattacctgccttcaaagagttcatgttctgtaaagacaatacatatgtaagcaaataattgtaattgaatataagtaccataatagagttaagtattaggttggggagggtaggaggaaggaatgattttccccctttttgagtgaattagaaacctctagagaggagtagatgcccaaatacctattaaagattgtgtatgtattagcccaatgagtagaaaggagaaaagctttctaagcagaaagaatactatgtgcaaagaaactggaaggtgaaacagtacgtggtgttttcagcattcgacacacattagattaccacctgcaccaaaccctcttcatctcagctgaattatcagggtcgcctcccaacagggctccctgcctttgcctttgccgagtggtacatttaaaacctaattctgaccacatcacttctctgctcagaactctcagtggagtgtaaaagctaacctccctgcagtggctgtaagctttacaggatttctatcaacgtccctctttccccactgctacctttctcgcttcatctcctgccactctgttccatgcttactccagtctgatcacataggtctccaaggcctccatgttcctagttcttagaatgagctgcttgtatttttgcctgtgggactttgcatttgtgttccctttgtctggagtcttcttccatccagatacacgtatagcttgttgccttagtttctaaaaaattatgatcagtgttaccttgctagaccagccttagaaaatagaaattctctgtctctccagcccaataccccgataccctcctcttattttttctctgtagcataccatctgtttattgttttacttgccaatttattatttgtctcttcctactagaatgtaaactccataagggcagggactttgtctttttaatcatcgttgtttcatcagcagctagaacagaatatctgatgaatgatagatactcaataaatatttgatggcaagagttgaagctgaatagatgaagtgtgcaaggggcatgacttccatgcaaaggtatttggacttgagactgtaaacattggcagtctaggattttaagaagaagataaattaactatcagatttaggttttattttagaaagatcattctggcaggtgcttggagagttcattaggttgaggttaagttaaaataaagcagaactctttaaaaaccaaaaaaaatgttatttagatagcctaggtgagagcaatggctcatttttcttttaatttcccatagtacataatgtggactcccacatatagccttatatgtatcttaatagaatgattatttatattgtggtaaggtccctggcagagttggtaaagctattgagagaatggttcctatcttttttttatagacttatactgcagaagcaggtattcaattacctggttaattcaattaccaggcattttctaaagggcacttcctatatgctcatcatcacttcatttggtgaggaagctatgatgaagacgtttatgattcagtccctggttgacttagggactttacttgttaaatgattaaagaatatataagccaccatgtaaccatggttgtagacaaaatgtgttttgttctgggaaagggatagggaaaatttttctctgttactatatgtatatcatgtgaattttctattttaaagaggtagactacaacagaatacccaacaaaatttataaagcataattaaatattttgtaattcagaagacactctactactttgccagtgttttatttggaacctgagtgacatctatttctttgttttgttttttccttagagacatggtctctctctgttgctcaggatggagtacagtggtgtgatctaggctcactgcatcctcaaactcctgggctcaagtggtcctctcacctcagccccctgagtaggtagtactacaggtgcatgccaccacacctggctatttaaaaaaattttttttgtagagatagggtctcgctatgttgcccaggctggtcttgaactcctggcctcaagcagtcctcccaccccggccttccaaagtgctgggattacaggtgtgagcaatgccacctggcctatttttaaggctattccagtttagcatatggaagatgcaaacttaattgtccatgatgacaaaataataaattaatttagattgtagtgaaaagtttggttgagaaaaagaataattttccatggattgtgtaaatccattggaatagaatatttacattgaatagaacagacagttaactattaattgtaagggccttccatttccaaagaagcaggtagctgaaccagagtagttcttgctgtctgttgttgccagtggaagacatgattcatgaatgtttgaggttctaaatacttgtttaaggagaaatagaggaaagagcttttaagaggttggaaatattaagactattacagggtttgttgcttttcacctaatagactataggtttgaatgactttgttctgaaatatttattttcctgtttaaatattcattgctgtgagatttcaaaactcagcctcaagggaaagaccggactggcttttccctctgagtaattcagaagaggggtgtgtgtgtgtgtgtgtgtgtgtgtgtgtgtgtgttgacaagtgatttggaggcaagtttacaatattcttgttggccaagcctgtaactgcccttaaatttacatataccagcttgtgtcatttattggtattctaagcaaggatttatattgtattgcctggttttttaaaaatttattttattaattgtctgtttataagagctcaagattgtactggtcgtgttcctgaattccaacgcccccttacatgactgcagcacactcatcttttggtcctgattctttagttatacccacgctaaaagaaggatccattgtgaggcctacatttcagtagatttgcactttagaaaacaactagtgtttattctcttagctgcaggttccatataagaaggtaaccctctacttttaggaaacttacatttatagccactgttgccttcctctcatcatctatgctctctttttatttatttatttatttatttatttatttattttgagacaaagtcttactctgttgtccaggctggagtgcagtggcgcgatcttggctcactgcaacctctgcctccgatgttcaagtgattctcgtgcttcagcctcccaggtagctgggattacagacgtgcaccatcacacctggctgtttttgtatttttagtagagatggagtttcaccacgttggccaggctggtcttgaactcctgacctcatgtgatctgcatgcctcagcctcccaaggtgctggaattaccttgggagccatggggcctagcctctatgccctctttaatctcttaactgactctgttcttctaaaggtgtagatgcttcaggacatgtcctggaggcatgctgtaaccataattctctcccattttgccagccaaagcctctaagtcagtgtttctcagaatgtgggacccaaaccatctacaccagtaagtaccagggtcctgttccaacccactgaatcctaatctatggggaaaggatcttgacatgtgcatttttaaatatgttccctgaatgggtgttatacgcaataaaatatggtcatctttgctttcaaagaacaaggtaaaagatgagttggtaggtgtgaggagctgggttgtatggaagtagtttcttactgcatcttactgttgagactgaagcaggaatgggtgtgtctgaactccttacccgaaattagacatttttttcttaaactaatacttcaatggcgattggtttttattacagtaatccttattatataatcattgaatctgtttccatgagcttccttgggatcttggccattcagtaagttccagacaaccaagtgaaaagcgaactcttagaattcaacctgaaggtaaatatttggagactacatggagatttcattgtatagatttttcctctcaacatcacatttacctacaagttgcctaacatcttatggctctgagtgtagttcagatgtattgtaaaagagaaaatgtattacttttacctaacttaccagaaatgtattcaggattattagacacttaacacttttgtctgctctgggtgctcaaaattgtgaaactttcttgaggtgagaaaagcaaaacaattctaccctacagctctcctctaggttatggtagtttaaaaaaaaagttaagaacagttcaatagcttggttgtctttagacttaaaaacaaaacaaaacaaaacaaaaaacgagaatattttagatactgaaggaaggagatttgggatttaagtatttgtgtaagttaagaatctagagtaattttgctttaagtcttgcaaatgagcattgttttgtctttgtatgtgtttatctgatttatttatctggattttcctggtctgttcttctacagagttaatttttttaaaaaaacggatcctagatgattttaaatccagtgttgtcttcttatctttctgagagaacagttatatagctgttattttcctcttgtcacagacagctgggcagaagccactgcttttagtaccagatctgagaatgacaggcctttgcctaggtactctttttttttaaacaaaggcaaatagagtttgaaatctgagcccatctaagcaaatcccaagggatcaaaatgatataatttgtaaaaatacttaaaagtaaaaacattttatttgtattataatcctagaaaattaatttccatttataaatagcactagaaaaactattagtgacattgtcagtggtaataaactggtgagaatatgctctaccaaaataatgaagtgattcttttatgatggtgtgaataaaattaatattgatctgtttgtgtgcatgatccattctgaccatatatgtggtatgggaattgagaagcttttaggatttgcagcctgttgattagaagcaatacaatagcagtttatgtatataagtgggactcaaggtgaccaaactgagaaaattagaatgaagttgaggaataaatgagaagatataaacaaaaatacacccttctctctcaaagattacatagactttagttatcctagaaatatgaagacaattatattttgggtcatttctgtgttctcttacagtactgtgcataggttttaaataatattcagaataattcagtaggaacagaaaatatgctaaagaatcagtaacaaaacagtttcacctgctctctcaattaattttcacacccacctctgaagtaaacaacccatctggtaagtggtataattggaatttaaactcaagtctgacttttaggttcatgctttcttctgttttactacattccatgtaaactggggagaaggcacatggttggacctagaaaaaacactgaaagtcacctgtcggtaggtgatgattgaacctctgagattgctgtgggtaaggcaatagactgttgaatgggttcctgtttgacgactgtaatactatagttgtctgtccatagccacgggttctgcatctgtggattcaagtagctgcggattgaaaaattagggtgggaaattggatgactgtgtctgtactaaacatgtacagacattgtttctttttaggagacagggtctcccattgcccaggttggtctcaaactcctgagctcaagagatcctccctccttggcctcccaaagcattaggattacagctgtgagccactggcctgaccagactcttttttcttgacacttttttcttttcttttcttttttttttttttttttttttttttgagacagggttccactctgtcgcccaggctggaatgcagtgccataatcatagctcgccacagcctctatctcccaagctcaagtgatcctcttgtctcagcctcctgagcaactgggactacaggcacatgctaccatgcccagctaatttttaaaaattttttgtggagacaggatcccactatgttgcctaggttggtctcaaactcctgggctcaagtgatcctccctcctcagcctcccaaagatctggaattacaggcatgagccaccatgcagggccttgtcattattttctaaacactacagcataacaactatttacataacatttacattgtactaggtattataagtaatatagagatgatttaaagtacacaagaggatgtgtgtaagtaggttatatgcaaatactatgccattttatataaagggcttgagtatccaaggattttggcatctgtggtgggcgggggctgggaggttcctggaaccaattacctgcagatatgaagggacaactgtatgtttgaattcagaatgaaaacatttagcatatttcacattgtacaccaaaaggctgtatataatatgtatcgcctctgttactatctgtggtttaaaagagaaagacatcattctcaactcagaaattaatagttacatttgattttcactcacagctggtcaacaactcttaaagcctgtgtttgtaagacagaaggaaattaagtgcataaagcacaagcatgtaaatgttgattctttgctttcctaatgcttccccacttctactttcccatccctgcactccagtttgatatcaacccaagataccaacacttgtttcactctgtgttatcccttgttatgctctctagcccaacaaagcagtttgctgtaatgtgcacacacctgactttctatctcagtcttcctctatttcataaatgtttaacacttcatatttattatgtacgatgtgggattctacattgtacaggactgtctccacccatcataatgagccttttaatctaataggggagttaaaatacatatttacgtttgctaagtatgaggctttagatttcaatgtcttataggggatgcaagctaaatgttataagaatataggaaaggaaggaattacttttaactggaaacagaagaaagtttataaattgctaggttagggaaaagagctattctgtctagccttgtggactaaagagaaagctagtaatttcttttctcagatgagatatacttaagcagcttagcctctggtaatagaaacaaaacatttttatataagtatagaggtaaattcatacctagaaatactcatgtgaactgttatctcatagtttgctgaaggctgttgtacttctcttctgagcatagaactttggaatatggcctggaaatttaatacaaatctgaaaccatttgacatttttaataatgtatacttggggaaatattcagacattgcatgctatatgagagaaaatgttaaatcactcctatcccaatttcattcccttaatatataaacaattgttgttacatttttaacaaaaattttaaaagaaatttctgtaagtaacaaaataatccactaagaatttcttcttgacctcttaagggaggtacataacccctctaggaaaacagagcctctgcctggcttgcatttctgtaaaacgcctagtgcctaggctacaagtggattgcaggaaatgtttttacctttctccccatctcccactgctaattgatgtgtttattcagttatctgagtcagccctgttgagaataacgctgtgagagaattcatactgtgtacttgtgtgccagagtctcattcccagcaggctggggtggagaatggaggctggagtaaaacgaggaggctgaaaggagcagtgtcagagcaggagaaagtcgccttggccttgttaatcctaacttgaaaactctatcttttagcttttaccaattatttagtagaactttcttatggattcctgtgagattatatttatgcctgatgtgggcataagacctttggtgctcttattgtgtttcattcaccagtccacctgaattccaattcaattctttttcatgtctgtcttcaggccagtagattcagcgagggcttctgaagcagtatgtttcatatggctagagagagacagagagatagagcattgaataatttgaaggggaagggagataactattttatatctctcgtcagatgcccagaatagctataaagacatcataaaaactatcctaacctagaaataacgtaaagaagttatatggtgatgggtgacgaagatagactttttccaaaaaaatttaaagttttcataacatattttctaagaactaaagagaggggtttttttttttttctatcttttgagatggagtctcactcactctgttgcccgggctagagtttaatggcagcgatgtcagttcactgcaatgtcctcctcctgagttcaagcgattctcctgcctcagcttccaagatatctgagattaaaggcatttggcaccatgcttggctaatttttgtatttttaatagggatggagtttcaccatgttggccaggctggtattgaactcctgacctcaagtgatctgcccgcctcagcctcacaaggtgctgggattacagaagtgagccaccacacccagccttttttttttttttttttcccttaagagacgtggtctttctgttgcccaggctagggtgatgcaatcatggctcactgcagcctccagctcctgggctcaagcagtcctcctttctcagcctcacaagtagctgggactacacataccaccatgcccagctaattttttaaagtttttctagagacagggtctctttgtgttggccaggctgatcttgaactcctagccgcaggcagtcctcccatctcagcctcccaaagtgctgggattacaagggcatgaaccattatgtccaatagcaggaaaatttttatgtaaagcaatttatttttatttttattattaatttctgttacagaatcttcattcctgcctttaccagtttgcaagggctgccataagaaagtattacataacaatatagcaatgtattttcttaccattctggaggctagaagtgcaagatcagggtgtcagcagggttggtttcttctgatgtcttttttgttggcttgtagatggtcatgctctgtgtcttcacatgggcctccctctgtatgtgtctgtatccacattcccttttcttataaggacaccactccaattggattaaggcccaccctcatgacatcactttaattacctttttaaagaccttatctttaaaaacagtgacattttgaggtactgagggttagaacttcaacatacgggttggagactgagcacaactcagtctatgactctgccccttcccactgataactgtaatcagttcatcactttttatctagactgtggcagccccccacccccaattctctgccttttttctttcaccactattgtgtaaagcagtttttattaccaagtagaaatgattcttggacattggagacagctgaattttgaagttgtttaacttttaaatggaagagagttatgaatttttgtttcaaggtaggtcactaccattctcttaagagtaacacagtaattcagtgtttcagaatattggcttccccttattgatgatatattttttgtcattctctttagtattaaaaacaatatatttgtataggttttattacaaaagtaatatatgtttattattggggcacaaggaaacttttgggggttttggatatatgtgttgactatcttgattgtggtgatgatttcatgagaatataagtgcatatatcaaaacttaccaaattgtatactgtaaataaataagtgctgtttatcatatgacagttatatcataataaaactgcttaatttttttgctgatttgatgactaaagacttggacttactttgatgttaatgtgaattttcgtgacagttagtgaggttgagcatttttattagttgtttgtatttcattttcaatgaattgttcagatacacagtttgcctgtttttctcttgggatgtgtgtgtgtttgtgtgtacatgtgtgtctgtcttgtcaacttggttaacccactctgggactagtgataataacccagcatctctcttaccttttgctaatattttctcctagttgatttttcttttttgtttttcgtattttttagggacagagtctctctctgtggtataggctgtagtggcttgtggtccaaagtgggctctccacctacttttaatttaaaggaaagatttttgcccctttggcatctagtccacttaaatatggttgtgggcctgtctagtaactacacattaacaaaagtgagtgtgtgtgtgtgtgtgtgtgtgtgtgtgtgtgtgtctgtccacatacatatatctatgtgtgtatgtgtaataatattttctccaatcctggagcaataagcattccattttacctatgcagtgagagaatattcagagaattccatatactcactttaaaaatagttacgtaacaaggattcaaagtcactttttctttctcttgttgtttgttttagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacggtacgtggaccatgaggtgaaaaatggaaggatgcatggcaatcatatagaaattgtcgccttaattatacaattagaagactctcggaattaatttagcatttacacctgttctcatttacaccttctctcaacagcattgtatacattgtcctccctcctcctagaaatacttagtctcttggcttttcgagctctcccaattttcctgccaagcactgggtgttctgctcctgcctccttctctgttcaacttttaaatggtgcagtactccatatgtaggtcctggaaccccttttctttttattttatatcctttctctgcataattatactaccaaactcaagcaaaacctaggaatattctttctttctttctttcatctgtacatctaattgattagcaagtcttgacaaccataactctaaaactacttcgtcttcttctctacatcttattactcttccaccaaattgcttgtgtttgaatctcaatatggcccctactaaactgtgtgaccttggaccagttatttaatctctctgcccttggctcactctaaaatgaagataatagtacctacctgaagaggctgttaggaaatttaaaagaatttatcatcatcactgctctagtccaaacctcatcacttatttccggtattactgttgcctaacttatctatcctccacataggactaaggtggtttttttttttttttaatgcaaatgccgatttcctacttaactcttaatagttccctaatgcaattagaatataatctgaactccgtacttggtttactagtctctagccccagcttacctctttgacttcacctcttactactaacttgctaaagtaaaggaaatgtcataaattaataataggtatatatctcatacataccaacatatgggaaattgtattgtctcttgctttgttgtccaggctggagtgcagtggcatgaacatagctagctcactgcaacctcagtctcctgggctcaagtgatcctcctgcctcagcctcccatctagctgggactacaagcacacaccccacgcccagctcattttttaattttttttgtagagacagggtctccttttgttgttgtccaagcttattttgaactcctgtcactctatcctcctaccatggtctcccaaagtgctgggattagaggcatgagccaccatgcccagccttgtgtggtctatttctaaagatagaaatgttctacagtctgcatagaaagacctagctctgtcgttagatttctttttctctttcctatatctggttatgaaaaggagagctttactcagcctttaagccacttgctaaggatggatttaacccataaatgctttcaattttctttcatcaagtattgaaccaccaagaaattcctactttcgatgtttattagttatgtataagcacataattttatacttcagaaataattggctacaatagataatttaagagtctaggcttgataggtaacaaacgagactttcagtagcatttgttctagaatcataaacgtacaggctgatgtattgactgcatttccaaataactttttaatgatcatgaactcacagacctatcagaataactgtttcaattaaagaagtgaaaaagaagaaataaaatatatgtgaggattttccaaggtgttttaattaataaatttctatactaattatcagggtttttttttcatttttattctctgtttcttgttagtttgggtaatttgtgtctttttagcaatttgcttcatataaattgtcaattttgttggtataaagttattcataatttcatataatcgttttaatttttgtagggtctgtggtgatatccctgtttatattcttgatttggcaatttgtgtcttctctctttttttattggtcagtctagctaaggtttattaattttgcagatttttccaggaaaccaactttttttttcattgatttttgttgtttttctattttatttttcattagtttccactctgttattatttctttcttctacttgctttgggtttgatttggtctttattttgccagcctcttgagttgcaagcttaggtgattgattttagattttcttcctttttgtgtttaaaactgtaaacacagaaagtttccctttagctgcataccgtaaaatatgatctatattgtttttatttttttttcgttcgagacattttaaaaatttttcctgtggtttcttctttgctcctgggttgcataggagtatgttgtttcctttccaaatgtttggggatttcccccaaatttctttcttttattgatttataatttaatttctttggcgcttcacatgatctcaattttttttaatttattgagacttgttttatggtttactagacagtctttccaacaaaatattcttaaccaattggttttttcatcaatatgaaatgtccctctttgtctcttttactatttcttggcttatagttaaccaagaaatagtaaaactatttgtctgatattaatgtaatcacttcagccttctcatagttactgtttacatatttttttctgtcattttgtttcaactgctttgtatctgaagtatatctcttatttaacaaaatttaaaaaagaaagggccaggtggggtggctcacgcctgtaatcccaacactttgggaggccgaggcagctggatcatctgaggtcaggagtttcagaccagcctgaccaacatggtgaaaccctgtccttactaaaaatacaaaaattagccgggcgtggtggtgtgcgcctgtaatcccagctactcagaggctgaggtaggagaatcgcttgaactggggaggcggaggttgcagtgaactgagatcatgccactgcactccagcctggcccacagagtgagactccgtcccccactccccgaaaaaagtgcacagctagatcctgcttcttgcttcttcatccagtctgaaaatttctgtctttttattggagcatttggtcaatttgcatcttaatgtaattattaatgtaggtagatttatgtctgtcattttactgtctcatgccttttattgttcctttgttccttctttactgattcctgttaaataatttttgtaccttttacatccatttgtgatattttttctttagttattttttgtttgtgctggtgtttcttgtattttcttagtgctttctcaaggaattacatctttgacttatcacaacttattactaatggttgtgtgtgtgcacatgcatgtgtgtcttattctggttaaatatagcagcttaggtctaatatagcttcattccccacgcgcctttgtgctattgtcatacatattatacctgtatattttagatatataacaatacactattataattattactttaaacaatcttacgttgtttttttttttaagatctccttttttagagcagttttaggttcacagtaaactgagaagatagtacagacttatcccatatactttctgttcccacacatgcatggcctcccccactaacaacattgcacaccagagtggtacacctgttaccattgatgaacctgtattgatacatctttatcacctaaagtctgttagagtttactcttactggtgtacgttctgtgggtttggataaatgtatagcatatagccagcattatagcatcacaaaaagtaatttcactgtcctaaaaatcctctgtggtctgcttgtttatccctctctcctccccacaacccaacccctggcaaccactgatcttttaactatctgcatagtttttcctttttcaggatttcatgtagttgtaatcccacagtatgtagcttttttctgattggcttctttcacttagtaatatgcatttaagtttcctctgtgtcttttcaagtcctaatagttcatttctttttcagcactgaataataacccattggtctgtatgtaccacagtttgtttatccattgaccaatttaagggcatcttggttgcttccagattttggcagttatgaataaagctactgtaaacattcatatgcagggttttttgtggacttagttttgaacttcttggggtaaataccaagggccatgattgctggatcatatgataagagtatgtttaattttataagaaaccaccaaactacattccagagtggctctaccgttttgcatttccaccagcaatgaatgagagttcctgctgctccacatcctcgccagcatttggtgtctggattttggccattctaatagatatgtagttgtatctcattgttgttttagtttgcatttccctgatgacatatgacatggaatatccttccatgtggttatttgctatctttatatcttatttggtgaggtatctggtaaggtctttgtcttacttttttttttttttttttttttttgagacggagtctcgctctgtcgcccaggctggagtgcagtggcgcgatctcggctcactgcaagctccgcctcccgggttcacgccattctcctgcctcagcctcccgcatagctgggactacaggtgcccgccaccacgcccggctaattttttgtgttttttttagtagagacggggtttcactgtgttagccaggatggtctcgatctcctgacctcgtgatccgcccgcctcggcctcccaaagtgctgggattacaggcgtgagccaccgcgcccagcctttgtcttactttttaatcaggttgtttgttttcttattattagattttagaattctttgtatattttggataacagtccgttatcagataagtcttttccaagtattttctcccagtctgtggcttttttcagtttcttgacaggattcattttattttattttttgactatttttagtgatcttcatgtcttcctataggtccaagttattatgcagtgtcatttcctttcagtccaaaggacttcttttagtatttttttttaggcctgctggaaacaaatactgtttttgtttatctgggaatgttgtttttttatgtgttcagttttgaatgatagttttgttagctataggattcttggttgacagtttcttcctccaccccccagccctttaaatatgtcatcccatggaccactcccatgggagtcagctgattgtgatgagaagtcagctgttaaccctggtgttggtccccctgtaggtgatgagttgttcttctcttgctgatttcaagattttctgtttgtctttggctttgagccgtttctctatgatgtgtctaggagtggatctctttgtttttatcatacttgggttctcttgagattttgaaatatatattcatcaaatttgggatgtttttcaccataatttcttcaaatttttttttcctttcttctctcttcctgggcctctgattacacataattttcttttcccccgagatgaagtcttgctctgttgcccaggctggagtgcagtggtgcaatctcggctcagtacaacctctgcctcccaggttcgaccaattctcctgcctcagcctcccaagtagctgggattatgggcatgcaccaccatgcccagctcatttttgtatttttagtagagatggggtttcaccatgttggccaggctggtctcaaacacctgacctcatgatctgcctgcctcggcctcccaaagtgctgggattacaggcatgagccactgcgcccagccaacacataaattaaaatacttggtgttctcccataggggtttttgtttcttaaaaaaattcagtctgaacctaaacaaaatctgaagttctattcatttttcttggatcttttttccttctgttctttagattggataatttctggtggtctctttttcagttcactccttctttgttctgccatcccaaatctgctgttgagcccatctagtgattttttttctttcagttattatacttttcaactctggaatttccatttacatttttctactgagatttcttctcatatttttctttaatttttattattattttttgagatagggtctcactttgtcacccaggctggagtgcagaggtgtaatcacagctcactgcagccttgacctgctgggcgcaagtgatcttcctgcctcagcctcctgagtagctggtactacaggcacatgcaaccaaacccagctaatttttgtatttttttgtagaggcagggtctcgctatgttacccaggctagtcttgaactcctgggctcaaggagttctctcgcctcagctgcctaacatgctgggattacaggtgtgagacaccatgcccagccttaattttaaaaatatatttgtatttactgctttaacgttgtctgctaaatccaacatctgggccttagtctgtttctagttactgcttattttcttgaatctgggtcacttttctgtttctttgcatgcttgtaattttttaatgaaaattggacattttagtaatgcattgtagtgactgtggggtgttatttatttttctgtgatgggcatgtgtgtgtgtgtgtgtgtgtgtgtgtgtgtgttttaagtaatttgcccatacttaaactatgacatgtgactcccacacagtatacggccactagtgtttctgcttattgattttcatttgttgttttattgtttttagcctggctaggaggcacccgtgtcttcctagcttaatggttagcctgtgactagtgcagaggtggtgttcaaacacctgaagcttattgagctttcaccctctgatgatccaggttgattgggaagtgcatggaaagttcagccagttcttaagcctgccttgggttttctttctgttgagacctcttatgtctcccttcctcatccatgtagtttcacagccacccagggatgtgaggagaccatatctggcccttttgtgactcttttctttccaggatctccccttcagatttctagctggtcttccactgcaccctcttcagaccacagcctcaagctagaagaatgtcttctccctgttaggttcccaccaggttggccccttttagctgtcagagctatggattttctaccactccttcaatctcccccttgtcccaagtcagatctgccctctctggcagtgaaaattgctggtttttatggtcccagccctcacctgataaaactaagttttaaggcattaagtttgtgtctggatgctcttgcccctaagtttaagcaatttctcaggacatctatttattgtctgtctgccattgattgatttctagaatcctgaaatggctgtttttgacaactttgtccaactttcttactgtcatttccttttgaggaaacagttcactgacctgttcataccatcatagccagaagtctcttccctgaatcattgcatggcatttttaaattacttactacatatctcctcatcattgcccatttctgtttctcttttttcctttattgctaccattttcagttgtttcagatctccagttgtatatttctaatgacagtgattaagggcaagttctgttccttaatgtaaatatacatatatttacattatatatatagttaagacttgcattcctcatttataccagaaactgttcaccatgaaattttgtatgtcaaccaatttgagttcctaaagagataacccatatgtatagagtataagtttatcgctgccaaaaatagatgaagagaaaatggaaaatcctttgatttgtgcctgtgaacagagatagcacaagttctataatttcaggaagctgttaacaataaaatgagaaatttttaggatgctctggttgaaagatgctttttttttaagtgtacattttattttatttgatcttatttttgagaccgagtctcactgtgtcacccaggctggagtgcagtggcgtgatctcagctcactgcaacctcagcctcccaggttcaagcgattctcctgccttagcctcccgagtagctagggttacaggtgtctgccactatgcccagctaatttctgtatttttagtagagacgaggtttcaccatgttggccaggttggtctcgaactcctgacctcaagtgatccacccacctcagcctcccaaagtgctgggattgcaggtgtgagtcactctgcctggcccaaaagtgtacattttaaatgtgagggtgaattcactgctcataagccatttatttacttttggcggggggagggagagagagagagagagagagtgtgtgtgtgtgtgtgtgtatgtgttgtatatagagagtttgaacagttgagcaatacattgtaaaacctagatttgacaatatttaggttattttattaaacttactatctgcctatatgtctcttaaaatggtctatccagtttgattactcatcaattaaaaacaatggtctagtaattcatgtggccaattaaatctaaaagttagacaggaagcgttgttatttacagatttattaatgatacctcaaatttgtatctcacttttcagtttaaaaattgctttcacaaacaatattttattatggtttataaaatatccctttgggatatattagagtttttacagatggggaattctaagtccgtaatcttcgttctaccactccgactccccatattcaacgtagtgaaagaagatggtgtactgtgtatattcactagtcctcttagcaagcacttagtatcttttcccactcagtttaagtcttatctctgctgaaaagccttcctggacttttctaggcaaagccaaattcgtgtgtccttcatttaggctcaagtagaaccgtaagctgactgctgtttatgtaacatataaattgtgatttttaaattgacttttgtcttcctaagttttaaacttttaaagaaaaagtcatttttcatctttgcattccctgacttgtcacagtgcctgacacttaatagaactcagtaaatgcttcttgggggaaaaaaaaaaaactaggtacaattgtattatggcagttctgaggagagagaagctgaggcgtcttggtgaatacagcattgatctgggccttgtattaatggtaattagaattcgagtaagcatagatggtagtgggaagagttaagaacgtcagttctcaatacaaagttgaagtgatgagaaggatcaaaatgcctcgggataaaagcataggtttctacttgattgaagctttaggtgtttggcagagactagtgggaaataaggtggaataagtgtcagttgagtataaattgggaagagtatttgaatgccaggctgagaaatatggactttattaaagattttgagcaagtaaatgaagtgagcagaattgtgctcggagaagattgatctgtcacagcgtatgcagggtgaatagaggagcaggcagacgattaggaaacagtcttaagtggttatgtagagggggaatgaattcaggagacattatgaaggtagaatatagaggatttgacagctggttggatgagtaagataagaggtagcacaaagattgtgccatccttattgtaataattgtcttgaataaatcattttacctccaatttcagtttcctcatctatcaaatgaagtttatacttgacctgactgtacagggttgtagtgagaataaattaagaaatgctttggaaattacttgtttaaatagttacctaattaccttttttggggggtgggggaagggggtctttgaggtagggtctcactctgtcacccaggctggagtgcagtggcatggtctcagctcattgcagcctctgcctcccaggctcagatggtcctcctgcctcagccgccacgagtagctgggactacaggcgtgtacccccacacccggctaattttttttttattatttgtagagacagggtctccctgtgtcttgctctggctggtctggaactactgggctcaagcaattctcccacctcagcatcccagagtgctgggattacagaagtgagccaccacatccagccgaagtaattatttttaaccatcataagtcttttaagatcagttgtccctatttgtactgtttgttgctgtgagctacagctccatttaagtatatttcgcttatgttggatggtcttagattgttggagagaacaaaaagaaaagaacttgtacaaaaatgagaactgagcattaaaatctgaaatttttatttttaaaatgtgttttagaaatcgattttaaccttgggctagaagcttctgctcttaagatgagagcttattttgatagtcagttggtcccatactgtgcattagcaaaagaggtaagcagttaggggtctaccacctgggcctgcagacacttgatcatctctgggcctgcctgcagagaaaaaaggacctcagttcctgtatctttagatacttttctaaatggcagtgggtataaataaccaaagaatttgaagtagacaagctttagtgaatactcttcagatatgatgtttatatttgtgtacatattctaactacctgttggattgtattattcttaagggtaggaaataattctctctctgtttctgtcacctctattggtatattatggatacaaacacttactagcaagtgctttctagtggtggggaaggcttatagttgttctaaaggcgtataggtggtctaaggtgttagacatacgctattaaaaatactgagttaatacatcagtttaggtaacagaattcatttctccaacattcttccgtataatgtaaatacttttctttttcttagtttgatgtaattagaatcatttacttaggagacatagcatgttattgagtctttcacttaaatataaggttttcctaactggataattaggaaaataaaatacatttatttccccttatacactcttcaaacataatttagagctaccttcttttaaatcaaaatatcagtccttaaataattttttgaaatacatatataggggcaataactacttaatagtaacaacaaaactaatatatttgagtgcctactttgtaccagatattgtttgaagcactttttatgtgttaactccattgagttaccatagccgccatgtgaaataggtatcgttattactcctcttttacagatgaagaaattgaggcttagagagattcaagattacttgtccaagatcacacaactaataaatgtcagtgtgaggatttaaatacaggttatctggccccaagagcctgcattatttcccataaattatattgaacaactgttttatatatacttgtcatgtgcacattactgtgctaggcactaggtgttcttaaaaaggtaaaataaagcccctgccctcaatgaacctatagaagttccagtagaaaaacagtacaggcctggtgcagtggctcatgcctgtaatcccagcactttgggaggccgaggcaggtggatcacctgaggctgggagttcaagaccagcctaaccaacatggtgaaaccctgcctctactaaaaatacaaaattagccaggcgtggtggtgcatgcctgtaatcccagctacttgggaggctgaggcaggagaatcgcttaaactcgggaggcagaggttgcagtgagtcaaaatcgtgccattgtactccagcctgggcaacaagagggaaactcagtctcaaaaaaacaagaaaagaaaaacaaagtacagataagtgctagaaagagagtaatgaagcgggttcattaagagatgcttttagaaggtaggtactacttctcctaaacagtgaacccatagcctgcagtgaagtagaggacattgcaggcagggacaatcctttgcagcagtaattttccctgtgtggtccacagatcactggcagttccctaaattttttcagagtctgggtcgagggagctatgaagtcaatgcaaggtattattttcatagtaataccaatacattcttgctgttttcactatatttgctttgacggtcagtacagaagcaatggtgggtaaaactgctagcaccttagcatgaatcaaggccgtggcaccaaactgtgctgctggcagccatcatattcttcactgtcacagactcacaggaaaacaaaaaaatcacgttcacttaagaatgtccttgatgaagcagtaaaaagtattaattttattaatttcccacattagtatatgatatttttcatattctacatggcaaagtgaaaagtattcataaagcacttgtgttacataccaaaatattttcattgtttcaaggaaaagtactgtgtgattgagttgcaagctgaactagctgcttttttcatggagcaccatttttttcttgtaagaacaattaatggacaaaccataatattcagttttatgcatctggcactcaaatatattagttttgttgttactattaagtagttattgcccctatatatgtatttcaaaaaattatttaaggactgatattttgatttaaaagaaggtagctctaaattatgtttgaagagtgtataaggggaaataaatgtattttattttcctaattatccagttaggaaaaccttatatttaagtgaaagactcaataacatgctatgtctcctaagtaaatgattctaattacatcaaactaagaaaaagaaagaaagtatttacattatacaccattttcttgaaaatgaagtgggcctgccacttcaagggaagaaactgacactatttttttccattggtaaaatgtaagctctcctggtagaaattagaattttgaaaaatttgtgtcctccactatgagctcgacagtttctcagtacttaaagattttttctgatgagatccgtgatgatagtaacaaatgtggtcttgtataatgcaatgtcctcacatttgaaagagctccgtaactcagtaagccgatattttacaaataatgactgaggtttaatgttacaaaatcatgagtaaaagattcatgcaaagtgcatgattgtccagtggattttagtgtaataacatatgaaaagttcactgataaggtttcagattcgacattgcagttaacttttaagaaagtaccacttgtcaagttttgatgtattatcaaagaagactccacagttttctgagaaggctattgaaatacttttcccttttctagctatctgtgaggccagatttttctttgtatacttaagttaaaataacatactgtaatagtaaatccatacattaaaaggagtgccagtcttctaagtaaatttattacgttttggaaaatgtagttaattttctttaaaatatgttatttacattaacacataattggcttattatttaaaattaatttttaaatactttaaaaatttatcagcttcaatttctaatgccataaataacaatggatattacctaaagaaacaaaaagctctctgaatcctcagtcatgtttaagagttaaaagggtttcccacatggaggtggggatgtaaatagaagattcttttctttgtaggccaggcacagtggatcatacctgtaatctcagcacttagggaggctgaggtgggaggatcacttgagtccaggagttagagactagcctgggtaacaaggcaagaccccattgctaaacattaaaaaataaaaattaagaagtttttttaagttgacaagattgtatgtatttatactgttgtacagcatgatgttttgcttacagtatctttagttggaacagaaggctctcttctgaagcaataatgctcaataagagaggctgataaagctaaattatagaggactttgaattcaaggccaaagaatttggaattttatactctaaagagctaagcatcctttgaaatatttgttggtgagttgaaagtagagatttgagcaaatagctgagtggcccactttattactatattagtcagctgtagattttataaccctcctcactggaaagcccctgttgaccattatgctcagaggattttttttttttttttttttttttttgcttttctacacaccccttctctggagtttaagccaatttttctttcacttctctattatcaattggtattgcccattgacttctttatctgataacagttgaaggtgccttgcagattagtgatgcactaaaacgtagccaagaaggtatagcccttaacagtgggatcatttgcccaaatgagtatttctagaacataatgggaagaaggggggccacagtctatcatactatgtattgttgggctatattaccttcagcccacagtgtaggtgtcattagcatgttctgtttccaggctagatgtagaggtcttggactacggaggaatttattcattcagccatccacttttccaagagtggctcttatttttccctcaaagtaataaaaggcagggtacattgagcctacataaaatatatatatcctgtatcaatttacccttaaaaataattacatctgtcctttagctccaaaattttgatgtctatgagtagtttggcagtttccaagctggatccataaggaagctatcacctggtttgagaatgtgagagttgccacagaaaaccaaatttagaattatgcatgggtatttttgaatagagaaaattgccctttggatcatataagactcaagacatcctttcagcacatgttaatattgctaactccatgactgttgcttcttctctttgcatgccttggtttatttacttacctacttactcctaatgcccaagggaaactaaactaaaaaattgctaggcgcgttaatgctgtgctccgctgccccttactgctctcacagcttagggcaaggatgatgaagtagtaaggattatttaggggcaatttttttaacctgtttacatttttcataaatactttatactacctcttgaaaatgagtaaactctgatcagaactgatgaagtttaaagctaaaaaacttttttttttttttgagacagagtcttactctgttacccaggctggagtgcagtggcgtgatctcggctcactgtaagttccgcctcccgggttcacgccattctcttgcctcagcctcctgagtagctgggaccacaggtgcccaccaccacgcctggctaattttttgtatttttagtagagactgggtttcaccatgttagccaggatggtcccgatctcctgaccttgtgatccacctgcctcagcctcccaaagtgctgggattacaggtgtgagccaccgcgcacggcctaaaaagcatttttaaaagcatcttcttttacagctgaggtcagtggtgttaagtgatttgagcaagttacagctagctggttacagagctgggccttaggaagtctgctgtcagtcaagtgcttttttcctgcttctccatgcaaatggtgatttaaaaaaaaaaagacatccatagagagtcttaaccatcttagcttctacttactcttcaacttttaacctaggactctagcttgagcatactaacaaatttctttcattctaaatgaacgttaaaataatcactcaggtataaagttttaaaaaattgaggtgatattctgtgtgcatgtcactatttatatgttacatataattttatacaattcttactcctgtttaaaaaaatgacttgctgtggtttttgtttcacagcgtgacactgataatcagtacatgatcatgttacatatacaaatgatgcctttcataattcctttttgtggcactttgacactctgagaaaatggaatcacatattttcagaagaaatggaattactcgtttattaaaaaaagttagcttacatttgaatgcccaaacaggattagactctcagaattcagcttgtcataacagtgttcaaatgcacagaagaaatgtttaagcatttctctttaaaataaatctaaaagtaattattcttaaatagggagttgctctaagtaaatgtaaattcacttttctgtgtctaaaaaattgttttggtggtgatatttgataaaataattttatattcaattgattataattgtcttatatattattttagcaccatgaagtacattgatttttcagtagctaagcatgtgggctaagattttacttttttgaaaaatattttatcatgttattgcgtttgtactctgtgagaaggaatgcatatgatctaattccaccaagttttaacccatcaggaactccatcgtaaacatttttattcattgatttatttatttttgagacagagtttcattcttgttgcccatgctagagtgtgatggcgtggtttcagctcactgcaatctctgccccccgggttcaagcgattctcctgcctcagcctccaagtagctggaattacaggcgcctgccaccacacctggctaatttctttctatttttagtagagatggggtttcaccacgttggccaggctggtctcgaactcctgacctcaggtgatccacccgccttggcctcccaaagtgctgggattacaggcgtgagccattgcacccggccccattagaaacattttcaaaatgcttagctaggcatggtggcatgcacctgtaatcccagcaacctgggaagcttaggcctgtaaatctcttgagcccaggagtttgagaccagcctgggcaacattgggagaccctgtctccaagaaaattaaaacaaaagtactttaagtgctaacaaatctggttgatgttctaacatggattgtagttcttgttttttgagatactatgcaatggcataatgaaaagtatcctggccaactttgtaaaatattgtaaggaaaaactgaaaattttaaagtgtttttatttttttaaaaaggctatattgtgtttagggagtgtgagcctgtaaatcaggttgcgctggttcagctctcagctccttctgttgactgaatgtgtaaccatgagagaattagaactccaatgctcattttccttatctgtaaaaatgatgataatagttccttccgcctacggttgtttgcaagattagatgagaaaatgaatatcaaatacttagtaggctatgatgtttccatttcaattcgttgaatattaaatatgtcataatcttattttattcaaatttaaatcatttagatttgaaatctgatataaaaagttaataatgtttcacttttgtgcaaattttgattcagtgtgaatctctgcaaatgaaaattttgttaatagttgcctaatttctttttctttttcttttcttttcttttcttttcttttcttttctttttttttttttttttttgagacggagtttcattctgtcacccaggctggactgcagtggcataatctcggctcactgcaacctccacctcccggttcaagcaattctcgtgccaaagcttcccaagtagctgggattacaggtgcccactgccacgcctacctaatttttgtatttttagtagagacagagtttcaccatgttggccaggctggtctcaaactcctaacctcaagtgatccacctgcctcagcctcctaaagtgctgggattacaggtgtgagcctccacacccagcaatagttgcctaatttgaaagctatttgaattgcatggtaattcacatggcagatgtactttgagcagttaatagaaatatctactgacctttgataggcttattcttgaatgacacatttttcagaactatgtcccttacactaaatgttgacttcataatactgtgaaaattacctatttgagtctatggaaagtattcatttacataccttatctgaagatcaccaccccctcccattcgaaataaatggagcccaaccaggagtgattgatatttttgttcttaaaactgtaatgtcttcagagagagtgcagtaggagatgaagctttatatgattggttttttgtatgtaaaataatgagagttacaagttaaactgtttctaattgtgaaatggattaatagtaatgttagatttaaatgtgggtttttttcttcatcaaaccaataatttgaaatgaatgtactttcagtctctttctaagtttcataagagttccaatcacattttgaatacaaaacataaatatttgtttacactcgtgcctgtatataatcattaaaccagttaaacatttttagtgttttaatatttaagggtttagaacctgacatcctaaaatattttcttcttttttttttttttgagacagagtttttgctctgttgcccaggctggagtgcaatggtgcgatctcggctcactgcaacctccatctcctgggttcaagtgattctcctgcctcagtctcccaagtagctgggattacaagcacccgccaccacgcctggctaatttttgtatttttagtggagacgaggtttcaccatgttggccaggctggtctcgaactcttgacctcaggtaatccacccacctcggcctcccaaagtgctaggattacaggcatgagccactgcgccaggcctacttttttcttttttaaaacttgtaattttttttctagcttgcttgtttccttgcttgctttttttgtgtgtgtgtgtgtttgttttttgttttgagacagggtcttgccttgtcgcccaggcaggagtgcagtgatatgatcatagctcactgcagccttgacctctcatgctcaattgatcctcccacctcagcctcccaagtagctgggagtacaggcttacgccatcattcctggctaatttttgtattttttgtagagatagggtttcaccagggttgttcaggctggtctcgaactcctgggcctcctagagtgctggaattaaagccagcctgggtgtgagccattgcacccagccaaaacttttaattatgaaattattttagattcacagtaaatttgcaaaaatatgcagaagatttctgcatacccttcacccagttcccctaatgttagcatcttacatagctatagtagaatgtttgaaactaggcaataagaaatactgaatactgatatagtgctattaggtaaaatataggccttattttaaatttcattttttccagtaatgtctttttctctattctgaatcccatactgtagttagttgccatgtctccttatcacaaatattttaataatcctcaccttatatctgaggtacttctaggctctaaagaacagaaaaaggaaaaaattttgtatttatggacttgccattagatgataaccacatctcatttcctacttcatctgcttattctcccttaaccttttgtgtttgcattggagaatgactataacgtaggcccttcttcacttgaaatataaaagttattttgaaagcaagcaatgtttcctagaatatacatgtcagctcaaaacaagcataggctatgttgccctattttgctgccttgattaaaacatgtacacacagtactataagattttattaaatagttactattagatccagttttgaatacatgagattaattttacttacaccacaaaaatttcaaaagttcagaaactggtgacatcagttagaagattggaagacttttttgaagaacctgacttgctcaagaagacttaaagaacaaattgcttacctaacaacttagaatgaaggaatcacaaagtcccccaagcctccactccacccactcagacttcccaaattttttagctacctgccacctaccccctcaactcttaagtcctgaatagacaaccaatgattactaggtaccaggaaagcccacaacttggaagatagataacaaaaagaaaccaaaacaacaaccaccaccaccacgttacagggagtaggacctttcccccacaattacatttatatgctcagagagagaagaaattgtattaacaggaatgaaatgctagtttgggggatgggggttgagtttcagaaaaggaaaatgagtccttgaaattaaaaacatggcaacaaaatgaaaaactttatctggctgacttgaagatgaaactgaaaaaataaaggtctacatctttttctttttttttgagatggagtcttgctctgtggcctaggctagagtgcaatggtgcgatctcagctcattgcaacctctgcctcctgggttcaagcaattctcctgcttcagcctcccaggtagctgggattacaggcgcgcaccaccacgcccaactaatttttctatttttagtagaaacagggtttcaccatgctggccaggctggtcttgaactcgtgacctcaggtgatccacccacctcagcctcccaaagtgctgggattacaggtgtgagccgctctacctggcctacggtctcttatccacaattccaaaatcccaaaagttctgaaaattatatttttcataagtttacaacacaacctatttctatcctttatagattttgctaaagaaatatcactgtctcagatctcattgtatgtgggtgggatgaggggtgggtattacattatgggttatattctatattaactttctaaaattctaaaaattctgataagcatttggccgcaaaggtttcagataagagattaaggacctatatcccagaaaaatggagcaaaaaggcagagatgggaaatacaagagaagagatgtgaaaattagaggaccggtccagaagatccaataatacagcttcccgaaagaaaatgtgtagcgtgagaatcatcacccgataacacaagaaaacttccaggactgaggacattaattttcatcttgaaagagaccacagaattctccacaaagtaggtgaaaatgaaacaagtccacactgaggcatataactatggacactgttttagaacatcaggtgtatttggatagtcctacaagctgcaagagagaagaaaaaagtcacatacaaggagatgggaatcatgccttcagatttctcagcagcaaggctaaaagctagaagacaattgagagttatcttcaaaattctgaagggatttttttttccaacctataattctgtgaccagccaaactatcattaaactgggatggttaaatagatattttcagccatgaatcagattctcaaaaaatttactgtgctaaactgaatttcctattttgctttttttctctgttagcctcaaagagatgaaaataagaaatgaagacttctattgggggacgggggggaagaggaaaaataaatattgaagaaagtggataatccataaatcaaaatatttctgaattcattaagagattccttagtatctatatcagagtcgtatgtgtttaatcttaatctgatagacttggaaagttatacttaatcttgtgtcactcagaattccctttagattatgacagaacatttgttgacaatgtatagttaaaatatttccattgtatcatagaagagtcagaaaaatcaatcaatttcctagttagaagtattttaaaaatttgaagtcatcaaaaaaagaaaacatttgtagtcctcatttctaggatgagattctgagacttaaaattctagtttgctattaagtgtaattggtgccgacctcctgtgcagtgttgatggctagctcagctgcaccagggaagatgagttgtttgaagggtagatgtataggttttagccatatgattgcatcaggccagcactgccgctagtcctcactctaaactgtcggtgaacggactccatccagcctcttctgttttatgccttgcccagtggatacgttaggtcggataatgaccacaaaagggaaaaccacaaccttggaaagttgtttatatggtcagtaaaggtgctcagcagctagcaagagaaaataatgcagaccagtgctgttgtagactgagatttttcttagatcaattttaactgtccacttttcacaaagataagacttaaaaacttttatttccctttttctctctgatttatatatttcagcaattagtagtctgtattgggataaatttaaagtgagaatgtcccagttgtgagataagatctcatttaagtacgttaatatagtatgaccaatattttctattcctatttctactctgtacagaaaaccacttttaagtccctgtatcagtttagtagttctttggcttttttcctaattaaatgtcagcatccctttgctggttttcttttctctccctttcctttccctttctctgcatagcctgacctatttctctttcctcaaggtatagaacctagccaggcacagtggctcatgcctataattctagcactttgggaggctgaggcaggcagatcgcttgagctcaggagttcaaaccagcctggcaacatggcaaaaccccatttctacaaaaaatataaaaattagtcatgtgtagtggctcgcacctgtagtcccagctatttgggaggctaaggcaggaggatcagttgaacccagaaggtggaggttgcagcgagctgagattgccacactgcactccagcctgggcgacagagggagacccttactcaaaaaaatttaaaaaggtatagaacccatgtcacctctagtgtagccttccgtgtctcttacccatgcctgtctccactcccggagactcttgctgcatgagatgagagtcctaagaaggtaagagaggggtggggttcgtatgggttctcgtttctaatgagaagaagagaggatgggtacagtgctagaaaggaagtgatttcacatatgaaattgggctgcctagttttgaattcctagtctgctgcttactgtgtgaccttggacaactaactgaacatctctgcacttagcatcttcctctgtcagttggagataatggtagtacctgtttcacagagttattgtgagggttaaagaaaataatatatgtaaagtacaatataatggctaagaacatgcactccaggccaggcgctgtggctcacgcctgtaatcccagcactttgggaggcctagagttagaagtcaggatcctcgtgaccctttgccaggggaaccgtgactggtgggggccccccagggtgcttctggtatcttgtttcttgatctaatttggtggttacatgggtgtacgtttcattgtgaatattcagctctatgcttataatttatgtatttttatctatgtatgttaaacttcaatttaaaaattgcattagatcagaagtcttgagaatttaggaaatgataggtcacttttttctacatggcagatcgacttagaattaaagatttcatacttaaaaacaagggggacgggtgttcactacaagctgcaaaattaaccagtcttgcttctgatcttaaattgtgtcttcagagaagcaaagaactatgaagagctacagataagcaccttgggcaacatactttgaagtaatcattagttttcatttatcctgccacttcacatacactgtgacagattacatgggctacatataaagttatatgtaaaagtgtaatttggagtttgtggaatcagtctttttaactttcctcagagtgatacattgtcatcttgcagaccagatctggtggttttaaagtttgattgaagataaagtttcatgtgatccaactgtgagatgttaagaggcaagtttgaaggtgcttgaatgagcattagttgtaattgatgcttgttgctttgactgcgtgttggtttgcttgatgctgttttagtaacttagtgagtttcatctttaaatgggatttgtgttacttagtctgcattgtgccaagactgataattgaaaaccgtacactttcacagaacattgcttcatagctcttcccttttctgctatttttatatcacatgaatcattgcacatttaagccatctgcaaggcctgaatggaatgagataaaaagctgccatcacttaaattgacacttgaaaagctgttattcatttggagtttattcctgattatcctttatattttaaagtttcaaacttcatttcaagatggttgccaacatctctgagccagaagtatctctgattcacagcttcttttagcctgaaagtcaaagggaggggatgcatcctgtcacctagaagaatctgttggggactcacttctatctcatttgagagaataagaacagcaagttccactcctgttttaaaagtatgttggtttaatcagctcagcaagccatcgggtttggcatgcacttcatagggaatagtaaaaacacaaggctcttcgattgccagatgaatacttcaaaattgcatgcctagaatgtgtcacacctgttagatacttatcaaaaattttctcaacataacttttttgaggatttagtgaaaaaaataattagataaatgcatgctgggatgttgcaaaagagattcatgattaaaaatgcatattcagccgggtgtgatggtgcgtacctgtagtgccagccattcgggaggctgaggtgggaggatcacttgaacccaggaggttgaggctgcagtgagttttgatctcgctattatacttcagcctgggggacagagtgagacactgtctcaattgaaaaaaataataataaaataaaaataaataaatgcatgtccaccctttgcaagaggcctggagtgggatcgcgccctctgtggagtgggtcgccacctctgtcacggtcctcaaaccctgccaccgccctggcctaggagcctgccccaccgcagcggccggcaacgcagcaatctgccggcggtggtcgcggcccccgggccctctcacggcaaccagctgcgggcctcccggggcaaaagcccatgggccaccaccatggccctcaagatggtgaagggcatcatcgactgcatgttcgacaagaacctgcaggacttggtccgcggcttctaaaaccacaaggaggatgagattgaagaagaatggggatagtgaccaccaagcatctgtcttcattgaaggatgcccatgcagcccttgggcagtggaagccttagaaagtcttctacctgaatgactgcctgactgcctgcctgcctccctgcgtggacagcaaaggctggcctgaaggagagcagctgtctgataccgcaccactcccaataccagaggctatgtcgggcatgaggtgccaggagggcagggaggttaaggaatttgcctgcaggcacccagtcaccctcagcccatgtgcctctccgtgggaacctgagttcttgccttattgttacacttttccagaagtggtgtgacttcgcctgcctctggcctaatgagatcatttttgttcatctccatcccctttcccttggttttcagcatatcagaagctctccctaactgctttggtgacaatgtgtaactaacttatgtactcttcagattcttttgagttgaaggcatagctgattggcctggattttattttactgagcgtgattcaccagattggaaatgtggtttgcttcctgggaggactttttctgcacaggcaggatctcccagtgcccgtccctgcccgcttcagcgcatgtcactgagcagcctgttctggcatcctgaggacgggccacggggtctgtccagcagaggaccatgcattgtagtctagggtgtggttttcaggggggtgtgcctgtcttcactgggaagcccctgagcctggatttcttcctttggaattggtgtgagttgatagtgccttccttacaggcatgggcccattcaagcgggtattggtggtggaaacatttttagagtagtgtggggccgtccttgaaagttccaggcttccttgtgggccctgctattggccaatcagtgattccatgcaggacacgtggtgtctgggggccctggctttctcatcagaagaccatctttatggcccggaaggtcattattcaggtgttcacttctgattccggatgttctctgcagctgctggagtttcctgattggagaacagcaaatgactgttcaatgaccattctagtggtcaccccctccacgctgtgcccccccaaactcgcttttgaaaagcagctaccctgtagacctcatgttgtaggtttttcccacccaccacacccaaaatgcagactcttggcgtgtgctttttctgcagcagtatagtttcaaaaaaaagtttttattttgtaatatattttcacttaaaacttgagtgtggcatcatggaaacaaggcttagcaatgattttaaaagccacgtggaaaggcagcgtgattgagtggaaatcagatgaagtttgggagatctgagtccaggtgctccgactggcttaatggggtggcccacggagagctccctgttctgtctcctcctgtgtaacatgggaacatgggatgagttgcctccctccttgtggaatggtgctgaggatgctgcagcaaaaacgtggttttctggaagcaccagagtgctcaaagaggttgtttagttcactgttttccggtcctcaggctgtgacctcttagtgggttgtaaattcaatttaccgggttatggtagttaagaaaaaggaaaacaaactagaaaataacagagtgcaggcacatacagtagctgtcctgtcttgaaactttgatttctgcatgtgattcttgtgtgcatgtgtgagcgtattgggttaccatgcacaacccattaaaatgagtgcaaaaagtaaaaaattaaaaaataaataaataaataaatgcatacccacactcatttatactctttaactgtgggtatgtgcaaatcttgcatttttatgctaattagcagatgagtcagggtctctaaagccttttccaacagttagattctctcaatgcagtttgctctgggctgcagaaggttgggttcccctgtactaaagttagctggaattgcataagttagggaggagagtacagatttgtttcagagtaagaagcttcttggccaggcacggtggctcacgcctgtaatcccaacactttggaaggccaaggcgggcggatcacaaggtcaggagatcaagaccatcctagctaacagggtgaaaccccgtctctaccaaaaatacaaaaaattagacgggcgtggtggcaggcacctatcgtcccagctactcgggaggctgaggcaggagaatggcgtgaacccgggaagtggagcttgcagtgacccgagattgcaccactgcactcgagcctgggcgacagagcgagactctgtctccaaaaaaaagaagcttcttcagttgttgctaggtctttcctcttcataaataatatcattataatactttggcaacatagtagtagtaactctagagctaatagagggaatgaaatataaaaatatttccttatttcatttccttgagagagcctgagatcatagaccaaaaaatgaagtgacctccataactaagtacaacagactctattttcaaaatagaaatatcttaaaaatagaaagttctaagagtctaagaatgaaggaactatttttgtatcttcagatcctaatgtatctccatgtgatcttgggcaagtcacttagtacttccgtgttcgttagctcccattttgttagcatactataaatactcaaaacaccaacattttgtttgtagacggtagcatttagaacattaatagcatctttgtgttttgttgttgctgctgttgttgttgcttttgtctttgaagggactactgtgatttttgcttaaacataccctgtttggggatgattgctgtggggggataactttaattattttaaagtaattgtgtatatttttcattctttatttctttgcttagcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttggggtaagtctctgaagtctttttatggattttacaattaaagtagattttaatcccccagatgtgttattagtcattattactttaggattaaactacaaatagattgaaagaacctgaggtaaatcagtcttttcatcagtctttagaagcctttttctgtcatccagtctgctctagacatagtcttgcaggtggctgcacacataaggtggcgatatgacccagcttgctgtgactgaggggtttcttgtgatgtgagactttcagtgctgaaaccaggatggtcaccctactcacctaccaaactcagtaaacataccaataatatgcttagtttcatctgcaagaacaaacatgcacattcttttagagcaatgattcctaaacttgtttgcacactggaaattacctgggaagcttaaaaaatattgatgcctatgcctgacattctagggttgtgatttaattggcctggagtgtggcttgggctttggtatgtttacaaaatccccagctgatactaatgtgcacataagtttgggaaccattgcttattcatcctgtcgccttctttgttttttctttaccttccatataagtccagctcaatactgccttcctctcctcttatctccctcaactccaagaccaaagaaactaggttcagggatgcgttattgccactctctacttagctttgtaatgtctaaaaagattcacaatgtagagaatacaggtttagaggtggcttattgaagtggaaagagtatagattttggagtcaaagagcctgggttcaaattctattcgcatgtgaactttggaattcatgtaacctttttgaatttaaatatcatatttataaacatagagacagtaatgtctacctttcagagtgttataaattaaatgaaataacatttgtgaaaacagtacctcagtgttttgtttttataatacgttgttgctcatactgcacagtgtcaagaccaatatctaaaatcattgtagaggattggtttgctacctctgatgtattctttcaactgtttatttcctcctgaatcaccatcatgaaaaaaagttaaattgcaaagatttgagttgttgggaagttagtgaatggctgctaaggatcttaattttttctgagcctgcttgttattgctttttgaatttgaccaaactcttaacccagagataatcaatagtttttttgttttttttttttgtttgtttgttttcttttttaaattccactaggatagctgcctggtactttattagaaaagcagatgctcttctttaagtcttggttgtggccacttcacggtgacaagacactggggcaaaattctgtcatttatagctgactacttggatgtattttccgcactaaagagaaggccagagttgagatttaatgatgttcttgaagtatttgaagagcttttacacagaaaatggtaaccagatattttccattttttctgagaagagagcaacagaaaataaagggcagcataaaggacttgggttacgcagaagaaacttctcgggagcatgagttattaggttctctactgaattattagagcttatataaaatcttagtctctggaggtctgtgagaatggagtacattctcatctgccagaagtgtgttttctcttgagtcagagaaatagtgtccattgcagatctgcctaggccagttagtgacttcttgaaatgtattatgcccttctcataaggcataaagtgcaaaagaaataattttttccttaccagagatacctagttgctttattttcttccacattgtgactctctgttacttagaagaacagtaacgttggtaaagagcaggcatccatgctccatttcattagcttcataaacttgacaaatagcttcttttagcctcattcgtcttaaccataaaaggagtgtgatccttactccagaaggatattataagaatgcattagaaaatataaaacaaaacaaactccaaagcaccatacaaatcttagttttataggataagcataaatgccctcccatctaaaataaaacattttcctttttccgtgattcttctattaaaccaaaccaagatgtcttactgtagaaaacttgggttattaatacaagttttttgataaagatagtaggtgattcagtccaatggaacagcatgatttctgttttgctctttccatttttcagttttttttcacatttcccaaagtctggtttgaaacccaagtgaagtagataatcaggtatgactccaatactcagagggaaatataagccaaaaagatatctggaaattttctgcatataccttcaattcatttcatccaagcattgattaaaacagttttgtctctttttatatatactttccccctaaataatcattgtgttttgtgtaaccctctagtcagctatttagctacctaacagtagagtttaggcttcgtgtctttagtttttgtttgcttttctgaatgttaaaatgtttaaagaattaccaaagagagtggttatttaaaatattcttgatgttattgtagaaatattaaagtggtgaatagcatgtagcctatagaagtggtaacacagttatatattgattcggatagttgttcacaatctattgctaagttaaaaaataaaagcaatatatgctttggcaggctgaggcaggcagatcacatgaagtcaggagttcgagaccagcctggccaacacggtgaaaccccctctctactaaaaatacaaaaattagctggacgtggtggcaggcacctgtaatcacagctactcaagaggctgaggcaggagaatagcttgaatccaggaggcagaggttacagagagccaagatcgtgccactggactccagcctgggtgacagttcaagactccatctttttttttttttaaagcaaattatagaatgcatctgatgtctatagttacttatctctacatgcctgagggaaagcctggaatgctgtgtactaaagcattacgatgataggattgcagattatctttattttctgttttcccttttccttttgtttatattttctgctttttatatagtgaatatactttgcttgtgtaaaaaaaaggagggtaacagccttctatagtatattattctacttactaggatttgctttttaaatctgagactgttctaaaaactaagagatgtagttaggaaaattccaggttcttgtccacatgaagtatctaatgggctaacactgtgaataactttggacaacagcttccacacacacaggtggataaactgtcagctcagtgacgaggaaaaatcagaaactggtattggaacttactaacaaatacaaacatagaagttaaataagtagtttactgaagaagaaaaataaactattcccatttcagaagataacaaaatatgtggataaaaacctgaccataagtaaacgtttttatttttatctctgcagcagtttggcaaaatcctagatgtagaaataatctttaatgaacgtggctctaaggtaagctccatttcagtgtcaagtgtgcttgatttctttttgagttttatgttattttaaatagcaagtattcagaaaacataagctgttttcaagcctgcataaaagtatcctaattatccaccttggtttagattatctctaaaaataagctaccacatggccaaactttattctgatacttatatgggggtggaagggtgatgaagtaagaagcagagaaggttgagggaagagtgggacgtaaagaacacaggatgtaggagatgacagtgctttatgagccttaaattcggcctcagctttctccgtttaaaggaaaagtgcaaagactaaataaagtgaaattctatgagaattctattctgaattctatcagaacaattcaaccaaaatccaacttcaaaacagcatacttagaacaaatttaatgttttgattattcagttaacttgcagtctcttttgaaaattgtgacaagacttaaacagagtgagcaataactgaggaattcagtatgaactgatttccttaagttctacccacataggcaatcctcaggatgtagagtcacctaaatcacaaatacagtgagttagttttttttgcataagaatgaaagtagtaagtgtgtacttttacgtgtgtattttcctctaaatgtgttctatataagaactgaaatttttaattaaaatttatttcccctattaggctgggcgcagtggctcacgcctgtaatcccagcactttgggaggctgaggcgggcggatcacctgaggtcaggagttcgagaccagcctggccaacatggtgaaactctgtctctgctaaaaatacaaaaattagccaggcctggtggcacacgcctgtaatcccagctactcgggaggctgaggcaggagaatcacttgaacccaggaggcagaggttacagtgagccgagattgcgccactgcactccagcctgggtgacagagcaagactgtctcaaaaaaaaaaaaaaaattatttcccctatttactattttaaattcccaatctgtatgatttagaatttccatgcattaaaagaaacagcaatgtttttaagaacaagggaatggcaaagacttacagtggtgttgtgaaaaaaaaaaaaagtatttgatgaactgaatatttgcacatgttacttgagagttttctcactgcttattaaatgaaatacatcctactgaaaccatcagccatagccaagcctataaatatttaccttgctgttgctactttcatttgttaggttagagcaattttttagttaattttcatttggtcatctctgctgaactttgaaaatagcttttggctatggttaaatctcttaaacatgtaatttgagggaaagctaaataaagccaataaatgagctaatatttacctctccaatttcatactccaaattcaccatactttgggaattgataacagagtttatatacctcctgtccccatctgtacacttaaaaatgtatgtgctgttctaatgctacttattattattcccttcctttgtagaatgtatcaacactaaaagtgtttaatcctgactataacaattatttgttaactattaaaggggtaattatactctaagcttccagttttcagttaaaacaaaaatgattaatatgcctatacagaactttctccagcacttggtaagtattttttaaagtgaagtctattcagactgcaaccagtaaactatttatgcttataatttttctcacgatggatttctgttcctttgttgcattgtttgtgtttattttatgtgatcttttttagctacaaggtgggaaaatgacagtggtttagagataagaagcacatgaatgtaaaataaatatgtggagatttttggccactctgtaaactactatctgaagtagttttaaatatttttagttgttaagtgtatgtacttaaaatattcttaactagaatctaacaactagaaggccaatgtagtttcatcaggcattgaggacttactccttaccaagaaaataatttgtttgaattattgtgaagcaaaggaaattgatctttcttaaggcttctttcattgactttaaggatttgcctgctaccaattctttttcttttcttttcttttcttttttttttttttttttttgaggcagattctcgctctgttgcccaggctaaagttgcattggcacagtcttgactcactgcaacctccgcctcctgggttcaagcaattcttgtgcctcagcttcccgagtagctgggataacaggcgcacactaccacccctagctaatttttggtatttttagtacagacagagtttcaccatgttggccaggctggtctcaaactcctggtctcaagtgatctgcctgccttggcttcccacagtgctgggattacaggtgtgagccactgcatcctggccccacatttttttaaatttacctgatccaattacttctctcatgtaactcatttgaaagtaatgacatgagctttctctttgagaaatctaaaagcataggctgcttctgtcagcttgatgctgtgtcctcactgccccatttttctttgggctgctaaagggtgcacagactgtgtactaattggtaaatgttttaaaaacaaagcatagaattcagaattgccctgaatctgccttcaaggactgatacaaaaccttgtttttgtcctttgaagctttcttaactgctacctaaagttatttgctggaatgggtgcccttggaactgttctgaggctcctaatagagatttattttggaatcaaacccatggatgcctcctctgggatccacctaagagaaattaatgagcactttttgttttgtgaattaagtttagtttcttaatccttttatatgtttggggttgactgtaaaattacagcgtattttgaaaataaccagagaaaaggaggctttatatagtcctattgtttagctaagagttcctctaacttttaaacagagtgcttttctgtacagaaattagctttattgaatttttttagagcagtaatggaaaaactagtcacaaaataactctaagatagcaatacttaatgtaaaacagggtttaatcaaattgttccaaagcaaaaagcaactccataccatatcttattttgtataataagaccatcacccagggttttaggatatacccatttgaaaacataagtaaacggtgttccactgccatgctcatgccctccttgtctgccagtattcttctttttccagcttgcctttaaagtagaattactctatagtagttttttcttagttgttgactagttttttccttttttccttcttttgccttcatattctagatttggcttacttagattatagaatgaatatatatcatatttgtgcacacacgtgcatacatatatatttaaattatttcatgtgaattttagtctttttactccctaatcctttataaaaacatagaatcacctgtatctaagtttctttgattaactgaaacagagatagactaggcttttaaaaatgtactattaagatatatgatggaaagtggtattcctgccaaaaaattaactaatttattcatatagaacctagaaaattattatatgagtttatgtagctttgttaattctccagatttcaccagtaatgacagattattaacacaaataataagataatgcctagagtgaccatatttcctggcttatccaggctagcctcaatttacacctgttatcttagcataattattaataaatgacccctttctctctcagaatgtcccagtttgaatgataaactatttactctccttatatatgctttgggtaacatcttaaaaaagcagtctttgaaaaggaaaacatgatgcttaatgaaaagtataaagaaaaaaatacatagtttattaaagagaaatgtgcactagtgatattctcatgtatccttctagtcttattttctcatatagaaccttaaaacataacccaaaatggtcacctagttcagccccctgtattcttgaccttgcattctctgctagaaacttttagtgattaagaacttgttttattcaaaagttattccattgtgggtcagactttctaccatcttactcaccatcatccaaccacataacaatttttggtgataattatcaagcttattaaataaagaaatacacagattgtaacatttacattttctataagtttttgccaaaatactttggtatatcctctattgaatggatatgtattaaaatattgaatatgctgaagttgttcagctcttcagatagtgctcattattaagtctactaaaggactacaaatattatacagcccagcaataattatttagatttctagcaattttttttcttttttaaaaattgatagatattagatgtacatattttcagggtatatgtgataatctgatacattcatataatcaaatcagagtaattgggatagccatcaccttaaatatttatcttttctttatgctaggaacattctaattattctagcaaatgtttacttaatgtgttctcattacttctctcaggtagatttctggaataatggggatctaggtttaggttgggcttaagtttaggctgtagttaggggagataaaacttctattcccattccttagacacaagtaatttgctgtaatgttttccctattatcatggcttttaatttcatgcaaagggaaattatttatttctttcaaaatattatcaaaatacttttttggaagtcacagtaagtaggccttttgactttcagtaaaacttaataggtaatgtcaaagtgaaatggtttttattatatttaaaacagaattaacagtgcatgtgtttctgaagggcttagtttgttttttttttttcttttgttaccattatgggctttagttttatattttttttatttatttttaaatttctgtgttctggccatacccaggagatctgtctgcttttgatttctcccttaaaagttacatggtaaattttctttctcattcttctgagatcgaaaaattcaaaaattatacaaattttaataatatttttacaatgttcattctattgctagttatttattgcagtctgaggccagactaaaaaggtgacagttacttggctcctatatgtcctcgatgatgtaaaggcaggctgtgaaattgctgtcacactttgtagaagttttaactacaaccatacacctaataaatacaccattcttcaatttccagaagtcagctaagatacctggtaaatcactaatgtaacactggtgtgtttaaatgtttaatatagaagggctctgaggactgcaaacttagaggagtataaagtgtagagacctgcattgcccagcacagtggtcacatttagcacttgaaatttggagagtttaaacggaggtgtgcctgtaagggtaaaatggacaccagatttcagaattagcacaaaaaaagaatgttaagcatctcactaataatgttttaatattaataccatattgaaatgttaataatatgtgtttatattgggttaaataaaatacattgttaaaattaatctcacctgtttctactttttaaatgtggttattagaaaattttaaattatatatgtggtttgtattatatttctgtctgcagtgctagtgtagacaaacatgtcaaaatcattttttaattaaaaattaaagtttacttttttaaaatctgattttatgaatagaagtttagataacaaaaattctccatctgtttacatagctgaaatatttcctcttgttcagaatttgagattaaatctgtttgttacagattatataatctatttgttacatatattataccggtgtagactggttcagtgtttgataggttgtatgatcatttggaagctgttctaaggaaaatactttagatttagacataattttactgacttttttttccaaagcaagagatcagaatgaccaacttaatgtcaattcaatttctaagagtgaagtgacaaaacatgagttcatgtaagcagacttttctactgataacttttaaacctggataatctgtgaacatctttagcactgtttctggcaccttttctaaaatgctaaattttattgaagaaatagtatattctaaaaatattttaagatctgagttcatgttactgaaactaaattgtgaatgtgatagataaggaagcatgtttgggttgatggaaaatcacctgtttaaagtttaaacatgagagaaaagtatttaagaacagtacttcaaaaattctagtcatacctctcactttcctaatcatggactttaattctaagaggtatgtattaattccctatgacttctgaacagattaccacaagtcgggtggcttaaaaccacacatttattatcttacagctctggaggtcagaagtccaaaatggctctcacaaggctaaaatcaacgtgttgggttcttcaggaggctctaagggatcatctgttttctccccttttctatcttctagaggctgcccacatttcttggactatagctcccttctgtcttcagagccagcaatggccagtcaagtctttctcaggctgctttactctgattcggactctcctgtgtccgcttttcacttataagcacagtacagtggccacgttggaacactgtattacattgggcccaactggataatccaggataatctctctatctcaagatcattaacttaatcgcatctgcaaaatcccttttgccgtgtaaggtaacatattcactggctctggggattaggatgtggacaactttgggaagccattatttggcctattgcaaagtctgtttatcttcaaagcaaagaaagaaatcttcttacctttatgtttcatattaaagagtcccaaaacatcaacaaggctttcttcctcctatcaccccagggaaaagatgcttataaagattgctttatttttatgtttttggtatcttgattcgcatttcctttggtgtataagcatctttctttataaaacacttttaaaacatttgaaagtgaaattttgttccagaatgttagtcattattgagaaaatcttatccaagcagacatgaatgttaaactttgacatttgctgactgtgaaattgcagtgctcatcataccaccttccattcttttggatgcagttattgtatcactaatgttctttcaacacatttcagaaaagaaggttatggaagatacttagcaattagatttgaaaaaagatagaaggattttaggactaatatagtttagtaaatagaatactgaactgagatttgaaaaggcttagaattttctcaccattagctggatatccttgggtacttaatctcagttcgactcagtttctttaccttcaaaatgaaaccaatatgtctattctttttacttcatggttatatttaagaagaaaaactagtatgtatatttgtatgtgggtgtgtagatatagtcataatgctaatatcaaaaacctaggtcttagttttcatataacttaatagtaatccaactattaatttacaatgtattaatttaacctaagtcataaaatatatgactgtaaggaccagttgaaatacagccaaaatgcccttaaagtgtgatattaaaactcatcactctgtgacctttctttaaaagtttgactttcctattggaggactcactaggattagagaactggcagcttgtcttcagcaggtgctagtgtagatgacaaatggtataactaattattaatgtgcccttttataccttgtggtgtcaaagtggctataaatgttgatatcaaaatttcatttataaaaatatgttcctgttgatattttcaacaaacttacacattctttaggagagtattaactgaaattaccagtagtatttcattccaagcaacatacgttttaaaatctctatcagcttagcattttgctttcaagggtatttgtgatgtccaaattgtgggtagagatcatccattggaattctccaaaacaccacccacccacataatcacttagaatgctgagttatcagatccttcaaaacaatggagttgcttttataaaattttattaagcaacgcgcattgtttaccgtgtcagttaagaacatgttttatatagagagaattgtgctcatgttattaagcagctaggcagaacttcagttaaaattaaagggttctgggttatcctacagtggaatattcaaaaaacgctagcaggacaatgaagttattggcaaatgaagactttgtagaaaatcctaagactttaccactttgcagatataagcagcatggaaattatttgtaaaattatagctgcagagtagaacgataaggacagagcacctagaatgaagtgaatatgatgttttaggaaagtcatataagtatatagtaaatgctcctggtgttaaaattggtagtacgtgaacatcggagtgaaggtagtcaactccctggtctcctgatttgtctacttaatgagttaaagctccactccatttttatagtatcttgcaaggaacaaacaaattaatcctaagtcattataccagctgcattgctgttttctgatatcctttttctactgaatagtgtacaactgatgtcactaatgtagatctcattcccattgcctgttgactgttccttttttctctatatatagaaagttactactacctttaatagcaggtataaacatcaataaatgaataatttaggcaaatttgggttagcagttttctgaaattcagttgaacatatttttactctaagtgtcaatctggtcatttaaaaagggcattgaagaaaagttataattgaccactgcttagtgatatttttatttgcttagaagagcatgaatgctctcctctcccacacccagtacatagaaaattgtacaccgactatgccctaagttatcctgttcccaaaggaattaatagtgataaaagcaacaggcaacgtggggctaaaatgattagacctactttaaaaaaaatctcattatgcaatgttgaacctgaatgtcagatttcatgtagcagttactggaaaataatagatttgggatgtcagagagtcaatttaattaagtcttttttagtattacataaaggggcatgtatattaaattaataacatgaattgagagagaaaggtagggcattaaaaaatcttcagatttttggttgaatagtttgacccgagtaactctgtaccttaattttggtctggcctcatatgctttatgttttattttattattgttacattgctgttaattattattattattacagttctttattcttttattggatttaatttccctttacaaatatgcatggaccaaaaatgtgactttgggagattattgctgagttgttgctgatgtcagtttcatactatgatattttttctctatttaccaagagatcagtatttcaatataacgatgtgcatgttttccccccttctcccgctgcatgcagggattcgggttcgtaactttcgagaatagtgctgatgcagacagggccagggagaaattacacggcaccgtggtagagggccgtaaaatcgaggtgcatgtctttaataattcaatttctggtttatatttttatttctcttttttcgtgttgcctcacttagttcacatttggaaccctgtcttatgtgtgcgtgtgcacatgtatgtgtgtttgtatctctgtcttcttcaccttcttgcactaaaatgtataaaagtaacacttctatctgcctccctcctcatttattggttgtttgggggttttaattttgactgtgtgtgtgtgcgtgtgtgtgtgtttgtttttcatttatgtttttccttcaaaatgttgatctttctgctctcttgatttttttcctttgcttcagtttgcaatactctgaattcctgtgatcaggcctaagcaaaactaatgttaaattgtctaaaaactatccagtttataacactgtgttctataatgaatcaaggggccagccaatatcctctctcttgggaggccagttcgcctctttgtgcacatgataagcacgaaatagaagattctagagattgtggggagggaggaaataatccaaaactcgtgtagtttttaaatatatctaataccaagaattttggtatctaaatttttatggataaaattcttaaacagagggtatgatggctggctggcgaatgtactgtgattatgaccaagtctaccgcctggtattcaccagccctttttgataacacatcgaaggttaactggctcctttcccctttcccaattttttaaagtattaaatgtaaaagccaccattttgagtaagatgtctgcatattttgctttttttcccctcctttccaatggtttagcatttagggcccttcacttgactcactctttccatggtaactatacacaatgctggcgatggtgcccgttggcggtaagtgaacaaaagcactagagaagaagcttttaaaaatgtaattacaaaacaattaaataagaaagaaaaagtccatctgccatctcacattaacactacaaaatgtgatttgacttgttgttcctcttccttttcctttcccccttttattttcaatgctgttgagtaatgccgcctggattttggatgtacatattgttttgtagcggtctgagctgtttgattactgacttcatggtgatttttttccccttgcacatcttactcagagttactgaactccagtttggctggttttattaatgcacttcctgcccctacatccttccctacttttcctgtttcccaaacccccgtttgtagctctgactgttctttctttgcccgttacacccttcctgactttctcttttctttttccctaccttactctctttttccggatccttgttcctgtccctttccctattcttcctttcccatcccttcagttacacgcagctgttggtctcttttgctgactggtggtttctgattggttctggccatttttccttttaagtgcttggttgctttctgctccagcagctggtttcagctcttgctccattctaatccttgtctgtgagaaccttgcttttcagtttctcccctctttccaaaattgattgttttttctttcttttatttgtgtgtgtgtgttttttaactgcatgctctcagtctcatcattgttgtatcccattctttctttttaaatgtgaaacgtttatattatttggtgggcgaagctagagtaaatggagtttcaagctctttcctcatatgggggattatcactgtacaaatcttaaaagacataggaagaggttttttttttagttctaattctacctaaaattggtcttttcataacaaaaatttattaccatacaaattgaacacaatgtaaatttgaagaggcaaaaataagacatttatattttatgcttcttttttcaattggcatgttttatgacctgacaacacagtataagtcaagttctatggtggagctttaccctccttgcaagagctttgagactggttctgtcactgggctgcagtatgctgacatcttagttccattcatcttttcttcagcagcagcatctttgtaacacctacttactctagcactgagaatgctttaaaatatgcagttctgtaatgagggtggagagtaccataaaacaaaataaataaacactttattttctcaattcttttaagtgcctactttaaaggctttcttaaaagctttgttcttaaattgatagaccatgtagtctagaaaattcagaatggtcctgaaggctgtcagcaggggaatcttaggtttctatatttgtttacttacctcagacagtaaaaatctctgacagacatatttaaaatgctgaacattaggacaggtgaaatcagatttattttatcacctttccatcaatctatttcataacccatgtggcaagcctctgttttattaacagacttcaaagtgaattgctaatatagtttcctatttacttttttctgtgttttccttagtgcagagatttctctgttaaaaagatgtccaaagatcttgcaaatgtattttctttggagtactgatatttggaaaccaagaaactcactttactcttgttatcctcatttgataagaactttaattaaaatactatatattaatattttatattgctgtgttaattatttaaatcactgctctcagaaatttacattttaaactaaatactctgttattggatgtgcaactttatgttccctaatgtggtccacttcttccctgcccttttttctccttgttatttttaggtgaataatgctacagcacgtgtaatgaccaataagaagatggtcacaccatatgcaaatggtaagaaattataatcttcgaaagagtgtttattcttgtgtaaatatatgaagtttttataaacttctaagaatgtctttatttccgtcttaagacagtttgatttgtgttgaagtagtctctttacctgggagagtattttatttttacagaataactttgtcattacaattgagctaagtttttagttattaaggtgttatgttctaagtaatgttcatcttttacacagtgcaaacatgctatctagttgcctattaacccaaattggatcccacctgagcaccttctttttcagctgctgtagctctttctaatatgttagacttgtccgtaatacccctggatgcccactgactcttacttttagttctgactttcattcatctgagcataagtggaataaattaggaggatattttaatcacttttataattctggacctgttgctctccttagccctagagataacagccatgggtatggttgtgtgtgtatcattttctgtttcatgattacatattatatagtaaggtttataagtttttctcattgagaaggaaattttctatgaataatttgttacatcagttaccaaatttaatctagactcatggtctctgaatgagatggaatataaatttaatctgtagcccagtggtggttttgcagactgttctgcagagccagtttgggagagaaaaaggaaaccaaatggattgaattctgaggtctcagctgtactttagtctgagcaattagggttctgcataagcttttactaatatctagaataaaggggggagtttctgctggagtttttttttttttttttttgagacggagtctcgctttgtcacccaggctggagtgcactggcgcaatcaaggctcactgcaagctctgcttcccaggttcacgccattctcctgccctcagcctcccgagtagctgggactacaggcgcccgccaccacacctggctaattttttgtatttttagtagagatggggtttcaccgtgttagccaggatggtctcaacctcctgacctcgtgatccgcccaccgtggcctcccaaagtgctgggattacaggcgtgagccaccatgcctggctctgctgtttttttaaaaagtttgaacccactgctagagtatggctgtatgtgctaataatgtcttaaatcaaggagaaatgtatccgtattgactatatcccataaagtcttcaataaatatatttagcccagcttttcacatagatgatacaaatttatcagcataatttgcatttttccttactccttttatcggtatgataccactgcctcccactttacctcttattttcttttcactgctcttacaaaaacaagtctctacaattttgataaaaactcaaagtaaacaaaatagaaaggagaggcaaagaatgtcaaattttctttacatctaagggaaatattgtgacagaaagagcctctgactggaattcagaaaacagacgttctccttctaggtttgactctttatttactccgtgacagtggaccagttttttaacctaattctgttttcatatttataaattgagaccacagatttttggcaccaggattttttaagaaattattgaaactcaaccctcccagcttattattaggaaatgagacccagaaaagtatagtattgacctcagattgcagatgtggtatctattttaccttcctctttgggttttgtgaaggtcaaagggcatctgtgaaaatacattgtaaattttctaaaactaaatatattcaaagtattactaacaacatgtcaatatacatccattatattgatttttgtttttgttttgaggcagagtctctctgtcacctaggctggagtacagtggtgcgatctcagctcactgcaacctccacttcccgggttcaagcgatactcgtgcctcagcctccagagtagctgggattacaggtgtgtgccaccacatccggctaatttttgtatttttagtagagacgaggttttgccatgttggccaggctggtctcgagctcctagactcaggtgatccctccgcctcagcctcccaaagtgctgggattacaggcttgagctacggtgcctgcccattatgtggatttaaagggaatgctcaggcaatagtggcattggtaggaaagaaaaaggttattttttaaaatattattctaaattaatattcaggtttagtaggcaagaaaccttctgctattgtgttaaaggtcctaagaagaatttgttgggttcctcctaatgaattctcagtcagcattctcatttaggttggttggaatctcttaatttgtgcagaaatgttgcacagtatttgtgtaatttgatgttgcagaatatttgtgttcttacaattcaagtaggatttgaacctagattttgccagaattttatgtggaatattgaagagacattgcattttatgagcacataaaatgatgaataagagattggattgaatcagagtgaataggttttcacttgaataatgtcttgcttacagtcatttaaatctggtaatttcaataattcttttgaaaaggccaattgtggctggacgcagtggctcaagcctgtaatccccagcactctgggaggctgaggcgggtggatcacctgaggttaggagttcaagaccagcctggccaacatggtgaaaccccatctctactaaaagtataaaactagccaggcatggtggcacgtgcctgtagtcccagctacttgggaggctgaggcatgagaatcacttgaacccaggagccgaggttgtggtgagccgaaactgcgccactgcactccagcctgggtgacagagcaagactctgtctcaaaaaaaaaaaaaaaaaaaaagaggaggccaattctggcctttttcttttcattcgtatatttatagaatagtgtggcacaatgctagggtcttaatataaaaagacaaatgagtcagaaaatatataatatagagtatttttgcttatatgtaaaattcagttaatattgattaaagttttcatgtggaattctacttttattcactcgcagtgagcaatcgtatattattcctttttaaaaaatacttgccatattcctataaatataaaaaagggaaagaagaaataaagttgacattaaacataatgttatttggaaactcttaatatttataaatatttaagctaatgttccacagtattctggtgttctttagctaagaagtctgattaacttaaaggtgattattacacattaaagcctcagaaaacatgcactgaagttgggaatgtaccttgaattttactatttcatgtctttccttttttagttggtgaaccccagtaaaatcccaatggtaaatccgagtaaaagtggatttcagtttacctggaataccagcattgtatagccaaacatggagtcaaagatctaggttgaatttgagttcagcccatggatacctttattaaaacaactagagtaataaacagggttgagaaaatgcatcacagcatggttcagagtgacatatagtcggccttctttttttaaatgaaggataggtcatccagggtaattctgtgagaacactttaccaaactctaggatttatttctatttattttttctcctctcattccctctccatcttcctcctcccaacatcatgacacctgccaagccccccagccccagcccctcattatctcttcactgtgtcctagttctactactgttactctctcatataaaccccaagctggaattccaaagagaagttgataataggcaaaaatagccccagagatggctgaagccaacttgacatgcactgatcatccctttcctcaaacagtcttaaatgcttaccttccattttgtgtgtttcaggttggaaattaagcccagtagttggagctgtatatggtccggagttatatgcaggtagtatttaagtaaatgtttccacttgtgctatttaattgtaatagcatctgctgtttttcaatttgtgactcctttttaatcttcttgcatttttaaattttttaaaaatccaatcagcatccagctttcaagcagatgtgtccctaggcaatgatgcagcagtgcccctatcaggaagagggggtatcaacacttacattcctttaatcagtaagtagcctatgttggcctggcatggattttgactgttgtgagtgaactatcatgtactgtttttttttttcctagtacagtacataactgaaatggaaatttcttgagagggatattaaatactatcccagtgccctgtcctgcttaacctgtgctagaattttcctgaccaaatattaagattgcacaaagcagaaatagttggaaaaggtagagggggtaagggcatatgaagaatattttagtctgtacttgacgataaagaaaacaaaagaagcaagtatgtgtagagcatattatacatttcctctgcgagtcagccacaggttctccagcagaggatcacttagaagtacttccagtattattgattattcccagctctcttgatctctctaagtcattttgacctgagccattttactccagcaagaggtataattaaacaggattcagtggacatggaatcaatgtctctgcatgctttccagaggacagcacacttaaaataggctcttagaaattgtctgcctctttaaaggatatgaggcccctagaaattgtctgcctctttaaaggacagggtaggagttgtttccctcaccttacatttgtggattaaaatgttttaaataaaagaatgaaattgactaatgaaatgaaatgtctaaagactattatgtgccttagaggttggtaccatgtaaaaatataaaaagaatgttcttttgagtaataattattatgtggacatagtaacattgggaagcaaggttaataactgaccggttgaagagtttgtgtcaatctgatttagactgcccacagtaattaaaagtctgtctcttattatggcagtcattctcagagcttcttgacctgtttctcagcagcttgcattgtaaagctgaaattgagaaggaacagagaagctcactcaagatttgtgatgaatgaggcatggaatcttttgcttttgcatgttgggtctctctttccatttcttccccactgagagacccagggtagaacgtttattgaatgcatgccaccttttccaaaaaggtgtggttcgtatctttccatcttttctataattggttcatagcaagttgtgactgtgcaccttctattgaatgcaagttgaaatttctgtcatattttgggtctccctttagttcctggcttcccttaccctactgcagccaccacggcagccgctttcagaggagcccatttgaggggcagagggcggacagtatatggtgcagtccgagcggtacctccaacagccatccccgcctatccagggtaagcgttagattccaaaatcagtatgtttctaaaataagcagttggaccaaaaaagaataccatggccctttcataacttctgggatgttgccgtgtcacagagtaggcattcagtgaatatttgcaaattaacagattagatgacaaaaaacaaaatataccatcatcagaatgtgacaaactgtcaattcattataagtcttcattttggccaccttaagccctcatggtaatggcttaagacagtagccagaaccgtcttgtgtttactagcagtgtgttggcatgaagttcactcagaagcgcacgaatatggattaacattactgcagagaaccaaaagaggagctcaagattgtagtacaagcctgcatctgctgtgttcacctccttatcaccaccccgtgttggggcagaggctgtcacatgtgtcctcccctttggtttcactgcctgggtggtgagcagcagagctagttacccacaatggatttgctttctttgtaggaaacggattaaaagaggttaattctaagatgaaccaagtccaattgaatcaagggagaaagggagaagtaggaagaattaaactgcagttggcttctgaatgatggtaaaacagcgactgtagctgagcatccttcaccgtttgatttttttatggagggtgtctcatgcagtggaatgattccatagcaacaaataaatcctttgctactgaatggggaaaaggagtgaagatggcaggttttgtttttaggggtttctcagtgtcagcctaaaatgcaaatttttatagagtggtctttcatgagtcagttgtaccaaggacttcctcatcaaagatgtgacatttctcttcaccttttctctgccagataatgtcaatatgacatatttttttttgtattcttacggaggaataagtagcagcagagaagcttgttggctgctacttagttaaaatataaagggaaggaacctcctttgtatgtccttttctgacagcaaaattggcttagccttgaggtgtactaatttagcattcattcattcattcattcatagaccaaatggatgtaccattagaagttctccattccacagagttaaaacatttttattagacaaggtatgttgaagtgggcaggctccaaaagacactggaagggaactgcttcagaaattaacttttgtttggagtttgtagacatttaaatcacatgcattccatcatctccatcttatgccattacttacttttattttaatccttttttctctcaacttgacctttgaccttcaacctctgacatctctttaaagaagtgaatatgcagtattatttcatcaagaaatactcaaatgaaacattaaaaggaaccttttggaagttttacacactaggaaaattgtttgtgaaatgtcttccgttgtaatccaagagaatttactgtcatatttgcaaagagagactactcaccagaaacatgggacttccttattttgtaacattgctgaattactttataaagtggttgaatttagtcctgttcaatgtagtcgtttcagtatattgaccaaacttgagaacccattctctaccaagtctgtgtcaggtatatatttgctcaaagatattttatctttatgtctaatcatatcaatttctgtgcattacattgaacactgatttcccatgttttctttttattaactaaaccacctgtttacatggaagatggcaaggaataagtccagtatttcatgggaatggcctagaattgcttttcagcttagtaaactaatttcatcattaatcattacgtttctagcctccttgtggcatttgatacagggaatattgggattcttctagaacgtagatgaatattcccaataagttatttgacttagggtaaaatgtattcgtgtttttaatgccaacccttctttatagaaggcttatttgtaaatctttgcctatatccccttactaagatctttgaagtttaattaatcaccacttggtctcagtgctttccattttatcagccttctcattttgaacaagttgtttttttccttaaaatgcagctgagaggcagattactttctaatatcagactttaactgcaactggagactatgaaaatgaatgggacttagctaaatgaacatcagagatgagtttgatttgccttttgtgtgatacaagggcatagcatatttggggcattccaaaatgtgaccatgctatcctgtaaatacaaccaaatgtcattggaaatagaattaagaaacattccacctacctataagaaataagttatttcatattcaagttaaaaatatgatttgatgactttacttgtcagcttgtttattgtaacagagaaggtagtggtgaaaatttccagcttgtttagttgaataaccaataaacagatcatctaaattaaaacaatctgatcttgacttcacagagatgaagaagaaagttttatcttttatctctactgctattccatgtcctttggtcccaaaataatgttttggggaaagtctgtataagtctgtatgcacaaaggtacctcagaaggttggaaatctatacttaagaatatagtgttgcttaggttttgttttttttttttttttaaagtcatgcattgtctgtttgctacaaattcattatctaaacaggaaaataaacccttctattcttaaccagctaccttctcagatgtattcttttaaataagacagggtgatctttggtcaagcccagaacttcagttatcaattgtatttttcagaattccatgaatactcttatagtcaaaaaagaacccttaaaatcttccagttactccttcccactctggattatattgttactatctgggatccccactgcacctttcaattcttggaccttggaccaatcaccttaacctttagctcattatctctgcttgtgaaagcaatgcattgtgggtatttttggttgtgttttttttttaattacatttctctgtttactttggtcagaattgattgacttgtttttctgaggtgttgcattggttcttaaaatgctgaataataatactttgcatgcttgtgtgatcagccaaatcttatcgcatgtctaatgtgcagggtaaaaagcaggtgatgtatggatatcagaaaaacatttacatattattacaatactgaaaacaaaatacttaaacgtaatgtaaaaacatactttgcatacaggccctgccctagtggaattctttgggttcagtttttcatgttaaactcctcttcacccctaccctactttgtaagctctttaaaaagaaacttcctcctagggcaagcttatttttaaaaatactccatatacaaaaagttatttccaagccagcagattttggatagatataataggctcttctaggagtgctttttattgtgtgaatcctactttaattaccaaatatccaggttgcgcattctagttttgcacacctttccctctcctcgcatgtcctggagctgtgtaaccttcgtgtgcactttcacattttctcaccaacttgccgaggccccaagcccaggttatgtattcatacatcacctgcctgtgtagagcgcatgtgcatgctgccgtcctcaataaccggaatgtgtttctgttcttttgttttttttgtttttgtttttgtgtggattttctgcagtgtggtttaccaggacggattttacggtgctgacctctatgtaagtacacacactggggccttctcgaccccatcccctgacaagccagcctttttttttctgtttctttggtttggtttggtttttttccttttaatttatttaatttttattttctttttccttgtggatatatatatatatatatttatatatttaagaatgcaagcatgcttctctgccactgcgcttgcccctgggtgcaaaaactaagcctttgggtttcctgatcattgcaagggtcagtctactggacatattcttttcccttccctatacccacagatgttctgtggatcattaatttacttgtgagatgatcagcaggtttaaagtcttttattattgtcgtgtcatttgcatacataaataacaggactagcttaaccttaaaccagctctttcccttttctgcttttcttctcatttcacatccctctttagatcattagagctgtgatttagaggttaataagctttctgaactgtacattttcctattttacctactttgagagaacatgaccttgtgatagccaaataaggaaccgatgccagcaaagagtgtgtagtaatgagaaaacgccagatatttagttcttaaaagccattggaggaaatgagtagcataatcagcaacccagactcttcttacagctatttgactatcatagatttgctgactctactagccatagtaatatggactccattatttaaactgtctagctatcactaaagttccatgattggtttgtcacatattatttaaaatgtggacaaagtgatataattgacaaagtacaagtttttgagttttgaagtcttttatcatgacctctccagatggactttttctgaatgcaagcttgatttagtcgctcaagtcatcaagggaaaatttttataagaaaaacttgtcagcatgaaatgattctgtggggataggttaaaattgtctagaaatactttctccacccttactttccaaaatcaataagaggtcctttttagtgaactgtttccacagtctaccagagattcacaagcaacctaaaaaagttaatgcactttcagaatgcactcagaggttttgcgttttgcaggaagtagagatgggatgatacagttcttcgaaatacaggtgactcacctgtactacttagcataggcctgtaaggtatgccttaatttaataactacttgaaggaacctcagctatgatttggtccaacctcctaacttacagatatatttctcagagacttacccagaactacataaattattaatagtcaggcataaaacccaaccaatccatatttcattacctctctttgtactttaattaaaatccacctctttcctcaaaatattttcaacaagtaatgaaagatatcttttttcctatgttcacagtgaagcttgagaactggggaatctcctacttttacaccagattacatatttctaaatacacagacttacatatgatgttagcatgtacattctcccatatacattagtgtccatattctcatgaaactcatctttgttatttaacttgttttcttgaaatctgatctattagaacaagattttccatttgagttatttcttaaatcaagtttttttctctaatgtgtttcttatttgaggatttatttttcttaaatacaacctatttatgtcttattaagacttgcctactttgggccgggcacagtggctcaggcctgtaatcccagcactttgggaggccgaggcgggcagatcatgaggtcaggagatggagaccatcctggctaacatggtgaaaccctgtctctactaaaaatacaaaaaattagccaggcgtggtggcgggcgcctgtagtcccagctactcgggaggctgatgtaggagaatggcatgaacctgggaggcagagcttacagtgagctgagatcgtgccactacagtccagcctgggtgacagagtgagactccgtctcaaaaaaaaaaaaagacttgcctactttggccaggcatcatcgctcacgtgtgtaatcgcagcactttgggaggccgaggcagggggatcacttgaagtcaggagtacgagaccagcctggccaagatggcgaaaccccatctctactaaaaatacaaaaattagccaggcgtggtggcacacgcttgtagtttcagctacttgggaggccaaggcaggagaatcacttgaaccctggaggcagaggttgcagtgagccgagattgcaccactgcactccagcctggctgacagagctagacttcgtctcaaaaaaaaaaaaaaaaaaaaaaaaaaaaagacttgtctacttcaaacttgttaagtcaaccaacccaattttttaatagttatcttacttccttactttacaatgtaagattttattgagacagatgatttttctgttcctgttaataaaatactcttggttttttttttttaatctactaactggattaccttgctgagctaaacacaagtaattcagtgatcttgctgaaataattttttttgaccagtggccccttgttaatgaaagtaattaatagtaatgttattatttcttagttcttatcttaaagcagagttacttagagaaaaaaaggttggtcactagtgctgaaataatatccatgcccctacatgaaaagcaagaatactttatgaggtaactactgagttaggcctaatacaactgttgcttttaaaactgtgtgttctgtattccacatgtgagggagcaaaggatacttcttcaaaaacacacagacaacaaaacactatcatttttgccttgagtttgttctgcttctctccatacatttcccatctgtggaaatctgtcagcatacatttagttcttatttcctccgaaaggcatattagaaatagaaggaatagagagtttagtatgaaaagtgcaccgaatcggagcttgaagagaagacacaagggaaaagattttaaattgctggttatgcttaagttaaatgaatttaggctattaattgtgcaaggtttttgtaatccctttcacagtcccattcttagacagtgattcctgctagccatttactttctgtttcttttatggcacattcctctctggagaactgatctagcaattctgttcctagtttgtaaaaagacctaccgtgataggatttgggagtgtggcagctagattatgtatccagccctccctcttcttttttggccagtagaaaaggcatagttcgccctaattcactttttaaatgggttaacaaactgctcctaaatcacctcctgtgaaaagcatgcttgcatccaaaggaaagaaaaggctggtgggccccttagtgggctttttgtatgattgttttccttccacagctgtgttttttgaactgctcttcctgtgttctgttatagaatagtcttacaggaaccaatcattagcgctaaaatacctcaggtaggagtgccagtgtgacctgccaatcaatcagattgtggattgcagtgaaaaaattgaattatactaaccattccagctccacgttagagatgggaacagaggcttttttggacaatcaagacttgtgagcgtgtgatctaagccctgctacctcagcagtgcccacagtcacattccgtacataatggcacttcctctaaaattaagtgctcctgtcctcttgacacatatcccagccaggtgtgtaatatgcactgtcccatcactgccacctcttttaatctgtcagtcacatgtacctgtggtatttaaactgtttttttatatttagatcttagcagttggggacattttcttactactataaatttagaaaagagaaaaaagaggaagtagaactgtacaaataggatttctgaatcccacattgggccctgtagtgagataccagttgtaattggactgtgctgctacataagtttgaagttgccttaaaaatctagacatatgggactcaaacattgagacatgcatttcccttggcctcttctcctttcacctaagaagatcagtgagttcatttggataatagcatacttgttagaaggattgctgatagctggatgctaggagaaagaaaatagtcgatggcttttcacaatccagtttatttatgtggctacccagcaagattttggaaatgaactaatttggggagatgtggaataataatgtttgaaaggtttgattattgaaaatcgtctctcatctaccatagaaataataggtggaagacatcaggttgatcatagcaattttttcccttaaccccaattttaaacaataataagataaaatttaaatactttaaaatttttttcataagtacttttcaaaggagacagagctcaatcaaaagcagtgacggtatcaccattattgtaagtttgtgtgttactcacatttaatcagtgatgccattttgccacaaaagaactctataatatctcctagaaccatggttcttagcaggggtggggaggtggtgaggaaaaagagggagttagattcatccaaggataaataaagtgattcctggaggcccagcattaaacccacgctagttggaatagatctctgctctgctgtagtgattttcagcatcacacctgccattccttacccaccccctgccgccatcccccaaccctctgctctattgatctatacactacatgtaggtaacaagctttcattttgtctgctggtcttgaaatacacactctcctcctcagtgtcacataatgtcattgtcttccgggtagaaagaaggtgtcttgacatcacatgctcaccaaagtcctgttttaatgtaaacctaaaacaaaaatataataaaattaaaagctaggttaaaatcaagacaaggcaaaagtctgccagtgtgagattaaactaataaatatgcagataaaggtcagatataggagggattatattctattgtattttgctctagtttaaaacccagctacagaactgtgccgaaagatcatgtggtcaacgtggcaacatcataaagttaatttgatgataaaattggctcagagcagagtagaaaagccctaggagatgacattgagccatgaaaaactgagactttaacaactgcagaaaacactggaaaggatcttaaagccaacttttcaaaggcattttcctttgaagaagctggaacttgaagtcagagataggttacagatatgtgaaaaagtaaaattcctaaacacaggaaatattttagcagaatgctgtggattagaatatacggttgttgacagagggcgagcatacatgtgagtgctgtgggtcaggactgaattatattgccagtgtcaggcaggttgaataggggagcgatgaagcactgggcagccccactggggacaccaggtatcattcagaatgaattgcaaaggaataagaataattctttttaaaggggcatgtgtgtatctgaatcaagcttagccaagccaaatttatccagctatcagagttccaaaaagccgtccgtgtgtgccctcctacattagggtgtgctgtggccatgctaatccccattttttgttttatttcaaatcacacacagatagaatctgcaaactgcttcagatcaaacaggtctgattgtgtgtaaatacatatgtcctttttaatttttattattaatggttgcttcagttttgcatcagtgcatggttaaaagcaatacacatcagctatttcatgacttcatatctccaaatgaattatttctcctctttttttgtttgtttgtttgtgcagtcagctgaagaaatgttaacatctcactctaaatctctcagtggagtctctgttcccttctctgatataacagatgggttactgcttgttataattattaacattgtggtgtgggccagggctagggtgggcaagattgactatttctttgggctggggaggggccagtcgttagggtatggaatgttaactcaagtggtgactgactgtttccgtaataccaggtcgttgtggctgcacgctctagtaattgaggctgtgtacttcaccgagcttgtggtagagcctagggcaaaccgctgtcccaagagaatgctgggatagatagagttagccaatacgagtctgaacgtggtgattttgctggttgtttagctccagatgttggcatgcttagtttttaatgtgattaataaatgtggcgccatatccctccccacgcctgaaccctgtctcttctacctccttcccacccttgttctttttgaaaaacttaagaaacagtaatgaaaaccttggtgtttcaaactgcactttgttctcatgttttataaaagcctttagatttgctagtaagagtgaaagctgaaaaaacggtttctcagcctgaaatttctatgcactttgaaatctggaatagaaataaatatatctgaattttctttttctcacattttgtgatatgttttgttgaataaagcagcaaaaatactttcgagtaagtgtatgtgtgtgtgtgcgtgtgtgtgtgtaagagagagagagaggaatacatccatgatacacaattaatttttctacttttggagtagtcattagtgaattaccaagttagtttagtaggatattgcctatctatcctaaaatagttcatcttttaaaggtttctctgtaatgccattattataaagtaatcaggagaataatcatgttaaagtcatctgctttaaaaaaaactcttcatgtgttttttcttagtgctgatattcttgagccttttgttttcagtaaagtatttgccaaccctgttctgttttcttccacttgaaaagcagagaacttcatcatgtttaaacttcaaagtcagacttgacttatcaaagaaggaaaccgctacagatagattctctccatctccttctggattggaaggaagattcttttccatagtctgatccatttgaattgttttgattagcagtaacattactcctaaaccaccaaggttcctatggcttcctgtaggcctaggaaaatgaggggaaattggttctgtcagcaacctcacttagaacctgttttttaagaatacagcttaaagccatgatttgatagaatactcagagatcgtacctccagtacctcactcagtcttcctgagagtcaggtgtgaaacctacccttggttgagtacttttgaacctcagtatccctttgcaagaatttatacctctgccgtatggcataagacttcagtttttaatttttttacctaggtaaacatgaattgggctttaactgcttttgttgccttaactttaaaatttttttaatgttactttgatggttggagtaatactaaagagtaaaatgctgaattacccttgtttgcaaagaagttttactaaatagccctgctgtaactttacactagcaaacaaattctaaactaatggaaccatctctagttataatgaaaaattactagggttcattttagtgttaaaattccaactgtaattaacatttgctttgtttaacaaatgcttaaaaaaaaaaaaggtaaagaaatactttagttagtttaattatgttgtggccaggatttacagctttgcccagatcctggctagaattccaaggaaccatgttgatcagaaacggcccccaagggtgcttcctgccatgttcccattcattaccatttcattgtcagtgtttggtaatattaattagagtcttcatatatctctggaagaattcgtaattaagaaggaaatgtttactttctaagtcactcatttgaaaaacaaaggaggaataatgtataaccactgaaagccagtcagggatttttttaagtacatttgaaactaccctgacttcaagcagcataaacttgaagagcaggaataaatttccctcacaatgcagtttcttcatttagagaaagcataaattatataaggaagaagcaaaaggctttagaagctcataagaaattataggtatttctaaaataaggggtaacaaataaaagaagcaagctaggacttgccatgcaagatggttaagaagaacaggggtccccttagaaaatagttgttctcaatcccaagaaatgatacagaagtaaatttgaaatttcttttgtagatttagaaaaatcgaacatttgaaaaaataggaagtagaaagcacagggcagaaaccttcagatatccatgagaaatgagcacattttatccacagaaataaaatgtttatgctattgttcactactgaaatgatgttcagttgggccagttgaacatagttgtttttgatagtgaaaggccaataataaaaatttgcatctgaattacgtttaggtaaaatagatgaattctatttcataaataataaaaagtagagtttgccacttttaaaaatatcctgtctcatgtggcaagcatttgttgttgtgattgtctcttgaaatgctttctgaaagagtgcatgattcaccctgatagtgaaaaccttttgtatatttgagttatctaaactgagttgaaatagaaggatgtgatggtttgaaattctttaggactgagaggatatttggactattggaagaaaagctcagagtctactgtaagattaatatgtaagaatctcaaaaccttttagggaaggaaaatgcagttaagtgctagaagcagggttcctgatctatttgaatccagccaaagaatcctcagaaatttgtaattgatttgctcaagtatgaaatgtagatctgagttggcaaactttccgtaaagggccaagtggtaaatatttttggctttgtaggacattggtctctgtcacaagtactttcaaaaacaggtggcaagctgcattggctcacaggccagagtttgctgacccctgatctacattgtttttccttctaaatattacctgattatcttagcttcttggcaaacatgctaggccggatggagcagaggtttctgttacatgctgtagtctcttattaatgaatcaatccaagaacacgttagagaatctgaagtcaacacatacagatttcatatattttaactttataatttatatttcttgtcagagtgctcccaacttgctgtaaatattttcgcttttgaaagttccaacaaagactgtgaagtaagacagattcaaaatcatatcttcattccttgtatttaacaggtactaccaaactttacttttaatactatcacaaattggaaagcaaatccttgcatatcgtagggcttaattttttattggaggaataataacatgcagactgatgcagtttgaaacattttcttcccatgtgtgtgtctatgtttgtgtcagtccctgtgtctacatgtgtgtacgtctgtgtgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacgggtatgtacagagacagtggtgagctttgggatgcatgagagctgttccatcccaaaatgtcacccattttcctcccttcaccatttccacagcagctcttagcacatcgggcatcttgccagcctgggctttctgcagacctcttgatggcctctgtcatgcctaaagcacaaggcaccgactctgtcctccactccctctttcttgttctcatctcttctttgactttgactccagtccctctcttcctcatctccaactcctttcttttccattttatggaagtacttcagatttttttcagttattgcatttgggagtagaaatagaaaggttttttcctattccttgtaattccagtttccttatgataatccaagaccaagtgactcacaagtcttaaagcacagtaatccctttaatttttttagatcatacacttttctttatctgtctgattgtgtttcttctttccagttatggcagggtgtacacagccgacccctaccatgcccttgcccctgccgctagctatggagttggcgctgtggtaagtatataatataccattgctttataaaaccatttcattccttcttttacccgtagactacagaagatctagggaggtagtaaattcagcctttcatccaccatcaaggtattaaagccacatagatctacctggaagtttcatgtcaccctctttatttgtgtgttattataatgtgagccacatggcctagttaagggcagcagaaaggaatgatcattgataatatgccccgagtagtggcatgatttgcgagagaaataggggaactggtgaatgttttctattggttcaaatgttgagtgcatacctgtggcatagtttcattgataggtgttggcaaaggagcatggagcataaggctgtagtattcacagtaagcttttcaaaaacttaagtttcaaatgcaaatctaaaggatgtctctgctcttcctaagccttctggtagatagtactagaaattcctaagtgaatgctttataggatattttattattgattattgataacaattgtggcaaaatatggtgttgttgatagaagtatcgaagaagtccatagaactagcataatttcttctgaccaaccacctcactgcagtattattgtgttggcttggatgcctccagtttcagtgattaggactcacaggctgcaacaaagacaggccattccacagtgacacctctgccagggctttctctctaatccaaaatgcaactgggcaactacctctggacatgggtagagttgtttgaaaaggagacagaatgaaatgtaaaatgtaagacctaaaggaatatgagaaagctacttctcacaccaaatttctactgatgaagatttgtggaaggaagtaatagggggccctgagggaatatatgtttataaatgaagtagagcattacaatataacggcagtggtagaagtgcctgaggttgtatttcgtcctaaaatgatataagtcctatgctaaaagaatgacctgagaaagatgcattcctgggaaacttctaattgaaagagataagccattagataaagtcatttgataaacataaaggaataaagcctagttaaaaccccagctagatatgtaaatgtgaatatgtcaagaaacagcctagttggtgtgcttcgtagatgatagaggaaacagactttattaaagactggctcaggtttagatgtggcaccatctcaaacatgggctgtgaccacacatggcagggatcgtgtcagaagtaacgtgcactgccgatgggtcatatgtgagaaggagaaactggtgatctgttttccaccaggattataaggctgtatcaaggtaaacaaaaacctgtgcttttaaaaatcaaactctttgcggaacttgttttcaactgtgtattgtttcccttctgtgctaattcatgtaaataatgaaataaaatgtcgtcatactctccttgagaatatcaggtcagcaataaatgtgttgggctctggtctgagcaccttagaagcagaagttggtttcctgacttcactgcacaaggcaatgcttgatcagttgctttgaggcttcgaagcaggctgtttctagatccctctctggacatttttcttcactgttaatgcttctctcatcaaccttttaattatttttatctctttaattactgcaggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacca
